United States Patent 11,098,302 (IDENTIFICATION OF POLYNUCLEOTIDES ASSOCIATED WITH A SAMPLE) - sequence listing, part 9

SEQ ID NO: 27617 - DNA, 519 bp, Homo sapiens
  misc_feature: GYAE6OF01D0BYK.22.5.A05.1.454.CMB.1.raw
  modified_base (402)..(402): a, c, t, g, unknown or other
  misc_feature (402)..(402): n is a, c, g, or t
  modified_base (417)..(417): a, c, t, g, unknown or other
  misc_feature (417)..(417): n is a, c, g, or t
  modified_base (492)..(492): a, c, t, g, unknown or other
  misc_feature (492)..(492): n is a, c, g, or t
  modified_base (510)..(510): a, c, t, g, unknown or other
  misc_feature (510)..(510): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaggccctagactggcttgcactcatttattggaatgatgataagcgctacagcccatctctgaagagcagactcaacatcaccaaggacacctccaaaaagcaaagtggtaccttacaatgaccaacatggaccctttggacacanccacatattactgtncacaccacacgggtactctactgctgggcttccagtaccaacttgtcgtaacccgtcggggccacggggaacccngggtcaggtctctcctcngtccctccc

SEQ ID NO: 27618 - DNA, 582 bp, Homo sapiens
  misc_feature: GYAE6OF01BWWV6.22.5.A05.1.454.CMB.1.raw
  modified_base (569)..(569): a, c, t, g, unknown or other
  misc_feature (569)..(569): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtggggctggatccgtcacgcccccaggaaacggccctagactggcttgcactctatttatggaatgatgataagcgctacagcccatctctagaagagcagactacaacatacaaccaaggaccaacctaccaaaaagcaaggtcgtaccttaacaatcgaaccaacactacggtaccctttaggaacacagacccaactattattactgttcgaccaacacccaacgtacgggttaccttcgtacgtcgtcgttcggtcctttacgaacgttactaacgttcggttaccgacccggtcggggaccgacgggacccttgggccaggtcctctaccctcnccgccctaacccg

SEQ ID NO: 27619 - DNA, 581 bp, Homo sapiens
  misc_feature: GYAE6OF01AQQUD.22.5.A05.1.454.CMB.1.raw
  modified_base (381)..(381): a, c, t, g, unknown or other
  misc_feature (381)..(381): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaacggccctagactggcttgcactcatttattggaatgatgataagcgctacacgcccatctctgaagagcagactacaacatacaactaaggacaacctacaaaaagcaaagtcgtaccttaanaatagaaccaactatacggtacccgtttaggaacctacacgaccacataacttactgtacgacacaaccacgacgggttcctactacgtcgcgttacgtctttacgagttaacctaacgttcggttaccgaaccccggtggggacccgaacgggtacccctgggtccacggtcctaccgtccctcacgtcccgtaacccg

SEQ ID NO: 27620 - DNA, 538 bp, Homo sapiens
  misc_feature: GYAE6OF01EL507.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagccccaggaaaggccctagactggcttgcactcatttatggaatgatgataagcgctacagcccatctctgaagagcagactcaacatcacaaggacacctacaaaaagcaagtggtccttacaatagaccaacatcggaccctttggacacagccacatattactgtgcacaccacagggtctctactgctggtcttacagtacaacgttggttaccgtaacccgtcggggacccacggggaacccttcgggtacacggtccgtcctaccctcgaccgtcccgtaaccccg

SEQ ID NO: 27621 - DNA, 655 bp, Homo sapiens
  misc_feature: GYAE6OF01C3BEY.22.5.A05.1.454.CMB.1.raw
tcagacatacgcgtcacgaccggtgctcgatttagatagatagacagggggactcctgtgccccaccatggacacacttttgctccacgctcctgctgctgaccatcccttcatgggtcttgtcccagatcaccttgaaggagtctggtcctacgctggtgaaacccacacagaccctcacgctgacctgctaccttctctgggttctcactcaccacttatggaggtgggtggtgggctggatccgcaccgacccgaaggaacggccctagacgtggcttgcactctatttagtggaatgatgataagcgactacagcccatctctagaagagacaacgactacaaacactaccaaccgaacggaaccaaccctaaacaaaagtaccgtaaggttacgtacccttaacaactaacgaacccaacgtacgttacggtaacccgtttaggaacctaacacgaccaacgtaattactttacgtgtacaccaaccaaccgaacgtacgggttacctacttaccgtgtcttcggttactttacaacggttaacctaacggttccgggttaacccggaacccggttcggggaccggaaccgggtaacccgttcgggtacctacggtccgttaccctcctaccgccgtaccccgtacccgg

SEQ ID NO: 27622 - DNA, 578 bp, Homo sapiens
  misc_feature: GYAE6OF01B5TP3.22.5.A05.1.454.CMB.1.raw
  modified_base (168)..(168): a, c, t, g, unknown or other
  misc_feature (168)..(168): n is a, c, g, or t
  modified_base (564)..(564): a, c, t, g, unknown or other
  misc_feature (564)..(564): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccanacagaccctcacgctgacctgcaccttctctggttctcactcaccacttatggagtgggtgtgggctggatccgtcacgccccgaggaacggcctagactggcttgcactcatttatggatgatgataagcgctacacgccatctctagaagagcagactacaacataccaaccgaaggaaccaacctaacgaaaaacgcaagtcggtaccttaacaatacgaccaaacacgtacggtaacccgtttggaacctaacgacgaccaactataacttactgtacgacaccaccacgtacggtcctactacgtcgctgtccttcacgttactacgttaggtaccgaacccggtcgggaccgaacgggtacccgtggtaccgacgtcgttcctaccgtcncgtccctaaccccg

SEQ ID NO: 27623 - DNA, 675 bp, Homo sapiens
  misc_feature: GYAE6OF01DMG2E.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctgggttctcactcacctacttatggaggtgggtgtgggctggactccgtcacgaccccgaggaacggccctagactggcttgcactctattattggaatgatgtataagcgctacacgcctatctctagaagagacagaactacaaacactacaaccgaaacggtaaccaaccctaaccgaaaaaacgaccgtaaaggttaccggtaacctttaacgaaacgtacggaaacccaaactaaccgtacggttaaccccgtttaacggaacctaacaacgacccaactaattaactttaacgtcgtacgacctaacacccgtaacgtacgggtaccttaccgtacgttacgtccgttagtacctttacgaacgtaacgttaacgtccggtaaccgtaacccgggtcgggaccggtaaaccgggtacccgtagggtaccaccggtacccgtcctaccctcccgcgtacccgtacccccgg

SEQ ID NO: 27624 - DNA, 692 bp, Homo sapiens
  misc_feature: GYAE6OF01CU3M6.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccatgaaggagtctggtcctacgctggtgaaacccacacacgaccctcacgctgacctgcctaccttctctgggttctcactcaccacttatggagtgggtgtgggctggatccgtcacgccccaggaaacggcctagactgcttgcactctattattgaatgatgatagcgactacacgcccatctactagaagagaccgacgactacaaactactaccaaacccgaacggaaccaaaccctaaccgaaaaaacgaccgtaaagttacggtaaccttaacaacgtacgaaaccaaccgtaacgtaccggtaaccccgtttaggaaccaaccgtaacgaacccacgtaaataacgtttaacgtcgtacgtaccaaccgtaaccaaccgtaaccgggttccttaccgtacgttcgtaccttacgggtctttaccgaacggttaaaccctaccggttaccggttaacccgggtaaccccgggtaccgggggacccgaaacgggggttacccccgtagggtaccgtacggacccgttaccgtaccccttgcccgttaacccccg

SEQ ID NO: 27625 - DNA, 539 bp, Homo sapiens
  misc_feature: GYAE6OF01DD0DN.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtggggtgtggggctggatccgtcacgccccaggaaggccctagactggcttgcactcatttattggatgatgataagcgctacagcccatctctgaagagcagactcaacatcacaaggacacctaccaaaagcaagtggtaccttacaatgaaccaacatcggaccctttggacacgacgaccacatattactgtgccacaccacgacggtctactactgctgtctttcagtacaacgtcggttccgaacccgtcggggacctacggggaaccctcgggtacacggtcgtacctcctccgcgcccgtaaccccg

SEQ ID NO: 27626 - DNA, 698 bp, Homo sapiens
  misc_feature: GYAE6OF01DF7NX.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttcctcactcaccacttatggagtgggtgtgggctggactccgtcacgccccaaggaacggccctagactggcttgcactcatttatggatgatgataagcgctacagcccatctctgaagagcagactaccaacaactccaaaccaaacggtaccaacccttaaccaaaaagacctaaaggttcggtacccttaacaattacgaacccaacgagttacggtaacccgtttaggaacaacgtaacggacccaactaattaactttaaccgtgtttcggacctaaccaacccaacgtaacggggttccttacctttaacgtcggtaccttgggttacccttttacgaacggttaacctaaaccgttcggggtttacccgtaaaccccgggttcggggggaccccgttaaaccgggggtaaacccccgttcggggttacccacggggttcccgtttaccccgtacccgtttaccgacggtacccccttaacccccggg

SEQ ID NO: 27627 - DNA, 625 bp, Homo sapiens
  misc_feature: GYAE6OF01EP7VS.22.5.A05.1.454.CMB.1.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgtctccgaggggaaagngccacctctcctgcagggccagtcagagtgttaactactacttagcctggtaccaanacgaaacctggaccaggcctcccaggtcctcctcatctatgatgctatctacgacgggccacgtggcactcccgagccgtaggttcaggtcggctaggtcgggtctggggacacgtacttcactctccactatcagcacgctagacgtctaggtaagttattttgacttagtttacttacgttgtactagctaggtcgtacgacctaaccttccctacgtaccggttcgggaccgggtacgggaccgtaagggtcggaacgtacgtaaccgaaacgtacgttacggtacggtacgtacgtacccgtaccgtacgttacgtttccgttacctttccgtacctttccccgttccccgtccgtacgttacccgg

SEQ ID NO: 27628 - DNA, 772 bp, Homo sapiens
  misc_feature: GYAE6OF01B5GBB.22.5.A05.1.454.CMB.1.raw
  modified_base (227)..(227): a, c, t, g, unknown or other
  misc_feature (227)..(227): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtacgaaacccacacacgaccctcacgctgacctgcctaccttctcgtggttctcactcacctacttagnggaggtgggtgtgggctggacgtccgtcaccggaccccgaaggaacgccctagacgtggtctgctactctatttagtagatgtatagatacgcgtactacgtacgcctactctacgtagaacgacggactaacgactacgaaactacgtaccaaaccgaaacgaaccaaaccgtaaacgaaaacgtacgtaaacggttacgttacccttaaagaacgtacggtaaacctaagtaccggttaaccggtaccccgtttaaggaaccctaacgaaccgtaaccctaacttaacgttaacgttaccgttagtacccgaaccgtaaacccgaacccgttaaccgggttaaccggttacccgttacgtttaacccgggttacgttaccgtttacgggtttaccctttacggtaaaaccgttaccgttaacccggtttaccgggttaaacccggaacccgggttcgggaaccccggtaaacgggttacccgtccggtaaccggtccgttacccgtaccgttaccctaccgtccggaccccgttaaccccggg

SEQ ID NO: 27629 - DNA, 591 bp, Homo sapiens
  misc_feature: GYAE6OF01CX0W2.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaaggaacggccctagactggcttgcactctatttattggaatgatgataagcgctacacgcccatctctgaagagcagactacaacataccaaccaaaggaccaacctaaccaaaaagcaaagtggtaccttaacaatacgaaccaacactacggtaccctttaggaccaacacgccacatacttactgtcgacacaccacacgggtctacgtactcgtctcggtctttacgacgttaacctaacgtcggttaccgaacccggtcggggacccgacggggtaaaccccgtcgggtaccgacggtccgttacctccctaccgaccgtcccctaaccccgg

SEQ ID NO: 27630 - DNA, 643 bp, Homo sapiens
  misc_feature: GYAE6OF01B4DDE.22.5.A05.1.454.CMB.1.raw
  modified_base (627)..(627): a, c, t, g, unknown or other
  misc_feature (627)..(627): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggactccgtcacgccccgaggaacggccctagactggcttgcactctatttataggatgatgataagcgctacgacgcccatctctagaagagacagactacaacactaccaaccgaacggaccaaccctaaccaaaaacgacaaggttacggtaccctttaacaacgttacgaaccctaaacacgttaccgggtaaccctttaggaaccaacgacgaccctaactaactttaacttacgtgtacgaccaaccaaccgaacgtacgggttacctccttaacgtcgtaccgttggttacctttacgaacgttaacctaacgttcggttacccgtaacccggtcggggaccctaacggggtaccctgggtaccgacgtccgtcctacccgtcnccgtccctaaccccgg

SEQ ID NO: 27631 - DNA, 698 bp, Homo sapiens
  misc_feature: GYAE6OF01DVFGC.22.5.A05.1.454.CMB.1.raw
  modified_base (198)..(198): a, c, t, g, unknown or other
  misc_feature (198)..(198): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaaggggaaanacgcccacctctcctggcgagggccagtcaggagttgtaagacaaactaacttagtctaggtaccagcaggacgacctggaccaggctcccgaggcctcctacattctagtggtcgcctttacgtaccgacggtccaacgttcgggtacctccccgacgtaggttccaggtcgaccgtagggtcgggtacgtacgggaactagtacgttcacgtcctcaaccagttacgacgacgacggtccttacggacgtagttccgtaaggtaagttacgttttcgactttaaacttttattaccgtaggtacacgtataaattagttaatcggtaacgtttggttacttacgtacttacctaccggttaccggaaccgtaacgggtacctaacggtacgttacgggaaacgttaaacgttaaaaccggacgttggtacgggaccttacgggacctaaccgttacgttcccgttagttacccttacgttcccgttcccgttaccccg

SEQ ID NO: 27632 - DNA, 538 bp, Homo sapiens
  misc_feature: GYAE6OF01BXK3V.22.5.A05.1.454.CMB.1.raw
  modified_base (194)..(194): a, c, t, g, unknown or other
  misc_feature (194)..(194): n is a, c, g, or t
  modified_base (253)..(253): a, c, t, g, unknown or other
  misc_feature (253)..(253): n is a, c, g, or t
  modified_base (507)..(507): a, c, t, g, unknown or other
  misc_feature (507)..(507): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgctccaggggaaangccaccctctcctgcagggccagtcagagtgttaactactacttagcctaggtaccaanagaaacctggccaggcctcccaggcctcctcatctatgatgcatcttacgagggccactggcactcccagcctaggttcaggtgctaggtggtctagggacagtacttcgactctacacatcagcagcctagacgctagaagtatttgactaagtttattactgtacagcagcgtagctaacctcctcgtacgttcggacgggacggtaccgaagggtgagtacacgaaacgtacgtggacgctcggacaccgnttcctgttcttcacttcccttcccgctctcg

SEQ ID NO: 27633 - DNA, 661 bp, Homo sapiens
  misc_feature: GYAE6OF01BC0YL.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcacctacttatggagtggggtgtgggctggatccgtcacggccccaggaaacggccctagactggcttgcactctatttattggaatgatgataagcgctacacgcccatctactagaagagcagactacaacactacaaccaacggaccaacctaaccgaaaaacgacgtaaacggtacgtaccttaacaatacgaaccaacgtacgtacggtaacccgtttaggaacctaacgaacgaccctaactaacttaacgtttaacgtacgttaccgacctaacccaacccgtaccgaacgggttacccttaccgttaacgtcgttcgttacggtcctttacgaacgttaccgtacgttaccgggttacccgtacccgggtcgggacccggaacggggtaacccgtgggtaccgacggtccgttaccttcctaccgtcgtccccgtaaccccgg

SEQ ID NO: 27634 - DNA, 560 bp, Homo sapiens
  misc_feature: GYAE6OF01EXRXN.22.5.A05.1.454.CMB.1.raw
  modified_base (197)..(197): a, c, t, g, unknown or other
  misc_feature (197)..(197): n is a, c, g, or t
  modified_base (380)..(380): a, c, t, g, unknown or other
  misc_feature (380)..(380): n is a, c, g, or t
  modified_base (520)..(520): a, c, t, g, unknown or other
  misc_feature (520)..(520): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaanagccaccctctcctgcagggccagtcagagtgttaactactacttagcctggtaccaacagaaacctggccaggctcccaggctcctcatctatgatgctatcttacagggccactggcatcccagccaggttcagtgcaggtggtctgggacagtacttcactctcacatcagcagctagancctagagtatttgtactagtttattacttgtctagcagtacgtacgacaacctccgtactaccggttcgggaccgggacggggtaaccgaagggtacggacgtacgtacgaaaacgtaacgtggtacggacgtcgacacnctcgtgttaccttactaccttttacccgcctgtcgtaacg

SEQ ID NO: 27635 - DNA, 602 bp, Homo sapiens
  misc_feature: GYAE6OF01A6GU8.22.5.A05.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (254)..(254): a, c, t, g, unknown or other
  misc_feature (254)..(254): n is a, c, g, or t
  modified_base (304)..(304): a, c, t, g, unknown or other
  misc_feature (304)..(304): n is a, c, g, or t
  modified_base (401)..(401): a, c, t, g, unknown or other
  misc_feature (401)..(401): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaangccaccctntcctgcagggccagtcagagtgttaactactacttagcctggtaccaanacgaaacctggccaggctcccaggcctcctcatctatgatgacatctacngggccactggccatcccgagccaggttcagtggcaggtcgggtcgtgggacaggtaccttcacctctacacctatcagcagcctagcgctagaagtntttgcttagtttatactgtcagtcagtcgtacgactaacctcccgtacgtaccggttcgggacggaacggggaccctaagggtacggaacgtacgtaacgaaacggtaacgttggtacggcgtaccgacctaacccgtgttaccgttgtttaccctttacgtaccgtttccccgttaccccgtcccgtacgttaaccccgg

SEQ ID NO: 27636 - DNA, 880 bp, Homo sapiens
  misc_feature: GYAE6OF01CHFM7.22.5.A05.1.454.CMB.1.raw
  modified_base (197)..(197): a, c, t, g, unknown or other
  misc_feature (197)..(197): n is a, c, g, or t
tcagacatacgcgtcacgaccggtgctcgatttagatagatagacgagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaanacgccaccctctcctgcagggccagtcagtagttagttaactacttacttacgccgttagggtaacccaacgaacgaaacccgttcgggacccaacgggcccttaccccgagggcccttacccgtactaacttaccttaagttcggtaattcggtaacctaacgtttaccgtttaaccggaacgggggtcccctaacggttcgggaccctaacgttaccccgaggtaccccgtaacggggttttaccgaacgggttcggggtacccgtaaggggtttaccgggggggttccgttaacgggggggaaaccctaacgggttacccttttacccgtaaccgtttccctacccgaaaccctacgttaacccaaaaccgtacggtacccgttaacggaccgtacccggttacggtaaccgttacgtttccgttacgtaccgtttaacgttttaacgttacgttacgttaccgtaacggtacgtaacgtaccggttaaccgtaacgggtccggtacccgttaccggttacggttttaccgggaccgggtaccgggggtaccgtaacgggtcggtacgggaggtaaccgtacgaacggtaccggtaacggttcgggtcggtaccgacggacccgtaaccgtcgttaccgttacggttaccttacgtacccgttcccgttccccggtaccg

SEQ ID NO: 27637 - DNA, 662 bp, Homo sapiens
  misc_feature: GYAE6OF01BAJUY.22.5.A05.1.454.CMB.1.raw
  modified_base (627)..(627): a, c, t, g, unknown or other
  misc_feature (627)..(627): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaacccacacagaccctcacgctgacctgcaccttctctggttctcactcaccacttatggagtgggtgtgggctggactccgtcacgccccaggaacgcctagactggcttgcactctatttagtggaatgatgataacgcgctacacgacccagtctacgtagaacgagacacgactacaaacataccgaaccaaacggtaaccaacctaaccgaaaaagaccgtaaacggttcggtaccttaacgtaaactacggaaaccaacgtaacgttaccggtaccccgtttaagggaacctacgtaacgaccctaactaacgttactttaaccgttgtacgtaccaaccgaacccacgtaacgggtccttactaccgtacgtcgttacgttaccgtttactaaccgtaacgttacgttaggttacccgtaaccgggtccgggtacccgaacgggtacccgtagggtaccncggtaccgtccttacctccgaccgtccgtaccccg

SEQ ID NO: 27638 - DNA, 646 bp, Homo sapiens
  misc_feature: GYAE6OF01BXFZJ.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcaccacttatggagtgggtgtgggctggatccgtcacgcccccaggaacgccctagactggcttgcactcatttatggaatgatgataagcgctacacgcccatctctgaagagcagactacaacatccaaccaaggaccacctaccaaaaagctaagtcgtaccttaacaactcgaaccctaaacagtacggtaccctttacggaacctaacacgacccctaacacttaacttactagtacgacccaaccaacccgaacgtaccgggttacctacctacgttcgtccgttacggttcctttacgacgttaacctacggttaccgggttaccggtaaaccccggtgggggtacccctaacggggggtaccccttacgggtacccgacggtccgtttacccttacccgtcccgtacccggtccccttaaaccccccgg

SEQ ID NO: 27639 - DNA, 820 bp, Homo sapiens
  misc_feature: GYAE6OF01B1MVV.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcaccacttatggagtgggtgtgggctggatccgtcacgccccgaggaacggccctagactggcttgcactctatttatggaatgatgataagcgctacacgaccctatctctaggaagacgtacagactacaaacactaccaaaccgaaacggaacccaaccctaaaccaaaaaacggacctaaacggttacggttaacccctttaacgaaactttaccggaaaccctaaaaccgtagttaccgggttaacccccgttttacgggaaaccctaacgaaaccgtacccctaaccgtaaattttaacgttaacccgtttagttaccggaacccctaaccaaaccccgtaacggtaaccgggtttacctacccgtttaaacctcgggttaccggttttcggtacccgttttaacccgtaaacgttaaaccgttaaacccggtttccggggttaaccccgggttaaaacccccggttccggggggggtaaacccccgtaacccggggggggttaaacccccccttgggggtttaaccccgaaccgggtttacccccgggttacccctttaccccgttaccccggtacgggttaacccccccccttaacccccggg

SEQ ID NO: 27640 - DNA, 777 bp, Homo sapiens
  misc_feature: GYAE6OF01DIC2D.22.5.A05.1.454.CMB.1.raw
  modified_base (748)..(748): a, c, t, g, unknown or other
  misc_feature (748)..(748): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtacgaaacccacacacgaccctcacgctcgacctgcctaccttctcgtggtctcactcactacttagtggaggtgggtgtgggcgtggacgtccgtcaccgaccccgaaggaaaccggcccgtagtacgtggtcgttcgactactactatttagtaggtaatgatagtagtaacgcgtactacacgaccctatctacgtaggaaacgtacgacaacgactaacaaacacgtaacccgaaaccaaacggaacctaacccgtaaaccgaaaaacgtacgtaaggttaccgttaaccgttaactaaacgtacgaaaccctaaacgtaccggttaccggttaccccgttaaggaacccaacgtaaccgaccaacttaacgtttaacttaccgacgtaccgtaaccaacctaacccggtaacggtccgggttaacccttaccgttaaccgttcggttaccgtttccgggtttaaccttaccggtaaccgttaaccgtaccgggttaccgggttaacccgaaccccggggttacggggaccccgtaaaccggggttccccgtagggtacccgaccggttcccgtacccgttacccncccggtacccggtccccgtaaaccccggg

SEQ ID NO: 27641 - DNA, 596 bp, Homo sapiens
  misc_feature: GYAE6OF01DRO2B.22.5.A05.1.454.CMB.1.raw
  modified_base (197)..(197): a, c, t, g, unknown or other
  misc_feature (197)..(197): n is a, c, g, or t
  modified_base (292)..(292): a, c, t, g, unknown or other
  misc_feature (292)..(292): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaangccaccctctcctgccagggccagtcagagtgttaactactacttagccttggtaacccaacgagaaacctggaccaggcctcccaggctccctnatctatgatgctatcttacgagggccacgtggcactcccagccaggttcaggtggcaggtcgggtntgggacagacttcactcncacntcagcacgcctagacgcctagaagttatttgacttagtttacttacgtagtcagtcagtcgtacgactaacctccctacgtaccggttacgggaccgggtaacgggaccgtaagggtacggaacgtacgtaaccgaaacgtacgtggtacggcgtacggacctaaccgtgtccgttcgttaccgttactaccttccgttccccgcgtcgttaccgg

SEQ ID NO: 27642 - DNA, 689 bp, Homo sapiens
  misc_feature: GYAE6OF01AMMPQ.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttagtggagtgggtgtggggctggactccgtcacgccccgaggaacggcctagactggcttgcactctatttagttaggaatgatagatagcgactacacgcccatctacgtagaagagacacgactacaactactaccgaaccgaacggaaccaaccctaaaccgaaaaacgccgtaaacggttcggttacccttaagaacgttaacgaaccctaaactacgttaccggtaaccccgtttacggaaccacgaacgacccaacgtaattaacgttaactggtaccacccgtaacccaacccgtaacggtacgggttacccttacgttaccgttcgtaccgttcgttacctttacgaacttaaccgtacgttaccgggttaaccgacccgggttcggggacccgtaaccgggtcccgttacggtaccgtaccggtcccttactaccccgtcgtacccgccccgttaaaccccgg

SEQ ID NO: 27643 - DNA, 733 bp, Homo sapiens
  misc_feature: GYAE6OF01BE8WZ.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgcccccaggaacggccctagactggcttgcactcatttatggaatgatgataagcgctacagcccatctctgaagagcagactacaacatccaaccaacggaaccaaccctaaccaaaaacgctaaaggtcggttacccttaacgaacttacgaacccaaacgtaacgtaccggtaaccccttttacgggaacctaaccgaacggacccctaactaacttaacgtttaaccttcggttacggaccctaacccaacccgtaacggaaccggggttacccttaccgttaaccgttcggtaccgttacggttacctttttaccgaaccgtttaaaccgtaaccggtttccgggtttaaccccggtaaacccccggtcggggggtaccccgtaaccggggggtaaacccccgttacggggttaccccgtaacgggtccccgtttacccgttacccccgttaccggacccgttcccccgtaaacccccggg

SEQ ID NO: 27644 - DNA, 774 bp, Homo sapiens
  misc_feature: GYAE6OF01BY1SF.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgcaccttctctggttctcactcacctattagtggagtgggtgtgggctggactccgtcacgccccgaggaacgcctagactggcttgctactactatttagttaggatgtatagtaataacgcgactacgacgccctatcctgtagaagacgacacgactacaacactaccgaaccaacggaaccaacctaaaccgaaaaacgaccgaaacggttacggtaaccctttaacgaacgttacgaacccgaaacgtacgttaccgggttaaccccgtttaaggaaccgaaaccgaaccggtaaaccctaaccgttaaatttaaaccgtttaaccgttacgggtaacctaacccgaaaccgtaacccgttaaacggaccggggtttacccttaccgttaacccgtacggttaccgttaccgggttacctttaccgtaaacggttaaacccgtaacggtttaccggggtttaaaccccggaacccgggttaccggggaaccccggtaaccgggttaaccccgttacgggttacccgaacggttcccggttacccttacccgtacctaccggtcccccgttaaaccccgg

SEQ ID NO: 27645 - DNA, 590 bp, Homo sapiens
  misc_feature: GYAE6OF01DENSC.22.5.A05.1.454.CMB.1.raw
  modified_base (393)..(393): a, c, t, g, unknown or other
  misc_feature (393)..(393): n is a, c, g, or t
  modified_base (428)..(428): a, c, t, g, unknown or other
  misc_feature (428)..(428): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtcgaaacccacacacgaccctcacgctcgacctgcaccttctctgggttctcactcacctacttatggtagtgggtgtgggcgtggactccgtcacgccccgaggaaacggccctagactggctgcactctatttatggaatgatgataagcgctacacgccatctcgtagaagagacagactacaacatacaacaacggacactacaaaagcaagtgtactacaatgaaccaanagtacgaccgttagacacacgacatatacttactntacgactaaccactaacggcgggtacttcctacgtacggtcttggtaccttttacgaacgttaacgtaaccgttacgggttaccggaacccgggtcggggacccgtaaccggggaaccctgggtacgacgtccgttacctccctacaccgcccgtaaccccg

SEQ ID NO: 27646 - DNA, 718 bp, Homo sapiens
  misc_feature: GYAE6OF01C7J2T.22.5.A05.1.454.CMB.1.raw
tcagacatacgcgtcacgaccggtgctcgatttagatagatagacagggggactcctgtcgccccaccatggacacactttgctccacgctcctgctgctgaccatcccttcatgggtcttgtcccagatcaccttgaaggagtctcggtcctacgcgtggtacgaaacccacacacgaccctcacgctagacctgcctaccttctcgtgggttctcactcacctacttagtggtaggtggggtggtgggcgtggtacgtccggtacgaccggaccccgaacgggaacggtccctacggacgtcggtcttcgcctactcttagtttagttaggtaataggtataggtaacgtaacgtccgactaccgaccgtaccctacttctacgtagaacggacgacgtaacgaacctacaaactactaccgaaccaacgaaccgtaacctaaacgaaaaacggtcgtaaacggttaccgttaaaccgttaactaacgtaccgtaaacccgtaacgtaccggttaccggtaacccgttacggaacctacgaaccgactaacgtaattaacttacgtagtaccgaacctaacgaccgtacggtaccgtactccgttaacgtcgtacgtcgttaccttagaccgtacgtacgtacggtacccgtaccggcgggtaccgtaacggtccgtaggtccacggtcctactccgacctccgtacccgtacccg

SEQ ID NO: 27647 - DNA, 682 bp, Homo sapiens
  misc_feature: GYAE6OF01BUIEA.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcacctacttatggagtgggtgtgggctggatccgtcacgccccgaggaacgcctagactggcttgcactctatttagttagatgatgatacgcgctacacgccatctgtagaagagcagactacaactactaccaaccaacggaacctaaccctaaaccaaaaacgacgtaaacgtacggttaccttaacgaatacgaacccaaacgacgttaccggtaacccgtttacgaaccaacgaacgacccgtaactaactttaactttaccgttacgttacgacctaaccgaacccgtaacgtacgggttacccttaccgtacgttcgtccggttacggttacctttaccgtaacggttaacccttaaccgttaccgggttacccgtaacccgggtccggggacccggtaaccggggtaccccgttcgggtaccgtacgtcccgttcctacccgtacgcccgtccctaacccccggg

SEQ ID NO: 27648 - DNA, 672 bp, Homo sapiens
  misc_feature: GYAE6OF01DDUBW.22.5.A05.1.454.CMB.1.raw
  modified_base (260)..(260): a, c, t, g, unknown or other
  misc_feature (260)..(260): n is a, c, g, or t
  modified_base (334)..(334): a, c, t, g, unknown or other
  misc_feature (334)..(334): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgttctttgtctccgaggggaaagcgcccaccctctcctgcagggccagtcagagttgttaactactacttagcctggtaaccaanaacgaaacctggaccaaggcctacccaggtcctcctacatactatgatgactatacgttacgacgggcctacgnggacacgtcccagtcccgtaggttacaggtcgggactagggtcggtcgtagggacagtaccttcaactctaccaaccgtatacgagacacgtaccgtagacgtcctaagtaacgttatttcgactttagttttaacttacgtcgtacacgtacgtacggtactacgacctaacccttcccgtacgtaccgggttcggggaaccgggaacggggtacgtaaggggtaggaacgtaaccgtaaccgtaaaacggtagtcggtacggtccgtacgacctaaccgtgtttccgtagtttacccttcgtaccgtttccccttacccgcgttaacgttacccgg

SEQ ID NO: 27649 - DNA, 617 bp, Homo sapiens
  misc_feature: GYAE6OF01AMV9S.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcaccacttatggagtgggtgtgggctggatccgtcacgccccaggaacggcctagactggcttgcactcatttattggaatgatgataagcgctacacgccatctctgaagagcacgactacaacactacaaccaaacggaccaaccctaaccaaaaaacgctaaaggtcggttacccttaacaacttacgaacccaaacgtagttaccggtaccccgtttaggaaccacgaacgacccaactacttaacttacgtacgttcgaccacaaccctaacgagggttcccttactacgtcgacgttcgttacttacgtaacgtactacgttacggtacccgtaacccggcgggacccggaacgggtaccgtccgtacgaccgtccgtcctcctcgccgtcccgtaaccccg

SEQ ID NO: 27650 - DNA, 834 bp, Homo sapiens
  misc_feature: GYAE6OF01DD74R.22.5.A05.1.454.CMB.1.raw
  modified_base (193)..(193): a, c, t, g, unknown or other
  misc_feature (193)..(193): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccacggagaagttgtgtgacacagtctccagccacctgtctttgctccgaggggaaancgccacctctcctgcgagggccagtcagagttagttaactactacttacgccgtaggtaaccaacaacgtaaaccgtggacccaacgggtccctacccggaggtccttcctactactctatagagtcgactacttacgtaacggacgggtccctaacgtcggaccctacgtccccgaagtaccccggtaggttaccgaagggtcggtaccgtaaggggttcgggtacgtacggggaactacggtaccgttaccaccgtcctaccgaactagtacccgagaccgtacgtaccgtaaggtacgtaccgtaggttaaacgttcgttttacggacttttaacggttttaacgtaaccgttcggtaactacggtaccgtaacggtaccgttaacgtaacccttaacccggtttccccgtaaccgggttccggggtaacccggggacggggtaaacccggggttaccgggaaaagggttcggggaaaccgttaaaccgtaaaccgggtaaaaccggttaccggttacgggtaccgggtaacccgttaccggaacccgttaaccgttaacggtttcccgttacgttttacccgtaacccgttaccctttaacccccggttcccttaacccgtaaggtttaaccccggg

SEQ ID NO: 27651 - DNA, 568 bp, Homo sapiens
  misc_feature: GYAE6OF01ECK2F.22.5.A05.1.454.CMB.1.raw
  modified_base (197)..(197): a, c, t, g, unknown or other
  misc_feature (197)..(197): n is a, c, g, or t
  modified_base (461)..(461): a, c, t, g, unknown or other
  misc_feature (461)..(461): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaancgcccaccctctcctgcgagggccagtcagagtagttaactactacttagccttaggtaaccaacaagaaacctggaccaggcctcccgaggcctcctcatctatgatgctatcttacgacgggccacgtggcactcccagcctaggttcaggtggcgtaggtcgggtcgtgggacagtacttcactctaccaccatcagacctaactagacgtctagtaagttatttcgacttaagtttacttactgtacagtcagtcgtacncctacctcctacgtacggtcggacggacggacgaggtgagtacgtacgaacgtacgtgcgtcgtgacctactatctcgtcttctcttcccgtcccactgtcgtacgg

SEQ ID NO: 27652 - DNA, 696 bp, Homo sapiens
  misc_feature: GYAE6OF01CMQ8L.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctgggttctcactcaccacttatggagtgggtgtgggctggactccgtcacgccccgaggaaacgcctagactggcttgctactctatttatgaatgatgataacgcgactacacgaccctatctctagaagagcacgactcaacactacaacaaaggaccaacctaaacgaaaacgacgtaaacgttcggtaccttaacaacgtaccgaacccaactacgttaccggtaacccgtttaggaaccaactaacgaccctaaccgtaattaacttacgtagttaccgacgtaacctaacccgacgtaacgggttcccttaccgttaccgtgaccggttacggtttacccttaccgtaacggttaacctaaaccggttccggtttaacccgggtaacccggttaccgggggaaccccgtaaccggggttaccccggtaccggttaccggaacccgtcccggttacccttaccccgacgtacccgcccgtaaaccccccggg

SEQ ID NO: 27653 - DNA, 591 bp, Homo sapiens
  misc_feature: GYAE6OF01BRZ4O.22.5.A05.1.454.CMB.1.raw
  modified_base (325)..(325): a, c, t, g, unknown or other
  misc_feature (325)..(325): n is a, c, g, or t
  modified_base (578)..(578): a, c, t, g, unknown or other
  misc_feature (578)..(578): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaacggccctagactggcttgcactcatttattggaatgatgataagcgctacagcccatctctagaagngcagactacaacataccaaccaacggaccaacctaaccaaaaagcaaaggtcggtaccttaacaactacgaaccaacagtcggtaaccctttggaaccacacgcccaactattacgttactgtcaccaaccaccgacgtacgggtcctacgtaccgtgtcttcggtctttacgaagttaccgtaacgttcggttacccggaacccggtcggggacccgaacgggtacccgtggtcacggtcctcctccctacnccgcccgtacccg

SEQ ID NO: 27654 - DNA, 686 bp, Homo sapiens
  misc_feature: GYAE6OF01BCEU0.22.5.A05.1.454.CMB.1.raw
  modified_base (338)..(338): a, c, t, g, unknown or other
  misc_feature (338)..(338): n is a, c, g, or t
tcagacatacgcgtcacgaccggtgctcgatttagatagatagacagggggacgtcctgtgccccaccatggacacactttgctccacgctcctgctgctgaccatcccttcagtgggtcttgtcccagatcaccgttgaaggagtctggtcctacgctgggtagaaacccacacagaccctcgacgctgaccgtgctaccttcgtcgttgggttacctacaccttcacccgtaacttagtcgggtacgttgggtgtcgggctaggactccgtcacgaccccgaggaacggccctagactggcttgcactctagtttactggaatgatgataagcgtntacacgtaccctattccgtagttagaaagtacgtacaacggtacctaacaaaccgacttaacccgaaaccgtaacggaaccctaaccctaaaccgtaaaaagccgttaaaggtcgttaaccgtaactaagtaccgtacctaacgtacgtaccggttaacccgttgaaaccacgtaacgtccaacgtatactacgtcgtacgactaaccgaccgtaacgtaccggtcctaccgacgtaccgtacgtcggtaccttcgaacgttactaaccggttcgtaaccgggtaccggtcggaccgtaccggtacgtcgtacgacgtccgtactacccgactccgaccctaacccgg

SEQ ID NO: 27655 - DNA, 716 bp, Homo sapiens
  misc_feature: GYAE6OF01DX85V.22.5.A05.1.454.CMB.1.raw
  modified_base (232)..(232): a, c, t, g, unknown or other
  misc_feature (232)..(232): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtggnggctggactccgtcacgcccccgaaggaaacggccctagacgtggtcttgctactctatttatggaatgatagaataacgcgactacacgcctatctacgtagaagagacaacgactacaaactactaccaacgaaacggaaccaaccctaaacaaaaacgacgtaaagtcgttaacccttaacaacgtacgaacctaactacgtaccggtaacccgtttaggaaccacgaacgacctaactacgttaacttaccgtacgtacgaccaaccaaccgtaacgtacggggttcctaccgttaccgtcggtacgttcggttactttaccgtaacgtaaacccgtacggttaccgggttaaccccggaaccccgggttcgggggtaacccggtaacccggggttaaaccccgggttcgggttacccgtacgggtccccggtttacccgtcccgttaacccgtaacccggtcccccttaaacccccggg

SEQ ID NO: 27656 - DNA, 645 bp, Homo sapiens
  misc_feature: GYAE6OF01AFRT7.22.5.A05.1.454.CMB.1.raw
  modified_base (483)..(483): a, c, t, g, unknown or other
  misc_feature (483)..(483): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctgggtcgaaacccacacagaccctcacgctgacctgcaccttctctgggttctcactcacctacttagtggagtgggtggtgggctggactccgtcacgccccgaggaaacggcctagactggcttgcactctatttatggaatgatgataagcgactacacgccctatcctcgtagaagcgacacgaactacaacactaccgaaaccgaacggaccaaccgtaaccgaaaaacgtacgtaaacggttcgttacccttaacaatacgaaccaacgtacgtaccggtaccctttacggaacacgacgtaccactattacgtactggacnccaacacccgacgtaccggtccttacgtacgtcgtcgttcggtaccttacgacgttaccgtaccggttcggttaacccggaccgggttcggggacccgaaccgggtacccgtcggtaccgacgtcccggttccctacccgcctaccgtccccgtaaccccgg

SEQ ID NO: 27657 - DNA, 744 bp, Homo sapiens
  misc_feature: GYAE6OF01DA9JU.22.5.A05.1.454.CMB.1.raw
  modified_base (198)..(198): a, c, t, g, unknown or other
  misc_feature (198)..(198): n is a, c, g, or t
  modified_base (544)..(544): a, c, t, g, unknown or other
  misc_feature (544)..(544): n is a, c, g, or t
  modified_base (722)..(722): a, c, t, g, unknown or other
  misc_feature (722)..(722): n is a, c, g, or t
tcagacatacgcgtcacgaccggtgctcgatttagatagatagacagggggaggaactgctcagttaggacccagagggaaccatggaagccccagctcagcttctcttcctcctgctactctggcctcccagaaaccaccggagaagttgtgttgacacagtctccagcccaccctgtctttgctccgaggggaaancgcccaccctctcctgcgagggccaggtcaggtagttcgttaaacctactacttacgccgttaggtaaccaaacaacggaaaccgtgggaccaagggcctaccccgaggtcctcctcattcctatgactgcattaccgttacgacggggtccctacgtcgggacctaccgtccccgaaggtcccgtaagggtttccgaagggtacgggaccgtaagggttcggggttaccggttacgggggaaacctacgggtacccttttaccgaaaccctttccgttaaccaacccgttactccgaacgccgtaaaccgtaccgttaacggacgtacccgtaggtaaacgtttnttttacgactttaagttttaagttaaccgttggtaaccgacgtcgtaacgtcgttaacgtaccctaactccccgtacgtaccgggttccgggacgggaacgggtaccgaaggggttagacggacgtaacggaaaccgtgtacggtgaccgtacgactaccgtattccgtcgttctacnccttccctcccgctatacccgg

SEQ ID NO: 27658 - DNA, 519 bp, Homo sapiens
  misc_feature: GYAE6OF01EPR7D.22.5.A05.1.454.CMB.1.raw
  modified_base (402)..(402): a, c, t, g, unknown or other
  misc_feature (402)..(402): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaaggccctagactggcttgcactcatttattggaatgatgataagcgctacagcccatctctgaagagcagactcaacatcaccaaggacacctacaaaaagcaaagtggtaccttacaatgaccaacatcggaccctttggacanacgaccacatacttactgtcgcacaccacagggtctctactgctggcttcagtactaactggttacgaccgtcgggccaagggaccctggtcacggtctactccncncgcctacccg

SEQ ID NO: 27659 - DNA, 687 bp, Homo sapiens
  misc_feature: GYAE6OF01C7UMD.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcaccacttatggagtgggtgtggctggatccgtcacgcccgaggaacgcctagactgcttgcactctattatggatgatgataagcgactacagacctatctactagaagacgacacgactacaacactacaaccgaaaggaacctaaccctaaccgaaaaaagaccgtaaaggtacggttaaccttaaccgaaacttacggaacccaaacgtaaccgttaccgggtaaccctttacgggaaccaaccgacgacccgtaactaacttaattaccgtagtcgacaaccaaccacgtagggtacccttacgtacgttcgccgttacggtacctttcgtaacgttaccgttaaaccggttcggggtttacccgaaaccccggttccgggggtaacccgaccgggggtaaccccgttcggggtaccgaccggttacccgtttacccgtacccgttccgaacccggtccccgtaaacccccgg

SEQ ID NO: 27660 - DNA, 772 bp, Homo sapiens
  misc_feature: GYAE6OF01DFS36.22.5.A05.1.454.CMB.1.raw
  modified_base (194)..(194): a, c, t, g, unknown or other
  misc_feature (194)..(194): n is a, c, g, or t
tcagacatacgcgtcacgaccggtgctcgatttagatagatagacaggggggaggaactgctcagttaggacccagagggaaccatggaagccccagctcagcttctcttcctcctgctactctggcctcccagaaaccacggagaagttgtgttgacacagtctccagccacctgtcttgctcgaggggaaancgccacctctcctgcgacgggccagtcagtagttagttaactactacttacgccgttaggtaaccaaacgtacggaaaaccgtcggaccaacgggtccctacccgaggtcctcctactactcgtaagtcggaattcggactaatttaccgtaacggacgggccctaacgtcggacctacctaccccgaggtcccgtagggtttcagggtcggaccgtagggttcggggtactggggaacctaggtacctttcgacctcgtaccaactactcgacgcacgtaccgtaaggaccgtccgtaaggtaacgtagtttttacgactttaagttttaactacgttggtactaggtacctaaggtaccgttaacggacccttaacctcccgttaacgggtaccgggttaccggggaccgggtaaaccggggtaacccggtaaaggggtcgggtaaaaccgtacgggtaaacccgtaaaacggtacggttcgggacggtacccgttacgaccgttaccgttaacttccgttaccggtttacccttacgtaacccctttccccgttaccggaccttcggttacccgg

SEQ ID NO: 27661 - DNA, 708 bp, Homo sapiens
  misc_feature: GYAE6OF01D3PI2.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtccctgatcaccttgaaggagtctggtcctacgctggtagaaacccacacacgaccctcacgctgacctgcctacccttctcgttgggttcctccactccacctacttagtggaggtgggtgtgggctggactccgtcaccgaccccgaggaacgcctagactggcttgcactctatttagtaggaatgatgaatacgcgactacacgccctatctactagaagagacacgacctacaaacactacccaaacgaacggtaaccaacccgtaaacaaaaagccgtaaacggttcgttaacccttaacaacttaccgaaacctaaaccgtacgttaccggtaacccgttagaaccacgacgtaaccccaactaattaccttacgtgtaccgacctaacccaacccgtacggttaacggttccctaccgttacgttacgtccgttcggttacctttacgtaaacgtacccgttaacgggttccgggttaaaccccggtacccggtaccgggggaacccgtaacccgggtaccgttcggtaccacccggtccttacccttccccgaccttccggtacccccgtaaccccgg

SEQ ID NO: 27662 - DNA, 815 bp, Homo sapiens
  misc_feature: GYAE6OF01DAC5R.22.5.A05.1.454.CMB.1.raw
tcagacatacgcgtcacgaccggtgctcgatttagatagatagacagggggactcctgtgccccacatggacacactttgctccacgctcctgctgctgaccatcccttcatgggtcttgtcccagatcaccgttgaaggacgtctcggtacctacgcgtggtacgaaacccacacacgaccctgacgctacgacctgcctacctttcgcgttcggttctcacctcaacgtacgttagtgggagggtgggtcggtgggctaggacgttcccgacgaccgaccccggaaggtaaccggaccgtagcgtggtcttacgcctacttactagtttaagttaggaattagagtaggtaactacggaccgtacgtaacaccgtaccctagtccctagtaaacggaacgacgaaccgtaacgaaccctacaaacctacgtaaaccgaacgaaaccgacctaaaccgaaaccaaaacgtacgaacggttacgttaacctaacgtaacgacctaacgtaacgtaccggtaaccgggtttacccctaggaaccctaagaaccgacttaactattaaaccgtttcgaggtaccgtaaccaacccgtacccgtaaggggttccgtacctttaccggtacccgttacgtacggttcccgttaacgttttaaccggaacgtttaacccgttacggggttaacccggtaaccccgggtaccggttacccgggggtaacccgtaaaccccgggggtcccttaacggggccctaaaccggttcccccgggtacttccggtaaacccgccccggttaacccctaaacccgggg

SEQ ID NO: 27663 - DNA, 610 bp, Homo sapiens
  misc_feature: GYAE6OF01BCHBI.22.5.A05.1.454.CMB.1.raw
  modified_base (339)..(339): a, c, t, g, unknown or other
  misc_feature (339)..(339): n is a, c, g, or t
  modified_base (390)..(390): a, c, t, g, unknown or other
  misc_feature (390)..(390): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctgggttctcacctcacctacttatgggagtgggtggtgggcgtggactccgtcgacgaccccgaggaaacggccctagacgtcggcttgccactctatttagttggaatgagtgaataaggcgatacgacgcccatcctntacgaagagacacgactacaacataccaacgaacgacaacctaacgaaaancgaagtctactacaaganaccaantcgacttgaactacagaccaagattactatcgacgacacaacctacgaggttcctacgtactggttcctagttaccttacaacgttacctaacgttcgggtaccgtaacccgggtcgggacccggaaccggtaccccggtgggttcccgaacggttcctcccttaccggtacctacccggttcccgtaacccccgg

SEQ ID NO: 27664 - DNA, 751 bp, Homo sapiens
  misc_feature: GYAE6OF01D6MDU.22.5.A05.1.454.CMB.1.raw
tcagacatacgcgtcacgaccggtgctcgatttagatagatagacaggggggactcctgtgccccaccatggacacactttgctccacgctcctgctgctgaccatcccttcatgggtcttgtcccagatcaccttgaaggagtctggtcctacgctggtcgaaacccacacagaccctcacgctgacctgcaccttctctgggttctcactcacctacttagtggagtgggtgtgggctggatccgtcacgccccgaaggaaacggccctagtactggtcttcgctacttactaattttagtggtaatgactgatacggcgactacacgccctagtctacgtagaacgtacgacaacgtactaacgaaactacgtaaccgaacccgtaaacggaacccaaacccttaaacccgaaaaaagtcgtaaacggttcgtaaccttaacgaacgtacgaaacctaacgacgttaccgtacccgtttagaaccacgacgaccctaactattaacgttacgtacgtacgaccctaaccgacaacggtcgggttaccttaccgtaccggttacgtaccggtttcgttaccgttttacgaacggttaaaccgttaaccggtttaccgggttaaaccccggtaacccgggttccgggggtaaccccgtaaacgggggttaaccccgtacggggttacccaaacgggttcccgttaaccccgtacccgttacccggaacccggtaccccgtaaacccccgg

SEQ ID NO: 27665 - DNA, 582 bp, Homo sapiens
  misc_feature: GYAE6OF01CIDR2.22.5.A05.1.454.CMB.1.raw
  modified_base (569)..(569): a, c, t, g, unknown or other
  misc_feature (569)..(569): n is a, c, g, or t
tcagacatacgcgtcacgaccggtgctcgatttagatagatagacagggggactcctgtgccccaccatggacacacttttgctccacgctcctgctgctgaccatcccttcatgggtcttgtcccagatcaccttgaaggagtctggtcctacgctggtacgaaacccacacacgaccctcacgctgacctgctaccttctcgtgggttctcactcacctacttagtggaggtgggtggtgggctggactccgtcacgcccgaggaacgcctagacgtgcttgcactctattagtggaatgatgatagcgctacacgccatctagtagaagagacagactacaaacactaccgaaccaacggaaccaacctaaaccgaaaaagcgtaaacggttcgttaccttaactaactacgaaaccaacgtacgtacggtacccgttaggaccaacacgaccacaattacttactgacgcaacaccagtacggtctctactgccttgtcttacagtacctagtcggtaccgaccggtcgggaccgacggtacccgtgccgacgtcctctacctcnccgtcctaccccg

SEQ ID NO: 27666 - DNA, 698 bp, Homo sapiens
  misc_feature: GYAE6OF01EIAPN.22.5.A05.1.454.CMB.1.raw
  modified_base (198)..(198): a, c, t, g, unknown or other
  misc_feature (198)..(198): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagcccacctgttctttgtctccgaggggaagngccaccctctcctgcgagggccagtcagagtgttaactactacttagcctaggtaccaacacgaaacctggaccaggcctcccgaggcctcctcatctatgatgctattcttacgacgggcctacgtcggacactcccgagccgtaggttcaggtggacgtagggtcggggtcgtaggggactacggtacctttcgaccttcctacgacctatccgacgacgaacgtacccgtaaggacgtaccgttaaggtaagtttacgtttttacggtacgtttaagttttaactttacgttacggttacctaacggtacgtacgtaccggtaacgacctaacccttcccgttacggtaccgggttccgggaccgggtaacgggtaaccggtaagggtacggaacgtacgtaaccggaaacggtacgttcggtacggtacgtacgaccgtacctcgttccttcgtttaccttactaccgttacccgttacccgtctacgttacccgg

SEQ ID NO: 27667 - DNA, 650 bp, Homo sapiens
  misc_feature: GYAE6OF01EDBCF.22.5.A05.1.454.CMB.1.raw
  modified_base (283)..(283): a, c, t, g, unknown or other
  misc_feature (283)..(283): n is a, c, g, or t
tcagacatacgcgtcacgaccggtgctcgatttagatagatagacagggggactcctgtgccccaccatggacacactttgctccacgctcctgctgctgaccatccttcatgggtcttgtccagatcaccttgaaggagtctggtcctacgctggtcgaaacccacacacgaccctcacgctgacctgctaccttctcgtggttctcactcacctacttatggagtgggtgtggcgtggactcgcacgcccgaggaacgccgtacgacgtggtctcgcactntatttagtagaatgatagaagtacgcgtactacacgccatctgtagaagagacacactacaacactacaacgaacgaaccaacctaacgaaacgacgtaacggttacgtactaacaacgttacgaacccaaactacggtacccggttaaccgttacggaacctacgaacaccgtaactaagttacgttacgtgtacaacaaccaccgtacgtacggttcctacgttcgtgtacggttacgtaccgttacgtaacgtaaaccgttacggttcgggttaacccggaccgggttacgggacccggtacgggtaacccgttcggaaccgtcggtccgttaccctcccaacgtcccgtcccgtaaccccggg

SEQ ID NO: 27668 - DNA, 649 bp, Homo sapiens
  misc_feature: GYAE6OF01DM4J3.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctggttctcactcaccacttatggagtgggtgtgggctggatccgtcacgccccaggaacgcctagactggcttgcactctatttattggaatgatgataagcgactacacgaccctatcctacgtagaagacgacacgactacaaacataccaaccgaaacggaccaaccctaaacaaaaagtacgaagttacggttaccttaacgaatacggaaacccaacgtaacgttaccggttaaccccgtttaggaaccctaacgacgtaccccaactaacgttaacttaccgtagggtacaaccgtaaccaccgtaacgtacgggttcccttacttacgtcgcgttacggttcttacgacgtaacgtacgtcggttaccgaacccggtggggaccctaacgggtaccccgtgtaccgacgtccgttcctacccgtacgccgtccctaaccccgg

SEQ ID NO: 27669 - DNA, 675 bp, Homo sapiens
  misc_feature: GYAE6OF01BYXEK.22.5.A05.1.454.CMB.1.raw
  modified_base (656)..(656): a, c, t, g, unknown or other
  misc_feature (656)..(656): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtcgaaacccacacagaccctcacgctgacctgccaccttctctgggttctcactcaccacttagtggaggtgggtggtgggctggactccgtcaccgacccccgaagggaaacgcccgtagactggtcttcgactactactatttagttagaatgatagaataacgcgactaccacgacctatctacgtaggaagacgtacacgtactacaacactaccaaccgtaaacggaacctaaccctaaccgaaaaagaccgtaaaggttccggttaacccttaacgaacgttacccgaacctaaacgtacggttaccggtaaccccgtttaggaacctaaccgacgaccctaactaactttacgtactgtacgacctaccgaccaacggtacggtaccttaccgtactgtccttcgttaccttacgaacgttaccgtacgttccggttaccgacccggtcgggacccgacgggtaccctggaccgtacgtccgtacctaccnctacccgccctaaccccgg

SEQ ID NO: 27670 - DNA, 720 bp, Homo sapiens
  misc_feature: GYAE6OF01EZWTT.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttggaaggagtctggtcctacgctggtagaaacccacacacgaccctcacgctgacctgcctaccttctcgtggttcctcactcacctacttagtggaggtgggtgtgggctggactccgtcaccgaccccgaaggaacgcccgtagacgtgtcttgactactctagtttataggtatagagtagaagtacgcgactacgacgacctatcctagtagaagacgacaacgactaaccgaaactactaccaacgtaacggaaccctaacccgaaaccaaaaacgaccgtaaacggttacggttacctaacaagttaccgaaaccctaactacggttacggttaaccccgtttacggaaccaaccgaccgtacccgaacttaactttacgttaacgttacggtaccctaaccgaacccctaaccggtaacggtaccgggtttacctacccgttacgttacggtcgttacggttacccttaagtaaccgttaaccgtaccgttcgggtaacccgtaaccgggtccgggaaccgtacgggtacccgttcggacgacggtcccgttacctacctcgcccgtccccgtaaccgg

SEQ ID NO: 27671 - DNA, 635 bp, Homo sapiens
  misc_feature: GYAE6OF01CQNX3.22.5.A05.1.454.CMB.1.raw
  modified_base (287)..(287): a, c, t, g, unknown or other
  misc_feature (287)..(287): n is a, c, g, or t
  modified_base (336)..(336): a, c, t, g, unknown or other
  misc_feature (336)..(336): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctcttgggttcctcactccaccacttagtggaggtgggtgtgggctggactccgcacgccccgaggaaacggcctagactggcttgcactntatttagtggatgatgataagcgctacacgccatctctagaagacgcanactacaacactacaaccaagaccaacctaacaaaagcgtaacgtcggtacctacgaatacgaaccaacgtacgtaccggtacccgtttaggaacctaacgaacgacctaactacgttaacgttactacgtaccgaccaaccgaacccgacgtacgggtccttaccgttacgtcggtccttcggtcctttacgaacgtaccgtaacggttacggtaccggaacccgggttcgggacccgtacgggtaccccgttgggtaccacggtccgtaccgtccctaccgacgtccccgtaacccgg

SEQ ID NO: 27672 - DNA, 762 bp, Homo sapiens
  misc_feature: GYAE6OF01CLOLM.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtacgaaacccacacacgaccctcacgctgacctgctaccttctcgtgggttctcactcactacttagtggaggtgggtgtgggctggactccgtcaccggaccccgaagggaaacggccctaagacgtggcttgcctacttctaatttagtaggaatgatagaataacgcgacctacgacgaccctaatcctacgtagaacgacgacacgtactaacaactactaacccaaccgaacggaacccaaaccgttaaaccgaaaaacgtaccgtaaacggttccggttaacccttaaacgaactaccgaaacccaaacgtacgttaccggttaccccgtttacggaacctaccgaacgtaccctaataactttaacgttaccgtcggtacaacccaaccgtaaccgtaaccggtccgggttaccttaccgtaccgttcgtaccgttacggttacctttaccgtaaacgttaccgttaacggttaccgggttaccccggaaccggggttcccggggtaaccccggaaaccggggttaccccggttagggtacccttacgggtaccctttaccccgtacccgtccgacccggtcccccgtaaccccggg

SEQ ID NO: 27673 - DNA, 667 bp, Homo sapiens
  misc_feature: GYAE6OF01ET5LT.22.5.A05.1.454.CMB.1.raw
  modified_base (195)..(195): a, c, t, g, unknown or other
  misc_feature (195)..(195): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaanagccaccctctcctgcagggccagtcagagtgttaactactacttagcctggtaccaacagaaacctggaccaggctccgaggctcctcatctatgatgctatctacgacgggccacgtggaccactcccagtcctaggttcgagtgggcctaggtcgggtactaggggacacggtacttcgacctcgtaccacctatccgtagacctacgacccgtaagacgtacccgtaggtaagttagttttcgacgtttaaggttttaactttacgttagtcgtaagtccgaaggttaccgtaaccgccgtaacccgttccccgttacggtacccgggtttaccggggaccgggtaacggggtaaccggtaaggggtacggaagtacggtaaccgaaaccggtaacgttggtacggtcgtcgtaccacctacttccgtgttacccgtttcactttacccgttccccgctagttaccgg

SEQ ID NO: 27674 - DNA, 747 bp, Homo sapiens
  misc_feature: GYAE6OF01DRS23.22.5.A05.1.454.CMB.1.raw
  modified_base (214)..(214): a, c, t, g, unknown or other
  misc_feature (214)..(214): n is a, c, g, or t
  modified_base (277)..(277): a, c, t, g, unknown or other
  misc_feature (277)..(277): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaagagtctggtcctacgctggtgaaaacccacacacgaccctcacgctgacctgccaccctttctcgttcgggttccnctacctaccacctaactttagtagggtaggttggggtggtggggcgtgggacttccggtaccnccggacccccgaaggaaccgccgtacgacgtcggtcttgactactcttaagtttagttaggtaataggtaagtagtaagtaacgtccgaccttaaccgacgtcccctaagttcctacgtagaaacgacgcgaacgtacctacaaccgtaactaccaaacccggaaagaaccctaaccctaaacgaaaacgtacgtaacgttacggtaaccttaacaactacgaaccaacgtacgtacgtaacccgttagaaccactacgacctaactattacgttaccgtaggtacaaccgtacaacccgtacggtacgttaccctacctacgttcgaccgttcgttaccgttactaacgttaccgaacgttccgggtaacccggtacccggaccggggtaacccggacgggttaacccgtacggtccgtaccggttcccttcccggtacctaccccggtcccgtccccgtaaacccggg

SEQ ID NO: 27675 - DNA, 639 bp, Homo sapiens
  misc_feature: GYAE6OF01A438M.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggactccgcacgccccaggaaggccctagactggcttgcactcatttatggaatgatgataagcgctacagcccagtctctgaagagcagactcaaacactacaaccgaaggacaacctacaaaaacgctaaaggtcggtaccttacaatacgaaccaacacgtcggtaacccctttaggaaccctacgaacgtacccaactacgtttaacttaaccgtgtacgaccaaccacccgtacgaaccggggttcctaccgttacgtacggtcttacgggtcctttacaacggtaaccttaacgttccgggtttaccgaaccccggttggggacccgtaaacggggtaaccccgttgggtaccacggtcccgttccttaccctacgaccgtccccgttaaaccccgg

SEQ ID NO: 27676 - DNA, 643 bp, Homo sapiens
  misc_feature: GYAE6OF01C9F3Z.22.5.A05.1.454.CMB.1.raw
  modified_base (287)..(287): a, c, t, g, unknown or other
  misc_feature (287)..(287): n is a, c, g, or t
tcagacatacgcgtcacgaccggtgctcgatttagatagatagacagggggaggaactgctcagttaggacccagagggaaccatggaagccccagctcagcttctcttcctcctgctactctggctccagaaaccaccggagaagttgtgttgacacagtctccagccaccctgtctttgtctccgagggggaaagcgcccaccctctcctgcagggccagtcagagtgttaaactactacttagcctggtaaccaacagaaacctggcaggctcccaggctcctnactctatgatgctattcctacgagggccacgtcggacactccagcctaggtcaggtgcaggtggtcgtgggacaggtcgttcacgtctaccacagtccagtcagcctgacacgtcgtaagtaagtacgttttgacgttaagtttacttactgttacaggtactagttaacttaacgttacgtcggttaccgtaccgggtaccggttacccgggaaccgtaacggggtaacccgtaaggggtacggtaacggtaaccgaaaaccggtaacgtagggtacgggacgtcgacccgaaccgttacgttccgttacttccgttacttaaccgttcccgtttacccccgccgttcgtacccg

SEQ ID NO: 27677 - DNA, 710 bp, Homo sapiens
  misc_feature: GYAE6OF01DYS5Y.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtcgaaacccacacacgaccctcacgctgacctgcctaccttctcgtcgggttctcactcacctacttagtggagtgggtggtgggctggactccgtacaccgcccaaggaacggccctagacgtggtcttgcactctatttacgttaggaatgtatagagtaacgcgtactacacgaccctatccgtactagaaacggacgacaacgtacctacgaaacctacaccgaaaccgaaacggaaccctaaccctaaaccaaaaacggtcgtaaacggttaccggttacctttaaacgaactaacgaaccctaaacgtaacggttaccgtacccgtttacggaccaaccgacacccaactaacttacgttacgtcggtacaccgaaccaacccgtacggtacgtaccttacgtacgttctacgtttcggtacctttacgaacgttaacgtacggttccggttaaccggtaaccccgggtcggggacccgtaaccgggtacccgtacggtccgaaccggtccgtaccctaccgtaccgtaccgcccgttaaccccgg

SEQ ID NO: 27678 - DNA, 754 bp, Homo sapiens
  misc_feature: GYAE6OF01D8YIP.22.5.A05.1.454.CMB.1.raw
  modified_base (430)..(430): a, c, t, g, unknown or other
  misc_feature (430)..(430): n is a, c, g, or t
  modified_base (733)..(733): a, c, t, g, unknown or other
  misc_feature (733)..(733): n is a, c, g, or t
tcagacatacgcgtcacgaccggtgctcgatttagatagatagacagggggactcctgtcgccccaccatggacacactttgctccacgctcctgctgctcgacctacttcccttcgtagttgggttcttcgtcccagactctaccgttaggaaggtagttcgttcggttcctacgtcgtcggtaacgaacccacacacgaccctcgacgctcgacctcgccttccttcgttcgttcggtttcctcctacctacctaaccgtacgttaggtagggtgggttcggggtggtcgggtcgtacgggtaccgttccgtacccggacccgtaccccgggaaaggtaacccggtaccttacggtacgtcggtccgtcgtacctacttacgttaagtttagtaggtaagtagtagtagaacgtacgacgtacctacncctaccgtattctacggagtaagacgacgtaacacgaacaacgtactaaccgaacgaacgaaccaacgaaacgaagacgtacggttactactaagacacctaacgtacgtacgtacgtacttcggaactacgactaactagtacttacgtcgtacgaccgtaccaacggtacctcggtacgttcctaccgttccgtgttaccgttcgttaccgtagttaaccggtacgttacccggtaccgggttaccggacgggtccggtaaccggacgtccggttcgaccgtccggttccacccggttccncgtccccgaccgtaacccggg

SEQ ID NO: 27679 - DNA, 733 bp, Homo sapiens
  misc_feature: GYAE6OF01EKE3B.22.5.A05.1.454.CMB.1.raw
  modified_base (141)..(141): a, c, t, g, unknown or other
  misc_feature (141)..(141): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggngtctggtcctacgctggtacgaaacccacacacgaccctcacgctgacctgcctaccttctcgtggttctcactcacctacttagtggaggtgggtgtgggctggactccgtcacgccccgaaggaacgcctagactgctgcactactattatagatgatgatacgcgtactacacgccatcgtacgtagaagacgtacgactaccgtaacaacaactaaccgaaccgaaacggaaccaacccgtaaacgaaaaacgtacggtaaacgttacgttaaccgttaaacgtaactaaccggaaacctaaaccgttaggtaccccggttaaacccgtttacgggaaacccaacgtaaccgtacctaaacctaccgtttaaacgtacgtaccggtacgaaccaacccgaacccggtaacgtaaccgggttcctaaccgttacggtcgttaccgttcgttaccgttaactaacggttacccgttaacgttccgggttaacccggtaaccgggtaccggggtaccgtaaaccggggtacccgttagggacccgtacggttccgtaccctacccgtactaacccggcccgtaaaccccgg

SEQ ID NO: 27680 - DNA, 738 bp, Homo sapiens
  misc_feature: GYAE6OF01AOR8Z.22.5.A05.1.454.CMB.1.raw
  modified_base (145)..(145): a, c, t, g, unknown or other
  misc_feature (145)..(145): n is a, c, g, or t
  modified_base (172)..(172): a, c, t, g, unknown or other
  misc_feature (172)..(172): n is a, c, g, or t
  modified_base (293)..(293): a, c, t, g, unknown or other
  misc_feature (293)..(293): n is a, c, g, or t
  modified_base (720)..(720): a, c, t, g, unknown or other
  misc_feature (720)..(720): n is a, c, g, or t
tcagacatacgcgtcacgaccggtgctcgatttagatagatagacagggggactcctgtcgccccaccatggacacactttgctccacgctcctgctgctgaccatcccttcagttgggtcttgtcccagactcaccttgaaggngtctggtcctacgctgggtcaaacccncacacgaccctcacgctgacctgcctaccttctcgtggttcctcacctcacctattagtggagtgggtcgtagggctggactccgcacgcccgtaggaacgcctagactggctcgctactnttactttagtcggtaatggtagtacgtaacgtacggccgtacgtacgaaccggtccctagttacccgtagtaacggaacggtagtaccggtaactaacctaccaacgttaaccgtaaccgaaccgtaaacggaaccctaaccgttaaaacgaaaaacggtcgtaaacggttacggttaccttaaacagtaccgaacctaacgtacggtaccgttaaccgttaggaacctaacgaccgtaaaccacttaacttaacgttcgttaccgacgtaaccctaccgaaccgtacgttcggttaacccttacggtacccggttagaccgtttcgtaccttacgtacggttaactaccgggttacgtacccggtaacgggccgggtaacgacccgggttacgtcggtacccgtgtacccgttcctaacgtacccncgggtacccctacccggg

SEQ ID NO: 27681 - DNA, 570 bp, Homo sapiens
  misc_feature: GYAE6OF01BPVQ1.22.5.A05.1.454.CMB.1.raw
  modified_base (168)..(168): a, c, t, g, unknown or other
  misc_feature (168)..(168): n is a, c, g, or t
  modified_base (383)..(383): a, c, t, g, unknown or other
  misc_feature (383)..(383): n is a, c, g, or t
  modified_base (440)..(440): a, c, t, g, unknown or other
  misc_feature (440)..(440): n is a, c, g, or t
  modified_base (558)..(558): a, c, t, g, unknown or other
  misc_feature (558)..(558): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccanacagaccctcacgctgacctgcaccttctctgggttctcactcaccacttatggagtgggtgtgggctggactccgtcacgcccccaggaaacggccctagactggcttgcactcatttattggaatgatgataagcgctacacgcccatctctagaagcgacagactacaacatccaacgaaggaccaactacaaaacgcaagtcgtaccttanaatcgaaccaacatacggtacccgtttggaaccacacgaccaactattaactttcgngtcaccaacgaccacgcggtactctactcggtcgttcgtcttacgaacgtactaacgttcggtaccgacccggtcgggacccgacgggtaccctggactacggtccgtccttcccgcncgtccctacccg

SEQ ID NO: 27682 - DNA, 690 bp, Homo sapiens
  misc_feature: GYAE6OF01C9I5B.22.5.A05.1.454.CMB.1.raw
  modified_base (140)..(140): a, c, t, g, unknown or other
  misc_feature (140)..(140): n is a, c, g, or t
tcagacatacgcgtcacgaccggtgctcgatttagatagatagacagggggactcctgtgccccaccatggacacactttgctccacgctcctgctgctgaccatcccttcatgggtcttgtccagatcaccttgaaggngtctggtcctacgctggtacgaaacccacacacgacccctcacgctgacctgcctaccttctctgggttctccactccacctacttagtggaggtggggtggtgggctggactccgacaccgacccgaaggaacggacctacgacgtgtctgctactactatttagtaggtatgtatagacgtagcgtactacgacgacctattcgtacagaacgtagacgacgtacaacaactacaccgaaccgaacgaaccaacctaaacgaaacgtacgtagttacgtacctaatacgtaaccgaaccaagtaccggtaccgtacccgttacgaacacgtaacgacctactaattacgttactcggtacccgaaccaacccgaacgtacggtacggttccttaaccgtcgtacgccggttacgttaccttacggaaccgttaacctacggttccccgggttaccggaaccggggtaccggggtaccggtaacccgggtcgtaccgggtaccgaccgttcccggtacctccgtaaccgtcccgtcccctaaacccggg

SEQ ID NO: 27683 - DNA, 704 bp, Homo sapiens
  misc_feature: GYAE6OF01EETI1.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctgggttctcactcacctacttatggagtgggtgtgggctggatccgtcacgccccgaggaaacggcctagactggcttgctacgtctatttagttaggtaatgtagtagagtaagcgtctacacgcccattctacgtagagagcagacctacaaacactaccgaaccgaaacggacccaaccgtaaacccgaaaaaacgaccgtaaacggtaccggttaccctttaaacgaaacgttaccgaaacccgtaaacgtacgttaccgggttaaccccgttttaacggaaacctaaccaaacggacccctaaactaactttaacgtttaaccgtggtacgtacccgaaccaacccaaggtacgggttacctacgttactacgtcgttcggttactttacgaacgttaactaccgtttaggtacccgtaacccgggtcggggaccgtacggggtaacccgttcgggactaccggtccgttaccgtacctccgtaccgcccgtaaccccgg

SEQ ID NO: 27684 - DNA, 696 bp, Homo sapiens
  misc_feature: GYAE6OF01EE07T.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttggaaggagtctggtcctacgctggtagaaacccacacacgaccctcacgctgacctgctaccttctcgtgggttctcactcacctacttagtggagtgggtgtgggctggactccgtcacgccccgaggaacggccctagactggctgctactactatttatgaatgatgatacgcgactacacgccatctacgtagaacgagacagactacaactactaccaacgaacggaaccaaccgtaacaaaaacgactaacggtacggtaccttaacgaacgttaccgaaaccctaacgtacgtaccggttaacccgttacggaacaaccgtacgaccctaactaacgttacttacgtgtaccgactacccgaacctacggtacggttacctacgtacgtcgtaccgttacggttacctttacgaaccgttaaccgtaccgggttcgggttaaccccggtaacccgggtcgggggtaacccgtaaccggggtaccccgttacggggtacccgtaccggtcccgtttacccacccggttaccgtacccggtcccccgtaacccggg

SEQ ID NO: 27685 - DNA, 833 bp, Homo sapiens
  misc_feature: GYAE6OF01EASQ6.22.5.A05.1.454.CMB.1.raw
tcagacatacgcgtcacgaccggtgctcgatttagatagatagacagggggactcctgtcgccccacatggacactactttgctccacgctcctgctgctgaccatcccttcagttgggtcttgtcccagactcacgttggaaggtagtcgtcggtcctacgcgtacggtacgaaacccacacacgaccctcgaccgtcgtcgacctgaccttcctttcgtcgttcgggttcctacctacctacctaacctacttaggtgggtaggtggggtgggtcgggtcgtacgggtaccgtcccggtacgacccggaccccggaagggaaccggtaccgtaggtaccgtcggtccgttacgccgtacttacgttaagtttagttaggtaagtaggtaagtaggtaacgtaaccgccgtaccgtaaccgaccgtacccttataccgttacggtacgaacgaccgtacgtaacgtacctaaccgtaaacctaccgtaaaccgaaccgtaaaccggtaacccaaaccgtaaaccgaaaaacggtaccgttaaacggttaccgtaaaccgttaacgtaaccgtaaccgtaaaccctaaggttaaccgggttaccccggttaaccgttaccggaaccaaccgtacgttaaccctaacgtttaaccttacggttacgtaccgaccgaacccaaccgtaccggtacgtacggttcctaacgtcgtacgttccttggttaaccttacgaacgtaccggtaacggtccggtaaccgaccgggtccggaacccgggtacgtaccggtcggcctacgggtcctacccgtaccgactccgccctaaccggg

SEQ ID NO: 27686 - DNA, 805 bp, Homo sapiens
  misc_feature: GYAE6OF01AO4IM.22.5.A05.1.454.CMB.1.raw
tcagacatacgcgtcacgaccggtgctcgatttagatagatagacagggggaggaactgctcagttaggacccagagggaaccatggaacgccccagctcagcttctcttcctcctgctactctcggctcccagacgaccgaccggagtagttgtggttagaccactacgtttccacgcccaccctgttctttgtcctccgaggacgacgccgggccctaccctcgtccgtgcgacgggaccaagtggacgtagttacttacgaccgtacgttacttcggaccgtacggtaaccaacgaggacggtcccttacggaccgaaccgggtccctacccggtaacggtcccttaccctacgtacgttagttacgtaggtaccgttacgtaccccggttaaaccgaaaaccggggcccttaacggtccgggtacctaaccccgtaccccgtacggtcccggttacgggttaccgtacggttcggaacccggtaggggtttacggtacgtaacgggaaaggtaccttaccgtaccgtaccgttcctaccgtaacctaggtaacctaacgtaccgttacgtacggtaccgtacgtacgtacgttaaccgttctaccggttacttacgttattaccgtcgtacacggtctacggtaccgtaacgtacgtccgtacccttacggttaccgttccgggacggtacggaccgtacgtcgacggtacgtaactgggaaccgtaggtaccgtcgggtgtacctcggaaccgttaccctacgttccggttacgtcccttacccggtccgtccgtaaccg

SEQ ID NO: 27687 - DNA, 814 bp, Homo sapiens
  misc_feature: GYAE6OF01EI8EQ.22.5.A05.1.454.CMB.1.raw
  modified_base (215)..(215): a, c, t, g, unknown or other
  misc_feature (215)..(215): n is a, c, g, or t
tcagacatacgcgtcacgaccggtgctcgatttagatagatagacagggggactcctgtcgccccaccatggacacactttgctccacgctcctgctgctgaccatcccttcatggtcttgtccagatcaccttgaaggagtctggtcctacgcgtaggtacgaaacccacacacgaccctcaccgctgacctgcctaccttcgtcgtggttccncactacacctacgttagtgggtaggttgggtggtacgggtcgtaggaccgtccggtaccaccggaccccgaaggggaaaccgtacccgttagaaccgtggtccttcgaccgtactttagttaacttttaggttaggtaagttggtaagttacggaaacgttaacggccgtaaccgttaaccgaaccgtaccccttacttaccgttacgtaacgggaaacgtaacggacgaacgtaacctaacaaacaactaacccgaaacccgtaaacggaaccccgtaaacccaaaacgtaaaaacgccggttaaaacggttcccggtttaaacctaaccgtaaacgacgtaaaccctaaagtacgttacccgttaacccggtttagaaaccaacgacccgtaaccaacttaattaacggttacctaggtactaacccaaccgtaacgacggtaccgttacctcgttacgtcggttactcgtaaccttacgtaaccggtaagtacccgttacgggtaacccgtaccgggtccgggtaacccggtaaccggtcccgtaggtacccgtccggtacccttcggtaccctacgccccgtcccgtaaaccccg

SEQ ID NO: 27688 - DNA, 659 bp, Homo sapiens
  misc_feature: GYAE6OF01D1DEA.22.5.A05.1.454.CMB.1.raw
  modified_base (494)..(494): a, c, t, g, unknown or other
  misc_feature (494)..(494): n is a, c, g, or t
  modified_base (613)..(613): a, c, t, g, unknown or other
  misc_feature (613)..(613): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgttctttgtctccgaggggaaagcgccaccctctcctgcgaggccagtcagagtgttaactacttacttacgcctggtaaccaacgaacgaaacctggaccaggcctcccaggcctcctcatactatgatgctatactacgacgggtcccacgtcgaccacgtcccgacgtccgtaggttacgaggttcggcgtagggttcggggtcgtacggggacaggtacccttcgaccttccgtaccaacctacgtaccagacacgtacctagacgtccgtagaacgtttcgttttagtactttagttttaacttagtcgtacgngtacgtagacgttacgacctaacccgtcccgtacgtccggtacgggaccggtaacgggtaccgtaagggtacggaagtaacgtaacgtaaaccgtagtcggtaggcgtacgacaccgtnttccgttgttacccttactaccttcccgttacccgtctcgtaccgg

SEQ ID NO: 27689 - DNA, 756 bp, Homo sapiens
  misc_feature: GYAE6OF01BBLAF.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcacctttctctgggttctcactcaccacttatggagtgggtgtgggctggactccgtcacgcccccgaggaaacggccctagactggcttgcactcatttattggaatgatagataagcgctacacgcccatctcagaagagcagactacaacactacaaccaaaggaccaacctaaccaaaaacgctaacggtacggttacctaactaactacgaacccaaactacgttaccgggttaaccctttacgggaacctaaccgacgtacccctaactaaatttaaactttaccgtacggtacgacccaacctaaccccgtaacgtaaccggggtttcttacccgttaacgttccggtacggtttacggttacccgtttttaccgggtaaaccgtttaacccgggtttacccggtttaccccggggtaaacccggttcccggggggggaaccccgttaacggggggtaaccccccgtttagggggtaccccgtaaacgggttcccccggttacccgtttacccctacccgggtacccgtaccccccgttacccggtaaaaccccccgggg

SEQ ID NO: 27690 - DNA, 658 bp, Homo sapiens
  misc_feature: GYAE6OF01DZ7MN.22.5.A05.1.454.CMB.1.raw
  modified_base (206)..(206): a, c, t, g, unknown or other
  misc_feature (206)..(206): n is a, c, g, or t
  modified_base (395)..(395): a, c, t, g, unknown or other
  misc_feature (395)..(395): n is a, c, g, or t
  modified_base (540)..(540): a, c, t, g, unknown or other
  misc_feature (540)..(540): n is a, c, g, or t
  modified_base (580)..(580): a, c, t, g, unknown or other
  misc_feature (580)..(580): n is a, c, g, or t
  modified_base (586)..(586): a, c, t, g, unknown or other
  misc_feature (586)..(586): n is a, c, g, or t
  modified_base (597)..(597): a, c, t, g, unknown or other
  misc_feature (597)..(597): n is a, c, g, or t
  modified_base (649)..(649): a, c, t, g, unknown or other
  misc_feature (649)..(649): n is a, c, g, or t
tcagacatacgcgtcacgaccggtgctcgatttagatagatagacgagggggaggaactgctcagttaggacccagagggaaccatggaagccccagctcagtcttctcttcctcctgctactctgcctcccaagaaaccacggagtagttgtgttgacacagttcctccagcccaccttgttcttttcgctccgaaggggaaacncgcccacccttctcctgtacgacgggcctaagtcaggtagttagttaaacctacgttacttacgccgttacggaaccaagacgaaccttggaccaggcctacccgaggtcctcctactattccgtatcggatcgcttactcgttaacggacgggccaacgtggaccacgtcccagcccgtaggttacgnggtcggcgtaggtcgggtcgtaaggactacggtaccttcggaaccttcgaaccaccgtgtaccgacgacgtaccggtacctaggactacgtaagtaagtttgtttacgtactttaagtttcttactgtactagctagtcgtaacnctaacctccgacgtacggtcggacggacggacgtaggtanacgtanaacgaacgtcnggtcgcgtacactacgtacgttcttcgttacctacgtcttaccctacccgtntccgtacgg

SEQ ID NO: 27691 - DNA, 858 bp, Homo sapiens
  misc_feature: GYAE6OF01CQNOB.22.5.A05.1.454.CMB.1.raw
  modified_base (137)..(137): a, c, t, g, unknown or other
  misc_feature (137)..(137): n is a, c, g, or t
  modified_base (194)..(194): a, c, t, g, unknown or other
  misc_feature (194)..(194): n is a, c, g, or t
tcagacatacgcgtcacgaccggtgctcgatttagatagatagacagggggaggaactgctcagttaggacccagagggaaccatggaagccccagctcagcttctcttcctcctgctactctggctccagaaaccncggagagttgtgttgacacagtcctccagcctacctgtctttgtctcagggggaaancgcccaccctctccgtgccgagggtccagtcaaggtagttgttaaacctacttacttacgcccgttaggtaacccaaacgacggtaaacccctgggacccagggccctcccgaggtcctcctcattctagtgtatcgctacgttccgttaacgacgggtccaaccggtggacctacccgtacccaggtccccgtaagggttaccgaagggtcggaccggtagggttcggggtcggtacgggggtaactaacgggtaccctttaccgtaacgtccccttaacgtaacccctagtacccaacggtcctaaaccggtacccgtaaggtaccgtaccggttaacggtaacggtttacgttttacggtaccttttagttttaaccgttagttacgtacgtacggtacgtacgtaccggtaacgtaccctaacccgttaccccgtacggtaaccggttccgggggaaccggggtaaccgggggtaaaccggtaaacgggggttacgggaaacggtaaccggtaaccggtaaaaaccggtaccggttacgggttacggggtacccttaaccgggtaccccgttaacccggttaccctttacggtttacccgtttaccctttaccctaacccgttttccccgtacccccgtcccgttaccgttaaacccggg

SEQ ID NO: 27692 - DNA, 735 bp, Homo sapiens
  misc_feature: GYAE6OF01CNGKD.22.5.A05.1.454.CMB.1.raw
  modified_base (679)..(679): a, c, t, g, unknown or other
  misc_feature (679)..(679): n is a, c, g, or t
tcagacatacgcgtcacgaccggtgctcgatttagatagatagacagggggactcctgtcgccccaccatggacacactttgctccacgctcctgctgctgaccatcccttcagttgggtcttgtcccagatcaccgttgaaggagtctcggtcctacgcgtggtacgaaacccacacacgaccctcaccgctcggacctcgcctaccttcgtcgttggttcctacactccacctagttgtagggtggtcgggtggtcgggcgtggacctccgtcgaccggacccgaacgggaacggtacccgtaggtacgtcgggtctttcggacctacgttattaagtttaggtagtaagtagtagttacggtaacgtaacgaccgtacgtaacaccgtacctacgttactaacgtacggaaacggacgacgtaacgaacctaacaaacgtaaccaaccgaaacgaaacggtaacccaaaccgtaaaccgaaaacgtacgtaacgtacgttaaccaagtacctaacgaaccgtaacgtacgtaccggtaccttacgaccaacgacgactaactaacttaacttacgtcgacaaccaacgtaaccgaacggtaccgttctacggtactcggtacttcggttacttacgaccgttaacgtcggttaccggtacgtacccgggaccgggngtaaccgggtccgtaccggcaccgtcctccttaccgcgtaacccgcgtaaccccgg

SEQ ID NO: 27693 - DNA, 728 bp, Homo sapiens
  misc_feature: GYAE6OF01CD6NR.22.5.A05.1.454.CMB.1.raw
  modified_base (225)..(225): a, c, t, g, unknown or other
  misc_feature (225)..(225): n is a, c, g, or t
tcagacatacgcgtcacgaccggtgctcgatttagatagatagacaggggggactcctgtgccccaccatggacacactttgctccacgctcctgctgctgaccatcccttcatgggtcttgtcccagactcaccgttgaaggactcgtcggtcctacgcgtgggtacaaaccccacacaacgaccctcaccgctacgacctgcctaccttctcgttcggttacncactccacctattagtggtaggttgggtggtgggtctggactccgtcaccgacccgaaggaaccgccagacgtgtctcgctactcgttaattagtagagtagtagtagaatacgcgtactaccacgtacctatcgacgtaagagacactacgactaacaaacgtactaaccgaacgaaaccgaccaaaccgtaaacgaaaacgtacgtaaacggttaccttaaccgtaacgaactaccgaaacctaattaccgggttaccggttaacccttaggaaccctaacggactaacccagttaaacctttacgtaccggtagaccccaactaaccccgtacgtaacgggtaccgtttaccccttacgtacggttccgtacgttacgttaacgtactaacgtaccggtacgtacccgggtacgtaaccccggtgggtacccgtaaccgggtaacctcgggtaactacccggttcctaccgtaaccgtcccgacgttccctaaacccggg

SEQ ID NO: 27694 - DNA, 750 bp, Homo sapiens
  misc_feature: GYAE6OF01DZC0M.22.5.A05.1.454.CMB.1.raw
  modified_base (169)..(169): a, c, t, g, unknown or other
  misc_feature (169)..(169): n is a, c, g, or t
  modified_base (182)..(182): a, c, t, g, unknown or other
  misc_feature (182)..(182): n is a, c, g, or t
  modified_base (215)..(215): a, c, t, g, unknown or other
  misc_feature (215)..(215): n is a, c, g, or t
tcagacatacgcgtcacgaccggtgctcgatttagatagatagacagggggactcctgtgccccacatggacacactttgctccacgctcctgctgctgaccatcccttcagtgggtcttgtccagatcaccgttgaaggtgtctggtcctacgcgtggtacaaacccncaacacgaccctnacgctgacctgcctaccttctcgttcggttccncctacctaccaaccttacgttagtggggtagttggggttcgtgggtctacgggtactccggtccaccggaccccgaaagggaacgcccgtagcgtcggtctgctaacttagttaatttagtaggtaatgtaagtagaagtaacgccgtacgtaccaaccgtcctattcgacgtaggaaaacgcgaacgaactaccaacgtaaactaccgaaccgaaaccgaaacgaaacccctaaacccgtaaaaacgtaaaacggtacgtaaaccggtttaaccgtttaacccttaaacgtaacctaaaccaaacccgttacgtaccgggtttaccgttaacccggttacgaacctaaccgtaaccaaccctaagttactttaacttcggtactaccgtaaccaacccgtacgaacgtcggtttacctacgttacgttcgcgttaccggttacctagtaacgtaccgtacggtccggttacccggacggtaccgggccgtaacggccggtagtacgcgtcttaccgcctacgcctcccgaaccg

SEQ ID NO: 27695 - DNA, 845 bp, Homo sapiens
  misc_feature: GYAE6OF01B356Z.22.5.A05.1.454.CMB.1.raw
  modified_base (149)..(149): a, c, t, g, unknown or other
  misc_feature (149)..(149): n is a, c, g, or t
  modified_base (179)..(179): a, c, t, g, unknown or other
  misc_feature (179)..(179): n is a, c, g, or t
  modified_base (230)..(230): a, c, t, g, unknown or other
  misc_feature (230)..(230): n is a, c, g, or t
tcagacatacgcgtcacgaccggtgctcgatttagatagatagacagggggactcctgtcgccccaccatggacactacgtttgctccacgctcctgctgcctgaccatcccttcagtgggtccttgtcccagactcaccgttgaaggngtcctggtcctacgctgggtacaaaacccncactagacccctcgaccgctgaccctgcctacctttcgtcgtacggttccncacgtccaacctacttaggtggagttggggtggtacgggctggacttcccggacgaccgaacccccggaagggtaaacgtcccgttaaggtaccgtggtacctttcgacctaccttacttaagttttacgaggtaatggttaagtacggtaacgttaacgccggtaacctaaccgactaccctactactaggtaagaacgacgacaacgttaccaactaaacacgtaacccgaaaccgaacggttaacccaaccgaaacgaaaaacgtccggtaaaacggttccttaaacccttaacgaataccggaaccctaaacggtacgttaccggttaaacccgttagggaaacccaaccggtacgtaaacccgtaccgtaaatttaccggttaacttaccggacctaacccgaacgtacccggtaacggtaccgggtttaacctaaccggttaccgttaccgtccggttacgtttacccggtttaacgtacggtaaaccgtttaaacggttcccggtaacgggaccccgggttaagggggaaccccgtaccggggtttaacccgcgggttaacctcggggttaccctccggtaaccttccgaaccccggccctaccccgg

SEQ ID NO: 27696 - DNA, 606 bp, Homo sapiens
  misc_feature: GYAE6OF01ENBMH.22.5.A05.1.454.CMB.1.raw
  modified_base (331)..(331): a, c, t, g, unknown or other
  misc_feature (331)..(331): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcacctacttatgggagtgggtgtgggctggatccgtcacgccccgaggaaacggccctagactggcttgcactctatttatggaatgatgataagcgctacacgcccatctcgtagaaganacgacgactacaaacataccaacgtaacggaaccaacctaaccaaaaaagcctaaggttacggtaccttaacaactacgaacccaactacgttacggtaaccctttacggaacctaacgaacgtacccaactaacttaacttactagtcgacaccaccaacgtacggtactacctacgtcgtcgttacgtcttacaagtaccaacgttcggtaccgtaccgtcgggtaccgaacgggtaccgtacggtcacgtctcctacctcgcgccctacccg

SEQ ID NO: 27697 - DNA, 707 bp, Homo sapiens
  misc_feature: GYAE6OF01B7CEV.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtagaaacccacacagaccctcacgctgacctgccaccttctcgtgggttctcactccacctacttagtggaggtggggtggtgggctggactccgtcaccgaccccgaggaacggccctagacgtggtctgcactctatttagtgatgatgatagcgacacacgccatctcgtagaagagacacgacacaacactaccaaccgaacggaacctaacctaacgaaaacgtacgtaacggtaccgttaaccttaacgtaacgtaccgtaaccctaaacgtaccgttaaccggttacccgtttaacggaaccctaaccgacgtaacccgtaactattaacgtttacgtcgtaccgacccaaccgtaacccgtaacggtaccggttactacccgttacgtccgttacgttccggttaccgttaccgttaaacgtacccgttaacggttcccgggttaacccggtacccgggtacgggggaccccgtaaccggggtaccggccggtacgaccggttcctacccgttacctaccgtcccgtccccgtaaccccgg

SEQ ID NO: 27698 - DNA, 732 bp, Homo sapiens
  misc_feature: GYAE6OF01BX8MO.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgcaccttctcgtggttcctcactccacctacttagtggaggtgggtggtcgggctggactccgtcaccggaccccgaaggaaccggcccgtaaggacgtggtcttcgcctacgttacttaagttttagttaggtaactggtagtacgtaagtacggccgtactaccgacgtacccgtattccgtacgtagaacgacgacaacgtacctacgaaactactaccgaaccgaacgaaccctaacccgtaaacgaaaacgtacgtaacggttaccgtaaccttaacgaacgtaccggaacctaacgtacgttacccggtaaccgttacggaaccacgtacgaacctactaatttacttacgtacgactacccgaaccaccgtacggtaccggttctaccggtcgtacgtccgttacgttacctacgtaacgttaaccgtacggttccggtaacccgtacccggggccgggtaacccgtaccgggtacccgtaggtacccgtacggtccccttacctacccgtaccgcccgtacccgtaaccccggg

SEQ ID NO: 27699 - DNA, 787 bp, Homo sapiens
  misc_feature: GYAE6OF01AYI5Q.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatggtcttgtcccgagatcaccttgaaggagtctcggtcctacgctggtagaaacccacacacgaccctcacgctgacctgctaccttcgtcgtggttctcactccactacttgtaggtaggtcgggtgtgggcgtcgacgtccgtccaccggtacccccgtaagggaaccggcccgtaggaccgtacgggtcttcggacctacgttacttagttttaactacgggtaataggtaacgtagtaacgtaaccggtacgacgttaccaccgtacctactaccgtaccgtacggaaggtaccgaactaacgtaacctaacgaactacgtaacccgaaaccgaacgaaccctaaaccgtaaaccgaaaacgaccgttaacggttaccgttaacctaaccgtaactaaccgaaacgtaaccgttggtaaacccggtttccggttaaaggaactaaccgcctaaaccttaccgtaatttaacggtgttaaccggtaacgacctaaccgtacgaccggttaacggaccgttcgtactaccggtacgttcggttaccttaacgtcgtaaccggttacggccccgggttaaccggtaaccgggccccgggtaacgtacccggtaccgttacggtaccgacgggtttccacccggttacccacggaccccgtttaccggaaccccg

SEQ ID NO: 27700 - DNA, 908 bp, Homo sapiens
  misc_feature: GYAE6OF01BN42D.22.5.A05.1.454.CMB.1.raw
  modified_base (187)..(187): a, c, t, g, unknown or other
  misc_feature (187)..(187): n is a, c, g, or t
tcagacatacgcgtcacgaccggtgctcgatttagatagatagacagggggactcctgtcgccccaccatggacactactttgcctccacgctcctgctgctgaccactcccttcagtgggttcttgtcccagtactctaccgttggaaggagttcgtcggtcctacgtcgtaggtacgaaacccanacacgaccctacacgtctcgacctcgacctccgttcgtcgttcggttcctcctactacctaacctacttaggtagggtacggtggggttcggtacgggtcgtacggtaccgtcccggtaccgaacccggacccccgaaaggggtaaacccggacccgttaacggtacggttccggttccttaccggtacctacctttaccgtttagttttaacggtaacggtaacgtaggtaacgtaggttaacgaaccggtccgtacgtaaccgaccgtacctacgtctacggtaagaacggcgaactacgactaacgaacctacgtaacccaacgaaaccgtaacctaaccgaaacgaaacgtcgtaacggttaccgtaactaacgtaactacggaaaccttacggtacgttacccggttaacctacggtaaccaccgtacgtaaccctaaagttaccgtttaacgtccgttagtaacccgtaccctaacgtaacccggacgggtttacccgtaccgttaccgttccggttaacggtccgttttaccgggtttacttaaccgggtaaccgttaccggttaacccgggttttacccgggaaccccgggtttaaccccgggggtcggtaaaccccgggggttaaccggtaaccccggttcgggtaacccggttacggtaccccgtttacccgcccccggtaaacccgtccgtaaccccccgggtaaccggg

SEQ ID NO: 27701 - DNA, 745 bp, Homo sapiens
  misc_feature: GYAE6OF01A78K1.22.5.A05.1.454.CMB.1.raw
  modified_base (726)..(726): a, c, t, g, unknown or other
  misc_feature (726)..(726): n is a, c, g, or t
tcagacatacgcgtcacgaccggtgctcgatttagatagatagacagggggactcctgtgcccaccatggacacactttgctccacgctcctgctgctgaccatcccttcatgggtcttcgtcccagatccaccttggaaggagtctggtcctacgctggtacgaaacccacacacgaccctcgaccgctcgacctgctacccttctcgttcggttctctacctcaacctacgttagtacgggtggttggggtcggtggggtcgtagggtacttcccggtaccgaacccgacccccggaaaacggtaaacggtcccgtaaggtacccgtgggtccttcgcctaactacttaattttacgttaggaattgtaagtagtaacgtaaacgccggtataccgactacccaagttctacgagtaagagacctacgactaacgaacacgtaccgaacgaaccgaactaacccaacgaaaacgtcgtaaacggtaccgtaactaaccgaagtacctaactaactacggtaccggttaaacccgttaggacaactacaaccccgtaataacgttacttagtcgtagaaccctaaccaaccgtaggtcgttaccgttactacgtcgttacgttacgttcctttaacaacggttacctaacggttaccgtacccggaaccggtccgggtaccgaccgggttacccgtagtacccggtctccggttccaccgtaccncccgtaaccccgtacccgg

SEQ ID NO: 27702 - DNA, 805 bp, Homo sapiens
  misc_feature: GYAE6OF01B5CH1.22.5.A05.1.454.CMB.1.raw
  modified_base (317)..(317): a, c, t, g, unknown or other
  misc_feature (317)..(317): n is a, c, g, or t
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
tcagacatacgcgtcacgaccggtgctcgatttagatagatagacagggggacgtcctgtcgccccaccatggacacactttgctccacgctcctgctgctgacctactcccttcagttgggtcttcgtacccagtacttcaccgttggaaagggtgttcgttggtcccttacggcgtcggtacgaaaacccacaccgacgtacccctcacgtctacgacctcgcctaccttctcggtggttcaccactccactaagttgtcggtggtggtggtcggctggacctccgcaccggcccgaaggaacgtcctacgtcgngtctcgacactnttatttgnggaatgatacgagttaacgcccgtactaaccgcgtaccctattccggtaactaaggtaaccggacacgtaaccgtaactaccgtaaaccaccgtaacccgaaaccggtaaacggaacccctaaaccggtaaaacctaaaccggacggtaacgttaacccggttaacttaccgaaacgttaccgtaacccaagtttaccggtaccccgttacccgtacgggtaaaccaaccgtccaaccgttaattaacctttacgtaccgttagtaccgaactaacccgtaaccgtacggtccggttaccttaccgtacgttcgggcctttacggttacccgttaagtaccgttaaccggttacgggttcccgtaaacccggggtcggtaccccgggaacggttaccccgggtaccgttcgggacccttccccggagttaccccttacggaccctcccgggttccccctaaacccggg

SEQ ID NO: 27703 - DNA, 901 bp, Homo sapiens
  misc_feature: GYAE6OF01EVJM3.22.5.A05.1.454.CMB.1.raw
tcagacatacgcgtcacgaccggtgctcgatttagatagatagacagggggactcctgtcgccccaccatggacacactttgctccacgctcctgctgctgaccattcccttcatgggttcttcgtcccagatcctaccgttggaaggtgtcgtcggtcctacgtcgtcggtacgaaacccacacgacgtaccctcaccgcctcgtacctcgccttacctttcgttccgttcgggttcctacctacctacctaacccttaacgttaggttggggtacggttgggggttaggttcggggtacgttacgggtaccgttacccggttaccgaaccccgggaccccggaaacgggaaacccggtaccgtaacggacggttcggttccgttacgtacctaaccgttacgtttaacgttttaacggttaggtaacgtagtaagttaacgtaaggtacgaccgtaacctaccgaaccgtacccttagtacgttacgtaacgggtaacgaacgtaacgaaccgtaacctaaccaaacctaaccgtaaacccgaaaacccggtaaaccggtaaacccgtaaaaccccgtaaaacggtaaaaacggtaaccgttaacggtttaacccggttaaaacctaacgtaaacgttaaccgaaaccgtaaaccgttcggttaaccggtacccggttaacgaaccacgactaaccgtataacgttaactgtaccgactaaccgaccgtaacgttacggtacgttacctacttcgggtacctacggttcgttaacctaacgttaccgtaccgttaccggtaccggtaacccggtacccggggtaccgggacccgtacccggtcgggttaaccgcgttaccgtaccgttcctaacccccgtgacccgcccgtaacccggg

SEQ ID NO: 27704 - DNA, 920 bp, Homo sapiens
  misc_feature: GYAE6OF01DXESS.22.5.A05.1.454.CMB.1.raw
tcagacatacgcgtcacgaccggtgctcgatttagatagatagacagggggactcctgtgccccaccatggacacactttgctccacgctcctgctgctgaccatcccttcagtgggtcttgtcccagatcaccttgaaggagtcgtggtcctacgcgtggtacgaaacccacacacgaccctcacgctgacctgcctaccttctcgttggttctcactcacctacttagtggtaggtgggtggtggcgtggacgtccgtcgaccgaccccgaaggaacggaccctagacgtcggtctcgactactcttatttagtaggtaatagacgtagaagtaacgccgtacctaccgaccgtaccctacgttacgtacgtaaggaaacggacgacctaacgtaacctaaccaaactaaccgtaacccgaaacgtaaaccggaaccctaacccgtaaaaccaaaaacggtaaccgtaaacggtttaccggttaaacccttaaacgtaaccgtaacgtaaacccgaaacgttaaccgggttaacccgggtttaacccggtttaacgggaaaccctaaaccggtaccgtaaccccgtaaactttaacgtttaaaccgtttaaccgttacgggttaacccgaacccctaaacccgtaacccgggtaaacgggttacccgggttttacccttaacccgtttacggttaccgttcccgggtttaacgttacccgttttaacggtaaaccggtttaaaccccgttaaccggggtttcccgggtaaacccccggggtaacccggggttacccgggggaaaccccggttaaccggggttaacccgttaccgggtaccccggttaacccgggtcccgttttaaccccggtaccccgttaacccggtccccgttaacccccggtaaaccccccgggg

SEQ ID NO: 27705 - DNA, 961 bp, Homo sapiens
  misc_feature: GYAE6OF01EULZN.22.5.A05.1.454.CMB.1.raw
  modified_base (215)..(215): a, c, t, g, unknown or other
  misc_feature (215)..(215): n is a, c, g, or t
tcagacatacgcgtcacgaccggtgctcgattttagatagatagacagggggactcctgtgccccaccatggacacactttgctccacgctcctgctgctgaccatcccttcatgggtcttgtccagatcaccgttgaaggagtctggtcctacgctggtcgaaaacccacgacacgaccctcacgctgacctgcctaccttctcgtagggttcncactcacctacgtttagtgggaggttggggtggttcggggactggtacgtcccgtaccgaccggtacccccgaaggggaaaccggtacccctaaggtaccgttacgggtactttcggacctaccgttacttagtttttaacggttaggtaagtaggtattaggtaagttaacggccggtacctaaccggacgtaccccttaatccgtttacgaaggaaacgtacggtacgtaaccgaacctaccgtaaaacctaactaacccgaaaccgtaaaccggaaaccccttaaaccccgaaaacgtaaaaaaacccgggtacgttaaaaccgggttaccggtttaaacccctttaaaaccgaaccgtttaaacccgaaacccgttaaaaccgtaaccgggtttaacccggtttaccccggttttaacggaaacccggttaaccgaacccggtaaaccccgtaactttaaaacgtttaaccgttttaaacccgtacggttacccgtaccctaaacccggaacccgtaacggttaaccgggttaaccgttccttaccggttacgttaccgtttacggtttactttacccggttaaacgttaacccgttaaaccggtttccggggttaaaccccggtaacccggggttaccccggggaacccgtacccgggggttaacccccgttacgggaacccgttaccggttcccctacccgtccccttaaccggtcccccgtaccccgtaaacccccggg

SEQ ID NO: 27706 - DNA, 764 bp, Homo sapiens
  misc_feature: GYAE6OF01AJ87P.22.5.A05.1.454.CMB.1.raw
tcagacatacgcgtcacgaccggtgctcgatttagatagatagacaggggggactcctgtgcccaccatggacacactttgctccacgctcctgctgctgaccactcccttcatgggtcttgtcccagatcaccttgaaggtagtctggtcctacgctggtacgaaaccacacacgaccctcacgctgacctgactaccttctcgtgggttcctcgactaccacctacttagtgggaggtgggtggtcgggcgtaggactccgtacaccggaccccgaaggaacgtcccgtacgtacgtcggcgttcgaccgtactcttagtttaagttacggtaagttaggtaacgttaggtaacgtaacggtaccggtaccgtaaccgaccgttaccccgtaacgttacccgttaccggtaacgggtaaacggaacggtaccgaaccgtaaccgttaaccgaactaaccaaccgaacccgaaaccggttaacccaaccgtaaaccgaaaacgtacggtaacggtaccgttaccgttaacaacgtacgaaccctaagtcggtacgtacctaggaccacactccaattagtactcgtacgctaccaccacgtacgtacgttcctacgttcgcggtattcgtacttacgaactccgtacggttaccgttaccccggaacggggtacccggtacggtaaacccggggtcccgttcggtaacccgtacccggttcgttaccctacccggtacggtccccgttaacccgtaacccggg

SEQ ID NO: 27707 - DNA, 507 bp, Homo sapiens
  misc_feature: GYAE6OF02IYMBW.22.5.A05.1.454.CMB.1.raw
  modified_base (415)..(415): a, c, t, g, unknown or other
  misc_feature (415)..(415): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgcccccaggaaaggccctagactggcttgcactcatttattggaatgatgataagcgctacagcccatctctgaagagcagactcaacatcaccaaggacacctacaaaagcaagtgtccttacaatgaccaacatggaccctttggacacagccacatattactgtncacaccacagggtctctactgctgtctttcagtacactggttcgaacccgtgggaccagggaccctggtcacgcgtctcctcacgcctaccg

SEQ ID NO: 27708 - DNA, 534 bp, Homo sapiens
  misc_feature: GYAE6OF02JH6QI.22.5.A05.1.454.CMB.1.raw
  modified_base (255)..(255): a, c, t, g, unknown or other
  misc_feature (255)..(255): n is a, c, g, or t
  modified_base (302)..(302): a, c, t, g, unknown or other
  misc_feature (302)..(302): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaanagaaacctggccaggctcccaggctcctcatctatgatgcatcttangggccactggcatcccagccaggttcagtggcaggtgggtctgggacagacttcactctcaccatcagcagcctagagcctagaagtattttgctagtttattactgtcagcagcgtagctaactccctcacgttcggacgggtacgggaccgaaggtggagtatacgaaacgactggtaggctgccacctattccgtgttaccttctacttccgttcccgtcctacttccg

SEQ ID NO: 27709 - DNA, 505 bp, Homo sapiens
  misc_feature: GYAE6OF02G2JR0.22.5.A05.1.454.CMB.1.raw
  modified_base (401)..(401): a, c, t, g, unknown or other
  misc_feature (401)..(401): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagccccaggaaaggccctagactggcttgcactcatttattggaatgatgataagcgctacagcccatctctgaagagcagactcaacatcaccaaggacacctacaaaagcaagtgtcctacaatcgaccaacatgaccctttggacacagccanatattactgtgcacaccacagggtctctactgctgctttcaagtacaacgtgttacgacccgtgggccagggaccctggtcacgcgtctcctcacgcctacccg

SEQ ID NO: 27710 - DNA, 595 bp, Homo sapiens
  misc_feature: GYAE6OF02HNMAC.22.5.A05.1.454.CMB.1.raw
  modified_base (308)..(308): a, c, t, g, unknown or other
  misc_feature (308)..(308): n is a, c, g, or t
tcagacatacgcgtcacgaccggtgctcgatttagatagatagacaggggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaaggcctagactggcttgcactcatttattggaatgatgataagcgctacncgcccatctctgaagagcagactacaacatcacaaggacacctaccaaaaagcaagtcggtacctacaatagaaccaacatcggaccctttggacacacgaccactataactttactagtcgacacaccgacgtacgggtcctaccgtactgtccgttgtcctttacaacgttaaccacgttacggtttaccggtaaccccggttcggggacccgtaacggggtaaccccgttacgggtacgtacggtccggttaccgtcccgtaccgtaccggtaccctaccccgg

SEQ ID NO: 27711 - DNA, 633 bp, Homo sapiens
  misc_feature: GYAE6OF02JNBHO.22.5.A05.1.454.CMB.1.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (257)..(257): a, c, t, g, unknown or other
  misc_feature (257)..(257): n is a, c, g, or t
  modified_base (274)..(274): a, c, t, g, unknown or other
  misc_feature (274)..(274): n is a, c, g, or t
tcagacatacgcgtcacgaccggtgctcgatttagatagatagacagggggactcctgtgccccaccatggacacactttgctccacactcctgctgctgaccatcccttcatgggtcttgtcccagatcaccttgaaggagtctggtcctacgctggtgaaacccacacagaccctcacgctgacctgcaccttctctgggttctcactcaccacttatggnagtggggtntgggctggatccggtccaggccccngaagccctagactggcnttgctatcatttatggaatgatgataagcgctacagcccatctctgaagagcagactcaacagtcaaccaaggaacacctacaaaaagcaaagtagtaccttaacaatagaaccaaactagtacggaaccctttagggaaccaacgaacgtacctaacagttaacttaacctagtacgaccaacgtacccaacgtacgggttactaccttaacgttcgtacctaggtacctttacgacggttaccgaaccgttcggggttaacccgaacccggttacgggggtacccgtaacggggtaaaccccgttacgggttaccctaacggtacccggttacccgttaccccgtaccgtaacccgg

SEQ ID NO: 27712 - DNA, 536 bp, Homo sapiens
  misc_feature: GYAE6OF02H61YF.22.5.A05.1.454.CMB.1.raw
  modified_base (526)..(526): a, c, t, g, unknown or other
  misc_feature (526)..(526): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctcgtgggttctcactcaccacttatggagtgggtgtgggctggactccgtcacgccccaggaaacggcctagactggcttgcactctatttattggaatgatgataagcgctacacgcccatctctagaagagcagactacaacatccaaccaacggacaacctaaccgaaaaagcaaggtcggtacctttaacaatacgaaccaacagtcgtaccctttgacacagaccacatattactgtcgcaccaccacgacggtctcgtactgcttgtcttcagtacacttgtaccgaccgtgggaccgacggaccgtgcacgtcgtcctcctcncgcctacccg

SEQ ID NO: 27713 - DNA, 520 bp, Homo sapiens
  misc_feature: GYAE6OF02FFTQX.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaggccctagactggcttgcactcatttatggaatgatgataagcgctacagcccatctctgaagagcagactcaacatcaccaaggacacctaccaaaaagcaagtcggtaccttacaatacgaaccaacatggtaccctttggaccacacgccacatatactgtgcacaccacaggtctctactgcttgctttcagtacaacttggtccgaccgtcgggaccacgggaaccctggtcacgtccgtctcctcacgccctacccg

SEQ ID NO: 27714 - DNA, 506 bp, Homo sapiens
  misc_feature: GYAE6OF02G4M9K.22.5.A05.1.454.CMB.1.raw
  modified_base (196)..(196): a, c, t, g, unknown or other
  misc_feature (196)..(196): n is a, c, g, or t
  modified_base (391)..(391): a, c, t, g, unknown or other
  misc_feature (391)..(391): n is a, c, g, or t
  modified_base (481)..(481): a, c, t, g, unknown or other
  misc_feature (481)..(481): n is a, c, g, or t
  modified_base (499)..(499): a, c, t, g, unknown or other
  misc_feature (499)..(499): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaacagaaacctggccaggctcccaggctcctcatctatgatgcatcttacagggccacgtggcactcccagccaggttcagtggcagtggtctgggacagacttcactctcaccatcagcagcctagcgcctagaagtnttttgctagtttattactgtcagtcagtcgtagctactccctcacggttcggcggaggaccgaggtgagatacgaagatgtgctgcaccntctgttctcattcctccnctactcg

SEQ ID NO: 27715 - DNA, 530 bp, Homo sapiens
  misc_feature: GYAE6OF02IUTES.22.5.A05.1.454.CMB.1.raw
  modified_base (195)..(195): a, c, t, g, unknown or other
  misc_feature (195)..(195): n is a, c, g, or t
  modified_base (351)..(351): a, c, t, g, unknown or other
  misc_feature (351)..(351): n is a, c, g, or t
  modified_base (391)..(391): a, c, t, g, unknown or other
  misc_feature (391)..(391): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaangccaccctctcctgcagggccagtcagagtgttaactactacttagcctggtaccaacagaaacctggccaggctcccaggctcctcatctatgatgcatcttacagggccactggcactcccagccaggttcaggtggcaggtgggtctgggacngacttcactctcacatcagcagtcctagacgctagaagtnttttgcttagtttattactgtcagcagtcgtagctaacctcctcacgttcggcggacgggaccgaagggtcggagactacgaacgtacgtgtcggcgtgccacacttctgtcttctacttccgttacccgcctataccg

SEQ ID NO: 27716 - DNA, 538 bp, Homo sapiens
  misc_feature: GYAE6OF02IHRUD.22.5.A05.1.454.CMB.1.raw
  modified_base (456)..(456): a, c, t, g, unknown or other
  misc_feature (456)..(456): n is a, c, g, or t
  modified_base (528)..(528): a, c, t, g, unknown or other
  misc_feature (528)..(528): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagccccaggaaaggccctagactggcttgcactcatttatggaatgatgataagcgctacagcccatctctagaagagcagactcaacatcaccaaaggacacctaccaaaaagacaagtcggtaccttacaatagaaccaaacatacggaccctttggaacacagaccaacattaatttactgtgcaccaaccacaacgggtctactacngtctgtctttcaagtacaatcggttacgacccgtgggaccacgggaaccctcggtacagtcgtctccctacncgcctacccg

SEQ ID NO: 27717 - DNA, 584 bp, Homo sapiens
  misc_feature: GYAE6OF02HS04Y.22.5.A05.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (268)..(268): a, c, t, g, unknown or other
  misc_feature (268)..(268): n is a, c, g, or t
  modified_base (362)..(362): a, c, t, g, unknown or other
  misc_feature (362)..(362): n is a, c, g, or t
  modified_base (404)..(404): a, c, t, g, unknown or other
  misc_feature (404)..(404): n is a, c, g, or t
tcagacatacgcgtcacgaccggtgctcgatttagatagatagacggagggggaggaactgctcagttaggacccagagggaaccatggaaaccccagcgcagcttctcttcctcctgctactctcggctccagatattactggaggacgtttggtccttgacgcagtctccaggcaccctgtcgctgtctccgaggggaangccaccctntcgtgtaaggccagtcagaatgttaacaacagatatgtagctggtattcagtcaganacctggccagtctcccgttactccctcgttcttggtgcggccgagagggccacgggcactccctggacagtattcagtgcaggtcgggtccggnagctatctgcctcacagtcggcgtctaggacctgagatttcngacacgttatattctgttcaattctttattagttaattccacctttcggttacttaacacttcgtttaggccgtaaggggtacctaaggcgttagggactattaccgaaacggtacgttgtcgggtaccttacggccaccgttagtcccgtttaggttacctttccggactttacccccg

SEQ ID NO: 27718 - DNA, 526 bp, Homo sapiens
  misc_feature: GYAE6OF02JDP1B.22.5.A05.1.454.CMB.1.raw
  modified_base (373)..(373): a, c, t, g, unknown or other
  misc_feature (373)..(373): n is a, c, g, or t
  modified_base (419)..(419): a, c, t, g, unknown or other
  misc_feature (419)..(419): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagccccaggaaaggccctagactggcttgcactcatttattggaatgatgataagcgctacagcccatctctgaagagcagactcaacatcaccaaggacacctaccaaaaagcaagtggtccttaanaatgaaccaacatcggaccctttggacacagccacatattactgtncacaccacagggtctctactgctggtctttacagtacaacttggttcgaacccgtggggaccacgggtaacccgtggtcacggccgtcctcctcgacgccctacccg

SEQ ID NO: 27719 - DNA, 516 bp, Homo sapiens
  misc_feature: GYAE6OF02HWB8N.22.5.A05.1.454.CMB.1.raw
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctggggacagacttcactctcacatcagcagcctagacgcctagaagtattttgactagttttatacttgtcagcagcgtagcaacctcctctacgttcggcggacggacaagggtgagatacgaacgactggtagcgtgccacatctgtcttcacttccttcccgcctatccg

SEQ ID NO: 27720 - DNA, 522 bp, Homo sapiens
  misc_feature: GYAE6OF02HFMEU.22.5.A05.1.454.CMB.1.raw
  modified_base (426)..(426): a, c, t, g, unknown or other
  misc_feature (426)..(426): n is a, c, g, or t
  modified_base (442)..(442): a, c, t, g, unknown or other
  misc_feature (442)..(442): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaaggccctagactggcttgcactcatttattggaatgatgataagcgctacagcccatctctgaagagcagactcaacatcaaccaaggacacctaccaaaaagcaagtcggtaccttacaatagaccaacataggaccctttaggaccacacgaccacatattactgtncacaccacaggtctcnctgctgtcttcagtacactggttacgacccgtgggccgacgggtaaccctcggtcgagtcgtctcctcgacgcctacccg

SEQ ID NO: 27721 - DNA, 531 bp, Homo sapiens
  misc_feature: GYAE6OF02FN4XN.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaaggccctagactggcttgcactcatttattggaatgatgataagcgctacagcccatctctgaagagcagactcaacatcaccaaggacaacctaccaaaaagcaaagtggtccttacaatgaccaacatcgaccctttggacacagccacatattactgtgcacaccacaggtctctactgctgtcttacagtaccacttgttaccgacccgtcgggccgtaacggggaacccttgggtacacggtccgtcctccgtccgacgtccctacccg

SEQ ID NO: 27722 - DNA, 507 bp, Homo sapiens
  misc_feature: GYAE6OF02GWUZ6.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagccccaggaaaggccctagactggcttgcactcatttattggaatgatgataagcgctacagcccatctctgaagagcagactcaacatcaccaagacacctcaaaaagcaagtggtcctacatgacaacatggaccctttggacacagccacatattactgtgcacaccacaggtctctactgctgctttcagtactaactgttcgaacccgtggggcctagggaccctggtccagccgtcctccctcacgccctacccg

SEQ ID NO: 27723 - DNA, 594 bp, Homo sapiens
  misc_feature: GYAE6OF02IQHZX.22.5.A05.1.454.CMB.1.raw
  modified_base (315)..(315): a, c, t, g, unknown or other
  misc_feature (315)..(315): n is a, c, g, or t
  modified_base (477)..(477): a, c, t, g, unknown or other
  misc_feature (477)..(477): n is a, c, g, or t
tcagacatacgcgtcacgaccggtgctcgatttagatagatagacagggggacgtcctgtgccccaccatggacacactttgctccacgctcctgctgctgaccatcccttcatgggtcttgtcccagatcaccttgaaggagtctggtcctacgctgggtgaaacccacacagaccctcacgctgacctgcaccttctctgggttctcactcaccacttatggagtgggtgtgggctggactcgtcagccccaggaacggcctagactggcttgcactcatttatggaatgatgataagcgctacagcccatcntgaagagcagactcaaacactacaaccaaggtaacaacctacaaaaaacgcaaaggtcggtaccttacaactacgaaccaaacaacgtacgggaccctttaggacctaacgacgccaacctattaacttactgtacgcaccaaccacgaggtactactacgngtcgtcgtctttacacgtaactaacgttggttaccgaacccgttcggggaccgtaacggggtaaccccgttgggtaccgacggtccggtccttcccgtactacgtcccgtaaccccg

SEQ ID NO: 27724 - DNA, 596 bp, Homo sapiens
  misc_feature: GYAE6OF02JJYI7.22.5.A05.1.454.CMB.1.raw
  modified_base (211)..(211): a, c, t, g, unknown or other
  misc_feature (211)..(211): n is a, c, g, or t
  modified_base (257)..(257): a, c, t, g, unknown or other
  misc_feature (257)..(257): n is a, c, g, or t
  modified_base (313)..(313): a, c, t, g, unknown or other
  misc_feature (313)..(313): n is a, c, g, or t
  modified_base (369)..(369): a, c, t, g, unknown or other
  misc_feature (369)..(369): n is a, c, g, or t
tcagacatacgcgtcacgaccggtgctcgatttagatagatagacagggggaggaacgtgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctccngcagggccagtccagagtgttaactactacttagcctggtaccaanacgaacctggccaggctcccaggctcctcatcatgatgcatcttacagggccacgnggcatcccagcccaggttccagtcggcaggtggtctgggacagctcgactcgcacntcagcagcctagacgcctagtagtagtttgcttaagtttattactcgtactagctagcgtacgactaacctccctactcggttcggtaccgggacgggtaacccgaacgggttaggaacgagtaaccgtaaaccgtaacgttggtacggtcgtacggaccgtaaccgtagttccgttacgttccgtttaccgtacttacccggttacccgtacccgtagttacccgg

SEQ ID NO: 27725 - DNA, 597 bp, Homo sapiens
  misc_feature: GYAE6OF02H7X88.22.5.A05.1.454.CMB.1.raw
  modified_base (165)..(165): a, c, t, g, unknown or other
  misc_feature (165)..(165): n is a, c, g, or t
  modified_base (259)..(259): a, c, t, g, unknown or other
  misc_feature (259)..(259): n is a, c, g, or t
  modified_base (324)..(324): a, c, t, g, unknown or other
  misc_feature (324)..(324): n is a, c, g, or t
  modified_base (342)..(342): a, c, t, g, unknown or other
  misc_feature (342)..(342): n is a, c, g, or t
  modified_base (413)..(413): a, c, t, g, unknown or other
  misc_feature (413)..(413): n is a, c, g, or t
  modified_base (458)..(458): a, c, t, g, unknown or other
  misc_feature (458)..(458): n is a, c, g, or t
tcagacatacgcgtcacgaccggtgctcgatttagatagatagacaggggggactcctgtgccccaccatggacacactttgcgtccacgctccctgctgctcgaccatcccttcactgggtcttgtcccagatcaccttgaaggagtctggtcctacgctggtnaaacccacacagacccctcacgctgacctgccacctttctactgggttctcactcacctacttagtggagtgggtgtgggctaggaattccgtntacgccccaggaacgccctagactggcttgccactctatttatggtaatgatgataagcgctacncgcccatctcagaagacncagacctaccaacatacgacaaggaccaacctacaaaagcaaggtcggtaccttaacaagtcgaacctaanagtacggtaccctttgaaccactacgtccaactataactttacgngtacgcaccacacgagggttcctacgtacgtgcgtacgttacttcgaacgtactacggttcgttacccggaaccgtgggtacccgacgggtaacccgtcggtaccgacggtcccgtccttcccgctaccgccctacccg

SEQ ID NO: 27726 - DNA, 639 bp, Homo sapiens
  misc_feature: GYAE6OF02H01RN.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccgaggaacggccctagactggcttgcactcatttattaggatgatgataagcgctacacgcccatctctagaagagacagactacaacatcaaccaaggacaacctaccaaaaagcaaacgtcggtacctttaacaatacgaaccaaacagttacggtaaccctttaggaaccaacgacgaccctaactaacttaactttacgtcgttacgaccaaccaacccgtaacgtaacgggttaccttaccttaccgttacgtccgttagttccttttacgaacgttacctaacgttcgggttaccgtaacccggtcggggacccgtacggggtaacccgttcggtaccgtacgtccggttacccttacccgtcgacccgtccctaaccccgg

SEQ ID NO: 27727 - DNA, 540 bp, Homo sapiens
  misc_feature: GYAE6OF02IQUQQ.22.5.A05.1.454.CMB.1.raw
  modified_base (309)..(309): a, c, t, g, unknown or other
  misc_feature (309)..(309): n is a, c, g, or t
  modified_base (531)..(531): a, c, t, g, unknown or other
  misc_feature (531)..(531): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaacggccctagactggcttgcactcatttattggaatgatgataagcgctacngcccatctctagaagagcagactcaacatacacaaggacaacttaccaaaaagcaagtgtaccttacaatgaccaacatcggtaccctttggacacacgaccacataattactgtgacacaccacgacgggtctactactcgactcgtctttcagttacaacgtggttaccgaacccgtggggcccagggtaacccgtggtccgagtccggtctcctcgacnccctacccg

SEQ ID NO: 27728 - DNA, 695 bp, Homo sapiens
  misc_feature: GYAE6OF02I6Z05.22.5.A05.1.454.CMB.1.raw
  modified_base (651)..(651): a, c, t, g, unknown or other
  misc_feature (651)..(651): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccacggagaagttgtgttgacacagtctccagccaccctgtctttgtctccaggggaaagagccaccctctcctgcagggccagtcagagtgttaactactacttagccttaggtaccaacgagaaacctggaccaggctcccgaggctcctcatctatgatcgcaatcgttacacgggaccaccgtggacctatccccgaagcccgaagggtttccaaggttcgggcctaaggggttcgggtccgttgggggaactacggtacctttacgacctcttacctaaaccaagttcccaaggtacccacgggacccttaggaaaccggtccctaaggtaaagttaacgtttttcggactttaaggtttaacttaacgttcggtacttaacggcgtacggtacggtacctacgttaaaccctccgttaccggtaacggtttcggacgggaacggtaccctaaggggtacaaggtactaacggaaagtaccgttggaccggacgttacgaccaccgttaanccggtttacgtcctttaacgctcccgtttaacccgcaattccgg

SEQ ID NO: 27729 - DNA, 499 bp, Homo sapiens
  misc_feature: GYAE6OF02FKYB0.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagccccaggaaaggccctagactggcttgcactcatttattggaatgatgataagcgctacagcccatctctgaagagcagactcaacatcaccaaggacaacctaccaaaaagcaagtggtccttacaatagaccaacatggaccctttggacacagccacatattactgtgcacaccacaggtctctactgctgcttcatacactgtcgaccgtgggccacgggacctggcagcgtctcctcagcctacccg

SEQ ID NO: 27730 - DNA, 685 bp, Homo sapiens
  misc_feature: GYAE6OF02H8EFT.22.5.A05.1.454.CMB.1.raw
  modified_base (142)..(142): a, c, t, g, unknown or other
  misc_feature (142)..(142): n is a, c, g, or t
  modified_base (194)..(194): a, c, t, g, unknown or other
  misc_feature (194)..(194): n is a, c, g, or t
tcagacatacgcgtcacgaccggtgctcgatttagatagatagacagggggaggaactgctcagttaggacccagagggaaccatggaagccccagctcagcttctcttcctctgctactctggctcccagaaccaccgganaagttgtgttgacacagtctccagccaccctgtccttgtctccgaggggaangtcccacctctcctgaccagggtccagtcagagtgttaactactacttagcctggtaccaacagaaacctggccaggcctacccaggctcctcatcttagcatgcatcttacgaggccactggcctaactcccaaggcccaagggtttccaggtcggacctagggttcggtacgtgggaccagtaccttcaacttcacccacactcaacgtcaaggtcccaagagtcccgtagtaaccgtagttttgaccgttagttttaacgttaactttcgtacgttaacgtaccgaagtcggtaatccgtaaacctcccgttactaccgggtttaccggaccgggtacgggaacccggtaacgggtagggtaacggtaacgtaccgtaaaaccgttaaccgacgggtttacggacggttacgaccggtaacccgtaagttcccgttacggtttaccgtttcctaacgtttcccggttacccctcgtaccgtttaaccg

SEQ ID NO: 27731 - DNA, 554 bp, Homo sapiens
  misc_feature: GYAE6OF02FS2SG.22.5.A05.1.454.CMB.1.raw
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggcctcccaggctcctcatctatgatgcatcttacagggccatggcatcccagccaggttcagtggcagtggggtctggggacagacttcactctcactatcagcagcctagacgcctagaagtattttgctagtttattactgtcagcagcgtagctaacctccctcgtacggttcgggtaggacgggaaccgaagggtgggaagagtacgaaaacgtacgtggtaggcgtacgaccaccagttcctcggttcttcgtacttcccgttccccgacctacttaccg

SEQ ID NO: 27732 - DNA, 559 bp, Homo sapiens
  misc_feature: GYAE6OF02HO5W2.22.5.A05.1.454.CMB.1.raw
  modified_base (313)..(313): a, c, t, g, unknown or other
  misc_feature (313)..(313): n is a, c, g, or t
  modified_base (480)..(480): a, c, t, g, unknown or other
  misc_feature (480)..(480): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcacacttatggagtggtgtgggctggatccgtcacgccccaggaaacgccctagactggcttgcactcatttatggatgatgataagcgactacagcccatctntagaagagcagactacaacatcaccaaggacacctaacaaaaagcaaagtcggtaccttaacaatacgaaccaacagtacggaccctttaggactaacgacgccaacaataatttacgtcgttacgaccaacaaccacgacgggtctacgtactgcgttcgtctttnacgtacacttggtccgtaacccggtgggaccgtacgggaaccctggtacacggtccgttctccgtcacgtccctacccg

SEQ ID NO: 27733 - DNA, 515 bp, Homo sapiens
  misc_feature: GYAE6OF02FTYVZ.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaaggccctagaatggcttgcactcatttattggaatgatgataagcgctacagcccatctctgaagagcagactcaacatcaccaaggacacctacaaaaagcaagtggtccttaacaatgaaccaacatcgacctttggactacacgacacattatactgtgcacaccacaggtctctactgctgcttcagtacacgtgttacgaccgtgggaccgacgggtaccctggtacgagccgtcctcctcacgtcctacccg

SEQ ID NO: 27734 - DNA, 658 bp, Homo sapiens
  misc_feature: GYAE6OF02HHZTQ.22.5.A05.1.454.CMB.1.raw
  modified_base (168)..(168): a, c, t, g, unknown or other
  misc_feature (168)..(168): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccanacagaccctcacgctgacctgcaccttctctgggttctcactcaccacttatggagtgggtgtgggctggatccgtcacgccccaggaaacggcctagactggcttgcactcatttatggaatgatgataagcgactacacgcccatctctagaagagcagactacaacactaccaaccgaaagaccaacctaccaaaaagcaaaggtcggtaccttaacaatcgaaccaactaacgtaccggtaacccgttttaggaaccaacgacgacccaactaacttaacttacgttacgtcgacctaaccaaccgaacgtacgggtccttaccgtaccgtggtaccgttcggttacctttacgtaacgttaacccgtaacggttccggtttaacccggaacccggttacgggggaccccgtaaccgggggtaaccccgttacgggtaccgtacggtccggtcccgttccgtacccgtaccggtcccctaacccgg

SEQ ID NO: 27735 - DNA, 517 bp, Homo sapiens
  misc_feature: GYAE6OF02GKN6T.22.5.A05.1.454.CMB.1.raw
  modified_base (376)..(376): a, c, t, g, unknown or other
  misc_feature (376)..(376): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaaggccctagactggcttgcactcatttattggaatgatgataagcgctacagcccatctctgaagagcagactcaacatcaccaagacacctacaaaaagcaagtgtaccttacaatanacaacataggacccttggacacacgccacatacttactgtgcacaccacagggtctctactgctgtcttcagtacactggttaccgacccgtcgggaccacgggaacccgtcggtcgacgcgtctcctctacgcctacccg

SEQ ID NO: 27736 - DNA, 624 bp, Homo sapiens
  misc_feature: GYAE6OF02IQECQ.22.5.A05.1.454.CMB.1.raw
  modified_base (293)..(293): a, c, t, g, unknown or other
  misc_feature (293)..(293): n is a, c, g, or t
  modified_base (307)..(307): a, c, t, g, unknown or other
  misc_feature (307)..(307): n is a, c, g, or t
  modified_base (315)..(315): a, c, t, g, unknown or other
  misc_feature (315)..(315): n is a, c, g, or t
  modified_base (330)..(330): a, c, t, g, unknown or other
  misc_feature (330)..(330): n is a, c, g, or t
  modified_base (359)..(359): a, c, t, g, unknown or other
  misc_feature (359)..(359): n is a, c, g, or t
tcagacatacgcgtcacgaccggtgctcgatttagatagatagacagggggacgtcctgtgccccaccatggacacactttgctccacgctcctgctgctgaccatcccttcatgggtcttgtcccagatcaccttgaaggagtctggtcctacgctgatgaaacccacacagaccctcacgctgacctgcaccttctctgggttctcactcaccacttatggagtgggtgtgggctggatccgtcagccccaggaaaggccctagactggcttgcactcattattggaatgntagataagcgctanagccatcnctgaacagcagactnaacatcacaaaggacaacctaccaaaaancaagtcggtactacgaatagaacaaccaataggtacccctttaggaacacgaagacccaacaacttaatttaacctacgtcgaccaacgaacccaacgacggggttacctacgttaacctgtaccgtacgggttcctttaacgtacgtaaccgtaaccgttagggtttacccggaaaacccgttccgggggtacctaaaccgggggaaccccgtttcgggtaccgtaacggtccggttacccttcccgtaccgtacgtacccccg

SEQ ID NO: 27737 - DNA, 592 bp, Homo sapiens
  misc_feature: GYAE6OF02JWWI7.22.5.A05.1.454.CMB.1.raw
  modified_base (576)..(576): a, c, t, g, unknown or other
  misc_feature (576)..(576): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccgaggaaacggccctagactggcttgcactctatttattggaatgatgaataagcgctacacgcccatctctagaacgagcagactacaacactaccaaccgaacggaaccacctaaccaaaaagacgaagtcgtaccttaacaatacgaaccaacagtacggtaccctttacggaactaccgaacgaccaactattacttacgtcgtcgacacaccgacgtacggttcctctacgtgtacgtgttctttacgaacttacgtaccgttcggtaccgaccggttcgggaccgtacgggaccgttggtacacggtcctaccgttccncgaccctacctacccg

SEQ ID NO: 27738 - DNA, 596 bp, Homo sapiens
  misc_feature: GYAE6OF02F6I2K.22.5.A05.1.454.CMB.1.raw
  modified_base (195)..(195): a, c, t, g, unknown or other
  misc_feature (195)..(195): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgctccaggggaaangccaccctctcctgcagggccagtcagagtgttagcaacaacttagcctggtaccagcaggagacctggccaggcctcccaggcctcctcatctatgttgcatccagtccgagggccacgtcggtaccccagccctaggttcaggtggcaggtcgggtctggggaacaggtagtttcacttcgtacaccatccagcacgtcctgctagtctaggaagttgtttagcttagtttattacgtgtcagtactagttaattaattacgtcggtaccgttacggtacggttacggaccgaacgggtaccgaagggtacggaaacgtaccgaaacgtacgtaggtacggcgtagaccgtaacctagttccgtacgttcttaccgtacttacccgttcccgtactacg

SEQ ID NO: 27739 - DNA, 569 bp, Homo sapiens
  misc_feature: GYAE6OF02G2H9F.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtggggctgggatccgtcacgccccaggaaacggccctagactggcttgcactctatttatggaatgatgataagcgctacagccatctctgaagagcagactacaacataccaacaacggacaacctaaccaaaaacgcaaaggtggtaccctttaacaactacgaacccaactaacgttacggtaaccctttacggaacaaccgacgacccaactaattaacttactgtcgaccaccaaccaacgacgggtctctactcgctgtcttcagttacacgttgtaccgaccgtcgggaccacgggaaccctggtcgacgccgtctcctacgcgcctacccg

SEQ ID NO: 27740 - DNA, 548 bp, Homo sapiens
  misc_feature: GYAE6OF02GQFLT.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaaggccctagactggcttgcactcatttattggaatgatgataagcgctacagcccatctctgaagagcagactacaacatcaccaaggacaacctaccaaaaagcaagtcggtaccttaacaatcgaaccaacatcggaccctttggacacacgccacatattactgtgcacaccacaggtctactactgctggtctttcgagtaccaacttcggttaccgaacccggtggggacccacggggtaacccctggtaccgacggtccgttcctcctcgacgtccctaaccccg

SEQ ID NO: 27741 - DNA, 537 bp, Homo sapiens
  misc_feature: GYAE6OF02HHYGR.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaaggccctagactggcttgcactcatttattgaatgatgataagcgctacagcccatctctgaagagcagactcaacatacaccaaggacacctaccaaaaagcaagtggtaccttacaatacgaccaacagttcggaccctttaggacacagaccaacatacttactgtgcacaccacacggtctctactcgctgtctttcagttacactggttctaacccggtcgggaccgacgggtaacccttggaccgtacgccgtctccgtcctacgccctacccg

SEQ ID NO: 27742 - DNA, 679 bp, Homo sapiens
  misc_feature: GYAE6OF02GJRQ8.22.5.A05.1.454.CMB.1.raw
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaagagccaccctctcctgcagggccagtcagagtgttaactactacttagcctggtaccaacagaaacctggccaggctcccaggcctcctcatctatgatgcattcttacgagggcccacgtggccactccccgacgcccgtaggttccaggtcggcgtaggtcggggtctaggggacagtacctttcgacctcgtaccacctatccagccgacgtcctagacgtaccgtagtaacgttagttttcgacttaagttttacttacgttgtaccgtagacgtacgtacgtacgacctaacctcccgtaccgtaccggttaccgggaccgggtacgggacccggtaagggtacgggaacgtaaacgtaaccgaaacggtacgttacgggtacggtaccgtacggacccgtacccgtaacgttaccgttacgtttacccgtttcctaacccgtttcccgtttacccccggtaccttaccgttacccgg

SEQ ID NO: 27743 - DNA, 779 bp, Homo sapiens
  misc_feature: GYAE6OF02ITPSP.22.5.A05.1.454.CMB.1.raw
  modified_base (199)..(199): a, c, t, g, unknown or other
  misc_feature (199)..(199): n is a, c, g, or t
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
tcagacatacgcgtcacgaccggtgctcgatttagatagatagacagggggaggaactgctcagttaggacccagagggaaccatggaagccccagctcagcttctcttcctcctgcctactctggcctcccagaaaccaccggagaagttgtgttgacacagtctccagccaccctgtctttgtctccgaggggaaancgccaccctctcctgcagggccagtcagagtagttaactacttacttacgccttaggtacccaacgaagaaacccgtggacccaggcctacccgaggcctcctcatctatgntgctatctacgngggccacgtgcactcccagtccgtaggttcaggttcggactagggttcgggtacgtaggggaacctacggtacctttacgaccttcctaccaaccctaagtccgaacggccgtacgtaacccgtaggtaccgtacccgttaagtaaacgttacgtttttacgtacgtttaacgttttaactttacgttacgttaccgtaacgtccggtaacggtaccggtaacgtaccctaacccgtccccgttacgttaccgggtttaccggggaccgggtaaacggggtaacccggttaaggggtaacggtaaaccgtaacggttaaacccgtaaaccgggtaaccgttacgggttacggtaccgtaccggtaacccgtaacgtaaccgttacccgtttacggtttaccctttaccgttaacccgtttccccgtttaacccccggtacgttacccgttaccggg

SEQ ID NO: 27744 - DNA, 700 bp, Homo sapiens
  misc_feature: GYAE6OF02H23YY.22.5.A05.1.454.CMB.1.raw
  modified_base (220)..(220): a, c, t, g, unknown or other
  misc_feature (220)..(220): n is a, c, g, or t
  modified_base (326)..(326): a, c, t, g, unknown or other
  misc_feature (326)..(326): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttanggagtggggtgtggggctggatccgtcacgccccaggaacggccctagactggcttgcactctatttattggaatgatgataagcgctacacgccatctctgaagngacacgactactaacactacaaccgtaaaggaccaaaccctaccgaaaaaaagtacctaaaggttccggtaccctttaactaaacgtttacgaaacccaaactacgtaacggtacccgtttacgggaaccaacacggacccaactaacttaacttttaacgttcgttacgaccaaccaaccgtaacgtaaccggggttacttaccttaccgtcgtaccgttcgttcctttaacgtacgttaaccgtaaccgtttacgggtttacccggaaacccgggttcggggaacccggtaaaccggggtaaccccggttacggtacccgtacggtcccggtttacccgttcccctacgtacccgttacccctaacccccgg

SEQ ID NO: 27745 - DNA, 575 bp, Homo sapiens
  misc_feature: GYAE6OF02I6F2T.22.5.A05.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (253)..(253): a, c, t, g, unknown or other
  misc_feature (253)..(253): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgctccaggggaaangccaccctntcctgcagggccagtcagagtgttaactactacttagcctggtaccaanagaaacctggccaggctcccaggcctcctcatctatgatgcatcttacagggccactggcatcccagccaggttcagtgcaggtggtctgggacagcttcactctcacatcagcagcctagacgcctagaagtagttttgcttagtttattactgtacagcagcgtagcaactccctacgacgttcgggacggacgggaaccgtaagggtcggaagtacgtaaccgaaacgtaaccgtggtacggtaccgtggaccctaaccgtagttaccgttacgttactttacccgtaatttccccgttacccgaccgttacttaccgg

SEQ ID NO: 27746 - DNA, 537 bp, Homo sapiens
  misc_feature: GYAE6OF02HG3D5.22.5.A05.1.454.CMB.1.raw
  modified_base (456)..(456): a, c, t, g, unknown or other
  misc_feature (456)..(456): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaaggccctagactggcttgcactcatttattggaatgatgataagcgctacagcccatctctgaagacgcagtacctacaacatccaaccaaggacaacctaccaaaaagcaaagtcggtaccttaacaatcgaaccaacagtcggaccctttggacacacgccacattattactgtgcacaccacacggtctctacgtncgtgtctttcagtacctaacgtcgtaccgaccgtggggacctacgggaccctggacgtacgcgtctcctcacgcctacccg

SEQ ID NO: 27747 - DNA, 730 bp, Homo sapiens
  misc_feature: GYAE6OF02IXAKF.22.5.A05.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
tcagacatacgcgtcacgaccggtgctcgatttagatagatagacaggggggaggaactgctcagttaggacccagagggaaccatggaagccccagctcagcttctcttcctcctgctactctggctcccagaaaccaccggagaagttgtgttgacacagtctccagccaccctgtctttgtctccgaggggaangccacccgtctcctgcagggccagtcagagtnttaactactacttagcctggtaccaacacgaaacctggccaggcctaccaggcctacctcattctatgatcgctacttaccgttacgacgggtcctaacgtgggacctaaccgtccccaaggtcccgtaacgggtttacaccgggttggtaccgtagggttcgggggtccgtgggggaaacctacgggttacctttccgaccttctcctaaccccgaatcccgaacgaccgtaacgtacccgtaggtaaccgtacccggttaaggtaacgttacgtttttacggtacgtttaggttttaactttaaccgttcggttaacctaggtacgtaccgtacgtacggtaaccctacctaccccgttcgtaccgggttccggacggggtaacggacgggtaaggtcgggaacggtacgtaacgtaaacgtacggttcgacggtcgtacggacccaacgtacttcgtttacgttcgttacctccgttcccgtcccgtctaccgtaccg

SEQ ID NO: 27748 - DNA, 863 bp, Homo sapiens
  misc_feature: GYAE6OF02I9TCX.22.5.A05.1.454.CMB.1.raw
  modified_base (143)..(143): a, c, t, g, unknown or other
  misc_feature (143)..(143): n is a, c, g, or t
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
tcagacatacgcgtcacgaccggtgctcgatttagatagatagacagggggacgtcctgtgccccaccgatggacacactttgctccacgctcctgctgctgaccatcccttcactggtcttgtcccagatcaccttgaaggngtctggtcctacgctggtcgaaacccacacagaccctcacgcctgacctgccaccttcnctgggttctcactccaccgtacttacgnggacgttgggtcgtagggcttacgggaacttcccgtacgtacggacccccgaagggaaaccggtcccgtaggaccgtcggtaccgtttcggacctaacttccgtaagttttacgtacgggaaacttggaaccgttggtaagttaaacggccgtaccgtaaccgtacggcccctaattccgtagtaggaaacgtcgacgacgtacctacaaactacgtaccgaaaccgtaaggaccctaaccgtaaccgaaaaaagccgtaacgtacggttaacccttaaacacgttacgaaccctaaacgtacgtaccggtaacccgttaggaacctaacgacgacctaacgtacttaaacgttacgtacggttaccaaccgtaaccgtaaccgtaaaccgggttacgggtttaaccctaccgttacggttaccggtaccgtttacgggtaacccttttacggtaacccgttaaacggttaacccggttacggggtttaaccccggtaaaacccggggttccgggggtaaccccggtaaccggggtttaacccccggttcgggttaacccgggtacccgttacccggtttaccccggttaccccttacccgggttaaccccgtccccccttaaaccccggggg

SEQ ID NO: 27749 - DNA, 581 bp, Homo sapiens
  misc_feature: GYAE6OF02GXA7S.22.5.A05.1.454.CMB.1.raw
  modified_base (196)..(196): a, c, t, g, unknown or other
  misc_feature (196)..(196): n is a, c, g, or t
  modified_base (394)..(394): a, c, t, g, unknown or other
  misc_feature (394)..(394): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaacagaaacctggccaggcctcccaggcctcctcatctatgatgcatcttacagggccagtggcactcccagcctaggttcaggtggcaggtgggtctgggacagacttcactctcacatcagcagcctagcgctagaagtntttagacttagtttatacgtgtcagtacgtagtcgtacgacctacctccctcgtacggttccgggacgggtacgggaaccgtaagggtggacgtactaacgaaacgtacgtaggtcggtacgtcggacctaccgtacttccgttacgttaccttacgtaccttcccgtaccccgtactacttaccgg

SEQ ID NO: 27750 - DNA, 670 bp, Homo sapiens
  misc_feature: GYAE6OF02I9DCK.22.5.A05.1.454.CMB.1.raw
  modified_base (141)..(141): a, c, t, g, unknown or other
  misc_feature (141)..(141): n is a, c, g, or t
  modified_base (284)..(284): a, c, t, g, unknown or other
  misc_feature (284)..(284): n is a, c, g, or t
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggntctggtcctacgctggtcgaaacccacacagaccctcacgctgacctgctaccttctcgtgggttctcactcaccacttagtggagtgggtgtgggctggatccgtcacggccccgaaggaacgcctagacgtggctgcactntattatgatgataganagcactacgcncctatctgtagaagacgtcgaagtacctaccaaactaactaccaaccggaagaacccaccgtaaaccaaaaacggtcgaacggttacggttaccctttaacgaacgtaaccgtaaaccaacgtaacgtaccgggtaacccgtttacgaaccgacgtaacgacccaacttagttacttacgttacgccgtaactaccgaccctaagtaccgggttaccttaccgttaatcgtacgttccgttacgttacgttaacgtaacgttacggttacggttacccgggacccggttcggggaacccgttacgggaacccgtccgtacgtacgtcgtaccgtccgtaaccgccgtaccctaacccgg

SEQ ID NO: 27751 - DNA, 581 bp, Homo sapiens
  misc_feature: GYAE6OF02GQ0PY.22.5.A05.1.454.CMB.1.raw
  modified_base (434)..(434): a, c, t, g, unknown or other
  misc_feature (434)..(434): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcaccacttatggagtgggtgtgggctggatccgtcacgccccgaggaaaggccctagactggcttgcactcatttattgaatgatgataagcgctacagcccatctctgaagagcagactcgaacatccacaaggacacctaccaaaaagcaagtggtaccttaacaagtacgaaccaacatacggtaccctttggacctacacgccaacattaacttacgtgtncaccaccacgagggtcctacgtactgcgtgtctttcgacgtacctaacgtcggttacgaacccggttggggacccgtaacggggtaaccccttacggtccgtacggtcccgttccgttaccctaccgtaccgtccccgttaaccccg

SEQ ID NO: 27752 - DNA, 644 bp, Homo sapiens
  misc_feature: GYAE6OF02GVLBD.22.5.A05.1.454.CMB.1.raw
tcagacatacgcgtcacgaccggtgctcgatttagatagatagacgagggggactcctgtgccccaccatggaccacactttgctccacgctcctgctgctgaccatcccttcatgggtcttgtcccagatcaccttgaaggagtctggtcctacgcctggtacgaaacccacacacgaccctcacgctgacctgcaccttctcgtggttctcactcaccacttatggtagtgggtgtgggctggactccgtcgacgccccgaaggaacggcctagactggtcttgctactctatttattaggaatgatagatagcgctacacgaccctatcctacgttagaagacgacgaactactaccaacaactaccaaccgaaacgtaccaacctaaaccgaaaaacgtaccgtaaggttacgttaacctttaaagaacgtaccgtaaccaaactacgtacgttaccccgttagtaaccagtacgacctactaattacgtacttacgtcgacacctaccgacggtacgtcttacgcctagtcgttgtacctttagactaacgtacgttaccggtaccgtaccgggtacggaccgtaaccggtaccgtacgttacgcgttaccgtcctcccgtcacccggtcctaacccgg

SEQ ID NO: 27753 - DNA, 521 bp, Homo sapiens
  misc_feature: GYAE6OF02GBF4L.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaaggccctagactggacttgcactcatttactggaatgatgataagcgctacacgcccatctctgaagagcagactcaacatcaccaagacacctacaaaaagcaaaggtcgtaccttaacaatgaaccacatcggtaccctttgacacagccacatatactgtgcacaccacaggtctctactgcttggtccttcagtacacgtcgttaccgaccgtgggacctaggggaccctgccgagtcgtcctcctcgacgccctacccg

SEQ ID NO: 27754 - DNA, 678 bp, Homo sapiens
  misc_feature: GYAE6OF02GNWIG.22.5.A05.1.454.CMB.1.raw
  modified_base (141)..(141): a, c, t, g, unknown or other
  misc_feature (141)..(141): n is a, c, g, or t
  modified_base (221)..(221): a, c, t, g, unknown or other
  misc_feature (221)..(221): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggngtctggtcctacgctggtgaaacccacacagaccctcacgctgacctgccaccttctctgggttctcactcaccacttanggagtgggtgtgggctgggactccgtcacgccccaggaaacgcctagctggcttgcactctatttatggaatgatgataagcgactacacgcccatctctagaagacgacagactacaaacataccaacgaaacggaccaaccctaaccaaaaagctaaacggttcggtaccttaacgaactacgaacccaaacgtacgtacggttaacccgtttacggacctaaccgacgacccaacgtaacttaattaccgtagtacgaccaaccaacccgtaccgtacggggttaccttaccgttaccgtacggttccgttacggttcctttaacgtaaccgtaaccgttaaacgttaccgggttacccggtaaccccgggtcgggtaacccggtaaccggggtaacccgttcgggtaccgtaccggtccgttccgtccctaccggtacccgcccctaacccgg

SEQ ID NO: 27755 - DNA, 688 bp, Homo sapiens
  misc_feature: GYAE6OF02I4EF5.22.5.A05.1.454.CMB.1.raw
  modified_base (360)..(360): a, c, t, g, unknown or other
  misc_feature (360)..(360): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaagagccaccctctcctgcagggccagtcagagtgttaactactacttagcctacggtaaccaacacgtaaacctggaccgaggcctccgaggcctcctcactctatgatgcattctacgacggcctaacgtcggcactcccacgcctacggttcaggtcggtcgngggttcggggtcgtagggaccgacgtaccgttccaccgttcgtaccgacctatccgacgtccacggtacccgtagacgaccgtacgtaacgttagttttacgtacgtttaacgttttacgttacgttcgttacgtacgtacgacgtcgtacgacctaaccgtacccgttaccgaccggtttttttaccgggacgggtaacgggtacggtaacgggttacggtaaggtaacgtaacgaaccgtaacgttacggtacggtaccgtacgtacctaccgtacgttccgtacgttcgttaccgtacgttcccgttcccgtccttacgttaccg

SEQ ID NO: 27756 - DNA, 622 bp, Homo sapiens
  misc_feature: GYAE6OF02IMC0V.22.5.A05.1.454.CMB.1.raw
  modified_base (111)..(111): a, c, t, g, unknown or other
  misc_feature (111)..(111): n is a, c, g, or t
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
  modified_base (472)..(472): a, c, t, g, unknown or other
  misc_feature (472)..(472): n is a, c, g, or t
  modified_base (597)..(597): a, c, t, g, unknown or other
  misc_feature (597)..(597): n is a, c, g, or t
tcagacatacgcgtcacgaccggtgctcgatttagatagatagacagggggactcctgtgccccaccatggacacactttgctccacgctcctgctgctgaccatcccttnatgggtcttgtcccagatcaccttgaaggagtctggtcctagctggtcaaacccacacacgaccctcacgctgacctgcaccttctcgtggttcncactcacctacttatggaggtgggtggnggtctgggtatccggacaccgcccccgtaaggaaaccgccgacgtacgtggccttgacctactctatttagtaggaatagtactgactaagcactacagcccatctcgtagaagacgnagtacctanaactanaccaaccgaggtaaccaacctaaacgaaaancgtaacgtcgtaacctanaancgaacaacacgttcgaccgtttagaaccacgtacacgataacgttaattcgangtaacccactaacacgttacggacctttacacggttaccgtcgtacgttaccttaacgaacgttaacgtacgtacggaccgtaccggaccgggaccgtacgaaccggtttcgacgtactcccgtntaccggtaccaccttccgtaacccg

SEQ ID NO: 27757 - DNA, 683 bp, Homo sapiens
  misc_feature: GYAE6OF02J006U.22.5.A05.1.454.CMB.1.raw
  modified_base (346)..(346): a, c, t, g, unknown or other
  misc_feature (346)..(346): n is a, c, g, or t
tcagacatacgcgtcacgaccggtgctcgatttagatagatagacagggggactccgtgtgccccaccatggacacactttgctccacgctccctgctgctgaccatcccttcatgggtcttgtcccagactcaccttgaagggagtctggtcctacgctggtgaaacccacacagaccctcacgctgacctgcaccttcgtcgtgggttctcactcacctacttagtggagtgggtgtgggctggactccgtcacgtccccgaggaacggccctagactggcttgcactctatttagtgaatcgatgaatacgcgtactacacgccctatctactgaagtagcanacgtacaactacgtaccaacgacggaaccacctaacgaaaagtcaacggttacggtacctttaacacgtacgaacctaaacgtacgttacgggtaacccttaggaacctacgaacgtaccaactacgttaacttactcgtaccacgtaccctaaccgtactcgggttacctaccgttacgttcggtaccgttcgttaacccgttacgtaaccgttaaccgtacggttaccggttaacccggttaccgggccgggtaacccgtaaccgggtaacccggtcggtacggtaccggtcccgttacccgtcccgttacggacccgtccccgttaaaccccgg

SEQ ID NO: 27758 - DNA, 600 bp, Homo sapiens
  misc_feature: GYAE6OF02GJAP6.22.5.A05.1.454.CMB.1.raw
  modified_base (144)..(144): a, c, t, g, unknown or other
  misc_feature (144)..(144): n is a, c, g, or t
  modified_base (172)..(172): a, c, t, g, unknown or other
  misc_feature (172)..(172): n is a, c, g, or t
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
  modified_base (336)..(336): a, c, t, g, unknown or other
  misc_feature (336)..(336): n is a, c, g, or t
  modified_base (408)..(408): a, c, t, g, unknown or other
  misc_feature (408)..(408): n is a, c, g, or t
tcagacatacgcgtcacgaccggtgctcgatttagatagatagacagggggacgtccgtgtgccccaccactggacacacttgctccacgctcctgctgctgaccatcccttcagtgggtcttgtcccagatcaccttgaaggngtctggtcctacggctggtcgaaacccnacagccctcacgctgacctgctaccttctggtggttctaccactcacctatttagnggtagtgggtgtcgggntaggactccgtcacgccccgaaggaagcctagctgcttgcactntattagtggaatngtnagtancgctatacgccagtctcaggtaaacngacaacgtctaacgaacctagacccaacgaagaacctaccaaaccgaaaaagccgaaagtgttaaccctaanaactacgtaacactacgtacgtacctacgactacgacacactagtatacgtatcgctacaccacgaggtctacgtactgtaccgtagtcttacgtagtaccgtacgttacggttaccaaccgggtccggaccggtaccggacccgttacggtaccgtacgtccggtaccgccgtaacgtccgccggtaaccc

SEQ ID NO: 27759 - DNA, 640 bp, Homo sapiens
  misc_feature: GYAE6OF02FHBUB.22.5.A05.1.454.CMB.1.raw
  modified_base (327)..(327): a, c, t, g, unknown or other
  misc_feature (327)..(327): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtggggtgtgggctggactccggtcacgccccgaggaacgccctagactggcttgcactcatttatgaatgatagataagcgactacagcccatctactgaagnacagactcaacatcaccaaggacacctacaaaaagcaagtcgtaccttaacaactacgaaccaactactcggtaccctttaggacctacgaacgacccactacttaacttactgtacgacctaaccacccgtaaccgtacggggtccttaccgtaacgttcgttaccgttacggtaccttttaacgaccgtttaacctaaccgttcggtaacccgacccggttaccgggggaccgtaaccggggttaacccgttcgggtacctacgggtcccgttaccgttaccccgtaccgtaccgtaccccgtaaccccgg

SEQ ID NO: 27760 - DNA, 749 bp, Homo sapiens
  misc_feature: GYAE6OF02JTNW2.22.5.A05.1.454.CMB.1.raw
  modified_base (180)..(180): a, c, t, g, unknown or other
  misc_feature (180)..(180): n is a, c, g, or t
  modified_base (364)..(364): a, c, t, g, unknown or other
  misc_feature (364)..(364): n is a, c, g, or t
tcagacatacgcgtcacgaccggtgctcgatttagatagatagacaggggacgtccgtgtgcccaccatggacacactttgctccacgctcctgctgctgaccatcccttcagtggtcttgtcccagatcacttgaaggatctggtcctacgctggtcgaaacccacacacgtacccctnaccggtctggaccctgcctaccgttctcgttggtacctccaactcaaccacttagtggaggttgggtactggggaaccttgggacttaccgggtcaccggccccgtaacggaacggcccgtagaccgtcggcgtttggaccacttcgtaactttagttacgggtaaatggtactgtaagttaanacggtctacgacgcccgttaatccttagagtaagacgtctaacggaccttgaaaccttaatcgaaaccaacggaactaacctaaccgaaaaacgctaaggtaccgttaacctaagtaagtaccgaactaacgtaactacggtaacccgttacgtaacgaaccgttacgaacctaacgttaactaacgtttacgtacgtaacgtaccaaccgtaaccgtaaccgaacgggttaccttaaccgttactaccgtcgttaaccgttcgttactaacgttaccgaacgttacgttaccggtaaacccgtcggggtaaccgtaaccggggtaaccgttacggacgtacggttaccgtaccgtacccgttacgacccggtccttaaccccgg

SEQ ID NO: 27761 - DNA, 612 bp, Homo sapiens
  misc_feature: GYAE6OF02G3AS7.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggactccgtcacgccccgaggaacggcctagactggcttgcactctatttatagatgatgataagcgactacacgcccatctctgaagagcagactacaacatccaaccgaagaccaacctacaaaaacgcaagttacggtaccttaacaatacgaaccaactacgtacggtaccctttaggacacgacgacccaactattacttactgtacgaccaacaccgacgtacgggttacctacgtacgtgtcgttcggtacctttacgaacgttaccgtaacgttcggttacccgaacccggttcggggacccgtacgggggtaacccgttcggtaccggacgtccggttcctcccgtacgtaccgtccctaaccccgg

SEQ ID NO: 27762 - DNA, 744 bp, Homo sapiens
  misc_feature: GYAE6OF02GTIZA.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccgaggaacggcccgtagacgtggtcttgcactctatttattaggaatgatgataagcgactacacgcccatctctagaagagcagactacaacactaccaaccgtaacggacctaacccgtaaaccgaaaaacgaccgaaacgggttacggtaaccctttaaaccgaaacgttaccggaaacccaaacggtaacgttaccgggttaaccccgttttacgggaaccctaacggaaccggtacccctaacgtaacgtttactttaaccgttacgttacgaccctaaaccgacccgtaacgtacgggttaccctaccgttacgtcggtaccgttacgggttccttttacgaacgttaaccgtaaccggttccgggttacccggtaaccccgggtgggggtaaccccgtaaccggggtaaccccgtttccgggtaaccgtaccgggttacccgttcccgttacccgttaccggacccgtaccccgtaaacccccggg

SEQ ID NO: 27763 - DNA, 766 bp, Homo sapiens
  misc_feature: GYAE6OF02F41F7.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcacctacttatggagtgggtgtgggctggactccgtcacgccccgaggaaacggccctagactggcttgcactcatttatgaatgatgatagcgctacacgccatctctagaagagcagactacaacactaccaaccgaaacggacctaacccgtaaaccaaaaaacgtaccgaaacggttacggttaaccctttaacgtaacgtacgaaacccgtaaacgtaacgttaccgggtaaccccgttttacggaaaccctaaccgtaaccggacccctaaaccgtaactttaaacttttaccgttacggttaccgtacccgtaaccaacccgtaacccgtaacggggttacccttaccgttaaccgttcggtacccgttgggttacccttttaccgtaaacggttaaccgtaaccggtttaccgggttaccccggtaaaccccgggttccgggggtaaccccggtaaccgggggtaacccccggttacgggttacccgaccggttacccggttaccccgttcccggttacccgtacccggtaccccgtaaaccccccgg

SEQ ID NO: 27764 - DNA, 689 bp, Homo sapiens
  misc_feature: GYAE6OF02HAND6.22.5.A05.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaangccaccctctcctgcagggccagtcagagtgttaactactacttagcctggtaccaanagaaacctggccaggcctccaggctcctcatctatgatgctattctacgacgggccactggcactccccaagcctagggttccaggtcggactagggttgggtacctaggggacacggtactttcaaccttctacaaccctagtaccgaagccaacgtccgtaggacgtccgtagtaaacgttacgttttagtacgttaagttttaacttaacgttacgttactacggtactacggtaccgttaaccgaacgtacggtaccgttaccggttaaccggttttacgggacccgggtaacgggggaacccgtaacgggtaccgttacgggtaacggtacgtaccgtaacggtaccgtaacgttacggtcggtaccggttacgaccgtaccgtacgttcgttacgttaccgttacgtaccttcccgttaccccgtaccg

SEQ ID NO: 27765 - DNA, 588 bp, Homo sapiens
  misc_feature: GYAE6OF02F92FY.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaacggccctagactggcttgcactcatttatggaatgatgataagcgctacagcccatctctgaagagcagactcaacatccaaccaaggaccaacctaaccaaaaacgctaaaggtcggttaccttaactaacgtacgaaccaaactagtaccggtaaccctttgggaaccaacgacgtacccaactacttaattactgttacgaccaaccaaccaacgtacgggttaccttacgtactgctcggtctttacagtacctaagtcgttacgaacccggtgggaccacgggaccctaggtaccagtccgttacctccctcacgtccctacccg

SEQ ID NO: 27766 - DNA, 761 bp, Homo sapiens
  misc_feature: GYAE6OF02IAF72.22.5.A05.1.454.CMB.1.raw
  modified_base (223)..(223): a, c, t, g, unknown or other
  misc_feature (223)..(223): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtacgaacccacacacgaccctcacgctgacctgctaccttctcgtggttctcactcacacttagnggtagtgggtgtggcgtggacgtccgtcacgccccgaggaacggcctagactggtctcgctactactatttagtaggatgatagagtaagcgtactacacgccctatctctagaagtacgacgacgactaccaactacgtacgaaaccgtaaacggaccaaaccgtaaccgaaaaacgacgtaaacggttacggttaacctttaacaacgtaccgaaccctaaaccgtacgttaccgggtacccgttaaggaactacccgaacgtaaccctaacttaactttaacgtttaccgttagtccgtaacctacgaaccccgtaacggttaaccgggttacccttaccttaaccgttcgtaccggtttacggttccctttaaacggaaccgtttaaaccgtaccgggttacccgggtttaacccggtaccccgggtaccgggggtaaccccggttaaccggggttaaccccgttcgggttaaccgaccggttcccggttacccgttacccggtacccgtaccccggtacccctaacccccggg

SEQ ID NO: 27767 - DNA, 727 bp, Homo sapiens
  misc_feature: GYAE6OF02IDPF7.22.5.A05.1.454.CMB.1.raw
  modified_base (198)..(198): a, c, t, g, unknown or other
  misc_feature (198)..(198): n is a, c, g, or t
  modified_base (230)..(230): a, c, t, g, unknown or other
  misc_feature (230)..(230): n is a, c, g, or t
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagcccaccctgtctttgtctccgaggggaaangcccaccctctcctgcagggccagtcagagtnttaactactattagcctggtaccaacagaacctggaccnggcctccaggcctcctnatctatgatgactattcttacgaggccacgtggccactcccgacgtccaggtttcacggtggactagggtggtcgtggggacacggtaccttcacttctaccacctatccagccacgtccgtaagaccgtcgtaggtaaagttacgtttcgtacgtttaggttttaacttacgttacggttacaacggtcgtaggtaccgttaacgtaccctaaccgttaccccgttacggtaaccccgggtttcggggtaaccgggtaacgggggtaacccgtaagggggttaacgggtaacggaaccgttaaaccgggtaaaaccgtacggttacgggtaacggtacccgtacggaacccgtaacccgtaaccggtttaccgtttacggtttaccgttacccgttaccgtttacccccggtttaccccgtacccgtacgtttaccccgg

SEQ ID NO: 27768 - DNA, 770 bp, Homo sapiens
  misc_feature: GYAE6OF02GVWKQ.22.5.A05.1.454.CMB.1.raw
  modified_base (760)..(760): a, c, t, g, unknown or other
  misc_feature (760)..(760): n is a, c, g, or t
tcagacatacgcgtcacgaccggtgctcgatttagatagatagacagggggactcctgtgcccaccatggacacactttgctccacgctcctgctgctgaccatcccttcatgggtcttgtcccagatcaccttgaaggagtctggtcctacgctggtacgaaacccacacagaccctcacgctgacctgcctaccttctcgttggttctcactcacctacttacgtggtaggtgggtggtcgggtcgtaggacgtccggtacaccgccccgaacggaaacggtcccgtagaacgtcggtcgtcgccgacgtaccttacttttaacttaggtaattagtacgtaggtaaagttaacggaccgtacgtaacgaaccgtcccgaacttaccttcgttacggaaacggtaacgacggtaacgtaaccgtaacctaaacaacctaccgtaaaccgaaaaccgggaacctaaacccgtaaaccgaaaaaaccggactaaacgggttaccgtttaacccgttaactaaaccgtacgaaacccaacgtaacgtaaccggtaacccgtttacggaaacacccgaacgaacccgtaactaagtttacttacgttcgtacgaacacctaaccgaacgttacgggtaccttccgtaactcggttacgtacgttaccttacgtaacgttaaccgttacgtacggtaccggtaacccgggtcggggaacccgggtacgtacggtcgacgtccgtcgtccctacgaccgtaccnccgtaaccgg

SEQ ID NO: 27769 - DNA, 754 bp, Homo sapiens
  misc_feature: GYAE6OF02IFCCP.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacggctggtacgaaaccacacacgaccctcacgctgacctgctacctttctcgtgggttctcactccacctacttagtggaggttgggtggtgggctggacttccgtcaccgccccgaaggaacgccgtagacgtgtctgactactctatttcgtaggtaactgaacgtagaagtaacgccgtactacacgacccgtatcgtacgtacgaagacgactaacgacctacgtaaccacgtaccaaacgtaacgaactaaacctaaccgaaaaacgtacgtaaacggttcgttaaacctaacgtaaaccgtaacgtaacccaaaacgttacgttaaccggttaacccgtttaaggaacctaacgtaaccgaacccttaactaacgttaacgtttacggttacgtacgaccctaaaccaacccggtaacgtaaccggttacctaacggtacctacggttaccgttacggttaccttaacgtaaccgttaaccgtaacggttaccggttaacccggtaccgggtaaccggggtaaccgtaacgggtacccgttacgggtacgtaccggtccgttaccctaccgtacccgtaccggtcccgtaacccgg

SEQ ID NO: 27770 - DNA, 726 bp, Homo sapiens
  misc_feature: GYAE6OF02IMEIG.22.5.A05.1.454.CMB.1.raw
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagagaccaccggagaagtttgtgttgacacagttttccagccacctgtctttgtctccaggagagcgggccaccctctcctgcgacgggccaatgacgagttattagaccgaacttactttagccttcggtaccaacagacgcctggccaggctcccaggctcctnatgtancgntgcttaccgaaaagggccaacgtggacctactcccgaagccgtacggtttacgacggttcggacggtaggttgggttctaggggaagtacggtacgtttaccaacgttcccgttaacaacccgtaacttaaccgaaaccgtacgtaccccgtaggtacgtaccgtacggtaaccggtactttccggtacgttacgttaaggttttaactttacgttcggttacgaacggtacgtaacggttaccgtaaacccgggtaaggttccggttacccgttaccggttacggtttttaccgggacccggtacgggggtaaccctaacgggtccgtagggtaacgtacgtacgacgtaaccggtacgtcggttacggctcggtaccaccgtacgttaccttggttaccttactccgttaccgttcccg

SEQ ID NO: 27771 - DNA, 779 bp, Homo sapiens
  misc_feature: GYAE6OF02J1T0T.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagacccctcacgctgacctgccaccttctcgtgggttctccactccaccacttatgggagtgggtcgtgggctggactccgtcacgccccgaggaaacggcctagactggtcttgctactactatttacgttggaactgagtagataaggcgactacacggccctagtctccgtagtaacgagacctacgaactacaaaccgtactaccgaaccgaaacggaaccctaaccctaaaccgtaaaaacgaccgtaaaggttccggtaacctttaacaacgttaccggaaacccgtaaacgtaacgttaccccgggttaacccgtttacgggaaacccgtaaccgtaaccgtacccgtaactaaacgtttaaacgttttaaccggtgggttaaccgtaccaaacccggtaaccctaaacgggttaccgggttaccttaacccttacggtaccgtaccggttcgttaccgtttacgtaaccggtacttaaaccggttccgggttaaccctaaccccggggtacggggtacccggtaacggggtaacccgttcgggtaccgaaccgggttccgttacccgttccggtacccgtaaccccggtcctaacccccgg

SEQ ID NO: 27772 - DNA, 533 bp, Homo sapiens
  misc_feature: GYAE6OF02GCNUQ.22.5.A05.1.454.CMB.1.raw
  modified_base (510)..(510): a, c, t, g, unknown or other
  misc_feature (510)..(510): n is a, c, g, or t
  modified_base (519)..(519): a, c, t, g, unknown or other
  misc_feature (519)..(519): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaggccctagactggcttgcactcatttattggaatgatgataagcgctacagcccatctctgaagagcagactacaacataccaaccaaggacaacctaccaaaaagcaaaggtggtacctacaatacgaaccaacatggtaccctttaggacacagccacatattactgtcgcacaccacgacggtctactctgccgtgtcctttacaagtacacgttgttccgtaaccgtgggacctacgggacctggtacngcctctccnctacgccctacccg

SEQ ID NO: 27773 - DNA, 615 bp, Homo sapiens
  misc_feature: GYAE6OF02G93K2.22.5.A05.1.454.CMB.1.raw
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgtctccgaaggggaaancgccaccctctcctgcagggccagtcagagtagttaactactactagcctggtaaccaacagaaacctggaccaggcctcccgaggctccgtnatctatgatgcatcttacgacggccactcggcactcccgagccgtaggttccaagtcggacgaaggttggggtacctagggggactaacggtacctttacaccgttcgtaccaaccgattccgaagtccacgtaccgtagacgtccgtagtaaagtattttagacttaagtttacttactgtacagtcacgtcgtaagactaacctcctacgtacggttcggacggaacggtacgaagggtgagtacaaccgtaaacgacgtggtacgacgttcgaccacgtactacgtgttacttaccgtcttcccgtacccgtactattaccg

SEQ ID NO: 27774 - DNA, 618 bp, Homo sapiens
  misc_feature: GYAE6OF02IHHI0.22.5.A05.1.454.CMB.1.raw
  modified_base (141)..(141): a, c, t, g, unknown or other
  misc_feature (141)..(141): n is a, c, g, or t
  modified_base (227)..(227): a, c, t, g, unknown or other
  misc_feature (227)..(227): n is a, c, g, or t
  modified_base (333)..(333): a, c, t, g, unknown or other
  misc_feature (333)..(333): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggngtctggtcctacgctggtcgaaaacccacacacgaccctcacgctgacctgcacctttctcgtgggttctcactccacctacttangggagttggggtgtggggctgggacttccggtcaccgccccgaaggaaacggtccctagactgggcttgccactctatttattggaatgatgattaagcgtctacncgccctatctccttagaagagcgatacgtacaacactacaaccaaggtacaaccctaacaaaaaacgctaaggtcgtaaccttacgaatcgaaccaaacacgtcggtaaccctttggaacacgacgcacattacttacgtgtacactacaccacgacggtctcgtactgtcgtcgttcttcgtacgtaaccgacgttccgttaccggacccgtacgggggtaccctaacggggaccctcgggtcctaggtccgtaccgtcccgtaccgtcgtaccccgtacccgg

SEQ ID NO: 27775 - DNA, 687 bp, Homo sapiens
  misc_feature: GYAE6OF02IHHW6.22.5.A05.1.454.CMB.1.raw
  modified_base (112)..(112): a, c, t, g, unknown or other
  misc_feature (112)..(112): n is a, c, g, or t
  modified_base (139)..(139): a, c, t, g, unknown or other
  misc_feature (139)..(139): n is a, c, g, or t
  modified_base (168)..(168): a, c, t, g, unknown or other
  misc_feature (168)..(168): n is a, c, g, or t
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
  modified_base (246)..(246): a, c, t, g, unknown or other
  misc_feature (246)..(246): n is a, c, g, or t
  modified_base (323)..(323): a, c, t, g, unknown or other
  misc_feature (323)..(323): n is a, c, g, or t
tcagacatacgcgtcacgaccggtgctcgatttagatagatagacgagggggactcctgtgccccaccatggacacactttgctccacgctcctgctgctgaccatcccttnatggtcttgtccagatcaccttgaagngtctggtcctacgctggtcgaaaccccanacacgaccctcacgctcgactgctaccttctcgtggttcncactcactattanggagtggtgtggcgtggatcccgtnaccggcccgaggaaacgtccgtagtacgtgtctcgcactcttagtttatagaattgaattgaagtacggtcgactanccgtaccattccgtacgtagaacgagcaacgtaccactaactcgtaaccgaccgaaaggacctaaaccaacgtaaaaacgcgttagttaccgtacctttaagacttacgaaccgtaacgtacgtaaccggtccgttacgaaccgtaccgacgtaccctaagtacttaacttcgtacgttacgaccctacgtaaccacggttacggtaccttcgtacgtcggtacctacgtttaccgtacgtaaccgttaaccgtacgttaccggttaccgtaaccccgggtggaacccggtaaccgggtacccgttaccggtaccgtacggtccgttccctaccggttaccgtaccggtacccgtaaccccggg

SEQ ID NO: 27776 - DNA, 677 bp, Homo sapiens
  misc_feature: GYAE6OF02H861M.22.5.A05.1.454.CMB.1.raw
  modified_base (254)..(254): a, c, t, g, unknown or other
  misc_feature (254)..(254): n is a, c, g, or t
tcagacatacgcgtcacgaccggtgctcgatttagatagatagacagggggactcctgtgccccaccatggacacactttgctccacgctcctgctgctgaccatcccttcagtgggtcttgtcccagatcaccttggaaggagtctggtcctacgctgggtacgaaacccacaacgacgtacccctcacgcctgacctgctaccttctcgttgggttcctacacctacaccgtacttagtggaggtgggtggngggtctggactccgtcgaccgaccccgaagggaaccggcctagtacgtggcttagctactctaatttgtaggtaatgatacgtaatagccgactacaccgcctactctcgtagaagagtacacgactacaaacctcaacaacccgaaacgtacccaaacccgtaacgaaaaacgcctaaacgtcgttaacctacaaacgtaccgaccaaactacgtcccggtaaccgttcggaaacacggacaacctaatacttaagttaccgaggtaccaacctacgaacccagggtaccgttactccgtaacgtcgtagtccgtcttacgtaacgtaacgtaccgtacgggtaccgtaccgggtccgggaaccgtaccggtaaccggtgaccgtacgttccgtacctccgtacctaccggccctaacccgg

SEQ ID NO: 27777 - DNA, 659 bp, Homo sapiens
  misc_feature: GYAE6OF02I1LP7.22.5.A05.1.454.CMB.1.raw
  modified_base (289)..(289): a, c, t, g, unknown or other
  misc_feature (289)..(289): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagactcaccttgaaggagtctggtcctacgctggtcgaaacccacacacgaccctcacgctgacctgcaccttctctggttctcactcaccacttagtggagtcgggtgtgggctggtactccgtcaccgccccgaaggaaacggccctagactggctgcactntattatgaatgatagatagcgactacacgccatctctagaagagcaagactacaactactaccaacaacgaaccaaccctaacgaaaaacgctaaggttcgtaccttaacgaactacgaacctaacacgtacggtacccgttaggacctacgtaacgacctaactaattaactttactacgtcgaaccgtaaccaaccgtaacggtacgggtaccttaaccgtacgtccgtaacgttcgtttaccgttacgttaacgtaaccttaacggttcggttacccgtaacccgggtcggggtaacccgtaacgggtaaccccgtggtacccgtacggttacgttaccctccggtacgaccgtacccgtaaccccg

SEQ ID NO: 27778 - DNA, 795 bp, Homo sapiens
  misc_feature: GYAE6OF02ICUDH.22.5.A05.1.454.CMB.1.raw
  modified_base (141)..(141): a, c, t, g, unknown or other
  misc_feature (141)..(141): n is a, c, g, or t
  modified_base (170)..(170): a, c, t, g, unknown or other
  misc_feature (170)..(170): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggngtctggtcctacgctggtacgaaacccanacacgaccctcacgctacgacctgcctacctttctcgtgggttcctcactccacctacttagtgggtagtgggtcgtgggcgtggactcgcacgccccgaggaacggccctagctcggtcttgcactactattttagtaggtaatgtataggtaataacggccgtactaccgcgtaccctattcctagtagaacgacgactaacgactacacaactaccaaaccgaacggaccaaccctaaacgaaaaacgtccgtaacggttaccgtaaccctttaacgaacgtaccgaaaccgtaaacgtaaccgttaccgggtaaccccgtttaggaaaccgtaaccgaaccggtaaccctaacgttaactttaaaccgtttaaccgtacggttaccgtaacccaaacccgtaacccggtaaccgggttaccgggttaccctttaacccggacgtttaccggtccggttacgtttaccgtttaccgaacgttaaccgttaacccggtttacggttaaccccgggtaccgggtacccggggaacccggtaaaccgggtaacccggtttccgggaccgttcccgggtaccgtttacccgtaccccgtacggtaaccccgtcccgtaaccccggg

SEQ ID NO: 27779 - DNA, 590 bp, Homo sapiens
  misc_feature: GYAE6OF02F0J93.22.5.A05.1.454.CMB.1.raw
  modified_base (328)..(328): a, c, t, g, unknown or other
  misc_feature (328)..(328): n is a, c, g, or t
  modified_base (479)..(479): a, c, t, g, unknown or other
  misc_feature (479)..(479): n is a, c, g, or t
  modified_base (551)..(551): a, c, t, g, unknown or other
  misc_feature (551)..(551): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtggggtgtgggctggatccgtcacgccccaggaaacgccctagactggcttgcactctatttattggaatgatgataagcgctacacgccattctctagaagancagacctacaacataccaaccaacggaccaacctaaccaaaaagctaaagtcggtaccttaacaatacgaacccaacacgtacggtacccttaggaccacacgacccactattaattactcgtcgacaccaccacgtacggtctctacgtntcgttgtctttacagtactacgttcggttaccgaacccggtcgggaccgaacggggtaccctcgggttaccncggtccgttacctcccgtacgtaccgtaccctaccccgg

SEQ ID NO: 27780 - DNA, 679 bp, Homo sapiens
  misc_feature: GYAE6OF02IF99B.22.5.A05.1.454.CMB.1.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
  modified_base (320)..(320): a, c, t, g, unknown or other
  misc_feature (320)..(320): n is a, c, g, or t
tcagacatacgcgtcacgaccggtgctcgatttagatagatagacgagggggaggaactgctcagttaggacccagagggaaccatggaagccccagctcagcttctcttcctcctgctactctggctcccagaaaccaccggagaagttgtgttgacacagtctccagccaccctgtctttgctccaggggaaagngccaccctctcctgccgagggccagtcagacgttgttaactacttacttagccctggtacccaacaagaaacctggaccaggcctacccgaggtcctccctnactctatgatgctatcttacngggccagtggcacgcccagcctaggttcagtcggcagtggtctacggggactacgacttcactcgtacaccaatacgacgccaacgtcccgtagacgtacccgtagaaaccgttatttacgtacgttaagtttactttaacgttcgtacgacgtactacggtaccgtacgtacccgtaaccgttccccttacgtaccggtttaccgggaacgggtaccgggtaaaccggtaacgggtacgggaacgtacggtaaccgaaacgtaacgttcggtaacggtcctggacccgtacctacgtaccgtttaggttaccctttaccgttaccgttaccccttcccgtacccgttacgttacccgg

SEQ ID NO: 27781 - DNA, 658 bp, Homo sapiens
  misc_feature: GYAE6OF02FTAYF.22.5.A05.1.454.CMB.1.raw
tcagacatacgcgtcacgaccggtgctcgatttagatagatagacaggggggactcctgtgccccaccatggacacactttgctccacgctcctgctgctgaccatccccttcatgggtcttgtcccagatcaccttgaaggagtctggtcctacgctggtgaaacccacacagaccctcacgctgacctgcaccttctcgtggttctcactcaccacttatggagtgggtgtgggctggatccgtcacgccccgaaggaacggcctagacgtggcttgcactcattttagttagatgatagataagcgctacacgcccatctcgtagaagagacagacctacaacactaaccaaccgaaacggaccaacccgtaaaccgaaaaaacgacgtaaagttcgggttaaccttaaacgaactaacgaaacccaaacgtacgtaccggtaaccccgtttagggaacctaacctaacgaccctaaacgtacttaagttacgtcgtacgaccaccaacccgtaagtaccgggtactcgtaacgtcgtccgttgtaccttagaacgttaccaccgttacgggtacccgtaacccggtgggacccgaaccggggtacccttaggtaccgacggtccgtcctaccgtaccgtacgaccctaaccccg

SEQ ID NO: 27782 - DNA, 768 bp, Homo sapiens
  misc_feature: GYAE6OF02FR5RB.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcaccacttatggagtgggtgtgggcgtggactccgtcacgccccgaaggaacggccctagactggcttgcactctatttattgaatgatgataagcgactacacgcccaatctacgtagaaacggagacaagtacctacaaactactaccaaaccgtaaacggaacctaaaccctaaaccgaaaaaacgtaccgtaaaggttccggttaaccctttaaacgaaacgttaccgaaaccctaaactaacggttaccgggttaacccctttagggaaaccctaccggaacgaccccgtaaacttaatttaaccgtttacgttcggttacaccctaacccgaacccgtaggtaaccgggttcccttacttaccgttacggtccgtttacgggttacctttacggaaaccgtttaaccggtaaccgttttcggggtaaccccgtaaccccggggtacgggggtaccccgtaaacccgggggttaaccccttcggggtaacctaacccgggtcccgtttacccgttcccggtaacccgtacccgttcccccgtaaaaccccccgg

SEQ ID NO: 27783 - DNA, 740 bp, Homo sapiens
  misc_feature: GYAE6OF02J1KAF.22.5.A05.1.454.CMB.1.raw
  modified_base (724)..(724): a, c, t, g, unknown or other
  misc_feature (724)..(724): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctcgtcgggttctccactcacctacttagtcggtaggtggggtcgtggggcttagggacttccggtcaccgtcccccgaagggaaacggaccctagaccgtggtcttgcctacgtactatttagttaggaatagtatacgtaagtaagccgtactacgacgtaccctatcctacgtaggaacgagaccaagtactacaaactactaaccaaccgaacggaaccctaaaccgttaaaccgaaaaaccggtcctaaacggttacccggtttaacccgtaaacgtaacgttaaccgtaaacccaaacgtaacgttaccgggttaccccgtttaacggaaccaacgttacccgaacctactaaacgtttacttaccgtacgttacgaacctacccaaaccggaaccgttacgggttacctaccgttaacgtcggtaccttcggttactttaccggaacgtacgttaaccgttccgtaccggtaccgggtccggaccgtaccggtaaccgtcgacgtacgtccgccgttaccncggacctcccgtaccg

SEQ ID NO: 27784 - DNA, 637 bp, Homo sapiens
  misc_feature: GYAE6OF02FUSPM.22.5.A05.1.454.CMB.1.raw
  modified_base (61)..(61): a, c, t, g, unknown or other
  misc_feature (61)..(61): n is a, c, g, or t
  modified_base (261)..(261): a, c, t, g, unknown or other
  misc_feature (261)..(261): n is a, c, g, or t
tcagacatacgcgtcacgaccggtgctcgatttagatagatagacaggggggaggaactgntcagttaggacccagagggaaccatggaagccccagctcagcttctcttcctcctgctactctggctcccagaaacccaccggagaagttgtgttagacacagtctccagccaccctgttcttgtctccgagggaagtagccaccctctcctgcgagggccagtccaggagtgttaacctactactagcctggtaccaanacgaacctgacagctccagtctcctctatctatgactgctatctacgagtccactggacactcccgagcctagttcacgtcggcgtaggtggtcgtagggtacacgtacttccactctacgacctatcagcctacgtccgacgtacgtctacgtaactagttttacgcttaacgtttacttactcggtacagtacacgtacgtaccgaccgtacctacccgtacgtaccggtacggaccgggtaacggtaacccggtaagggtacggaacgtacgtaccgtaacgtacgtacgtacgtacggtaccgtccgtaacccgtactccgttaaccgttcgttacctaccgttaccccgttacccgtacctacgttacccg

SEQ ID NO: 27785 - DNA, 698 bp, Homo sapiens
  misc_feature: GYAE6OF02IAORD.22.5.A05.1.454.CMB.1.raw
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgcgtggtacgaaacccacacacgaccctcacgctcgacctgcctaccttctcgttggttcctcacctcacctacttagtggaggtgggtggtggctggctccgtcgaccgccccgaggaaccgccgtagactggctcgctactcttagttatagaagtntatgtaanagcgactacgcgcctatctacgtaggaagacgtacacgaacctaactaactactaaccgaaaccgtaacgaacccaaccgtaaaacaaaaacgtacggtaaacgttccgtaaaccttaacaaacgtaccgaaacctaacgtacgttaccggtaccttacggaacaccgaactacctaactaattaacgttacgtacgaccgaaccgtaaccaacccgaacgtaccggttcctacctacgtccgtacgttccggttacttacgtaaaccgtacgttaaccgtaccggttaccgaccgggtccggtaacccggacgggttaacccgtcggtccgtaccggtccgttccgtacccgtcgtacccggtcccctaaacccggg

SEQ ID NO: 27786 - DNA, 713 bp, Homo sapiens
  misc_feature: GYAE6OF02FOAO4.22.5.A05.1.454.CMB.1.raw
  modified_base (211)..(211): a, c, t, g, unknown or other
  misc_feature (211)..(211): n is a, c, g, or t
  modified_base (227)..(227): a, c, t, g, unknown or other
  misc_feature (227)..(227): n is a, c, g, or t
  modified_base (364)..(364): a, c, t, g, unknown or other
  misc_feature (364)..(364): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaaccccacacacgaccctcacggctgacctgcaccttctctgggttaccncactcaccctacttanggagttgggtgtgggctggactcccgcaccgccccgaaggaaacggccctaaggacgttggacttcggcctacctcgtaacttttacgttaggaataggactagaataagccgactacacgcccagtctactagaanacgacacgtactacaactacacaacccgaaggtacccaaaccttaaccgaaaaacgtccgtaaacggttaccggtacccttaaactaacgtacctaaacccgaactaacggtttacccggtaacccgtttacgggaacctaacccgaacgtccctaaacctagttaacgttaaccgtcgtcggaacccaacccgtaccaccggtaaggttcctaccgtacctacgtccgtttacgtacctttcgaacgttacccacgttacgggtaccccgaaccgggtcggggcctaaacccgggtaccccgtggtaccgtacggtacccgttcgacctcccgacgacccctaacccg

SEQ ID NO: 27787 - DNA, 735 bp, Homo sapiens
  misc_feature: GYAE6OF02ICCW9.22.5.A05.1.454.CMB.1.raw
  modified_base (376)..(376): a, c, t, g, unknown or other
  misc_feature (376)..(376): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtcgaaaccctacacagacccctcaccgctacgacctcgctacccttctcttgggttcctacacctccaaccgtacttagtgggtagtcggggtggtggggcttagggacttccgtaccgaccgaccccgaggaaaccggcctaacggactcgggtcttcgccgtactaccgtattttagttaggaattgacgtgtaagtaagcgtactacgacgcccntacctatacggaatacgacacgactacaactactacaacgaacgtaccaacctaaacaaaacgcgtaagttcgtaaccttaacacgtacgtaaccaacgtaaccgtacggtacccgttagtaaccaacgtacgacctaacgtacttaacgtttcagttaccgacaccaccgtaaggtaccgggttctacccgttacgtacgtcccgttagttcccgttaatacccggttaacgtaaccgttccggttaaccggtacccggttacggggtaaccccggaaccggttacccggttaccggtaccggtaccggttacccgttacccgttcccgaccggttacccggtcccgtaaacccccgg

SEQ ID NO: 27788 - DNA, 712 bp, Homo sapiens
  misc_feature: GYAE6OF02IHNKG.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcaccacttatggagtgggtgtgggctggactccgtcacgccccaggaaacggccctagactggtcttcgctactctacttttagttggaactgaatggtaataaggcgtctaacacgcccattcctactagaagcgacagactacaacactaccaaccaacggacctaaacccgtaaccgaaaaaacgtccgaaacggttccggttaacctttaacgtaacgtacgaaccctaaacgtacgttaccgggtaaccccttttcgggaacccaacgtaccggacccaacgtaactttaacgtttaccgtacgttacgacctaaccaacccgtaacggtacgggttaccttactaaccgtcgtaccgttggttccctttaacgaacgttaaccgtaaggtttccgggttaacccgtacccgggtcgggacccgtaaccgggtaaccccgttacggtaccgtacggtcccggttacccgttccgtaccgtacccgtcccgtaacccgg

SEQ ID NO: 27789 - DNA, 683 bp, Homo sapiens
  misc_feature: GYAE6OF02IRLPU.22.5.A05.1.454.CMB.1.raw
  modified_base (311)..(311): a, c, t, g, unknown or other
  misc_feature (311)..(311): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagaatcaccttgaaggagtctaggtcctacgctggtgaaacccacacagtaccctcacgctgacctgcaccttctctggttctcactcaccacttatggagtgggtgtgggctggatccgtcacgccccaggaaacggccctagactggcttgcacgtctatttatggatgatgataagcgctacncgccatctctgaagtagacacgactacaactactccaacgaaggaccacctaacaaaaacgtcaagtcggtacccttaacgaatacgaacccaaactactacggtaaccctttaggaccaacgtacgaccctaactacttaacttactagtacgtaccacccaacccaacgtacggggttaccttaccgttaacgtccggtccgttacgggttacccttttaccgaaacggttaccgtaaaccgtttccgggttaacccggtaaccccgggtcgggggtaaccccgtaacgggggttaaacccccgttgggttaacccgtacggtccggtttacccgtacccgttacccgtaaccgtccccgtaacccccgg

SEQ ID NO: 27790 - DNA, 866 bp, Homo sapiens
  misc_feature: GYAE6OF02HNYYU.22.5.A05.1.454.CMB.1.raw
  modified_base (198)..(198): a, c, t, g, unknown or other
  misc_feature (198)..(198): n is a, c, g, or t
  modified_base (329)..(329): a, c, t, g, unknown or other
  misc_feature (329)..(329): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccaagaaaccaccggagaagtttgtgttgacacagtctccagccctaccctgtctttgctccgagggaanagcccaccctctcctgcgacgggccagtccgagtagttagttaacctacgttacttagccctaggtaacccaaacgaacgaaacccgtcgggacctaggcccttaccgacggtcctccctactagtcctanacgtctgactattacccttaaccggcgggtaaccctacgtacggtacctaccgtaccccgacgggtacccgttaggttacgaacgggttccggtaaggtccggggttacggggtacgtacggggtaaccaacgtttacccgtttacgacccgttcccgtaacctaaccctattacccgaacgggtacccacgggttacccgtaacggtaaccggtacgttaaccgggtaagtttacgttttacgtaacgttttacgttttaacgttacgttacgttacggaacgtaccgtaagttaccggtaacgtaacccgttaaccccgtttacccggttacccggttaaccgggtaccccggggtaacggggtaaacccgggaaaccgggttacgggttaacggtaaacggtaacgtaaaaccggtaaacggttaccggtacggttaccgggtacgttaccggtaccgttaaccgtaccgttaccggttacggtttaccgtaccttcccgtttacccgtacccccgttagttacccgttaccgg

SEQ ID NO: 27791 - DNA, 747 bp, Homo sapiens
  misc_feature: GYAE6OF02I3OYF.22.5.A05.1.454.CMB.1.raw
tcagacatacgcgtcacgaccggtgctcgatttagatagatagacagggggactcctgtgtcccaccatggacacactttgctccacgctcctgctgctgaccatcccttcatgggtcttgtcccagatcaccttgaaggagtctggtcctagctggtgaaacccacacagaccctcacgctgacctgcaccttctctgggttctcactcacacttatggagtgggtgtgggctggatccgtcagccccaggaacggccctagactggcttgcactcattattcggatgatgataagcgctacacgcccagtcctctcgaagacgcaagtacctaccgaaactactccgaacccaaacggacctaaacccgtaaccaaaaaacgtccgaaacggttacggttacccttaacgtaaactacggaacccaaacgactacgggtaaccccttttcgggaaccgaactaacgggacccaacgtaacgttaaacgtttacttacgttcggtacccaaaccgaacccgtaaacgtaacggggttacccttaccgttaaccgttagtacccgttacggttacccgtttttacaaccgggtttaaaccctaaaccggttccgggttttaacccggtaacccccgtttccggggggacccctaaaccggggggttaaaccccgttaccgggttaacgtaccggtccggtttacccgtaccccgtttacccgtacccgtaccccctttaaccccggg

SEQ ID NO: 27792 - DNA, 225 bp, Homo sapiens
  misc_feature: GYAE6OF02ILL9J.22.5.A05.1.454.CMB.1.raw
  modified_base (171)..(171): a, c, t, g, unknown or other
  misc_feature (171)..(171): n is a, c, g, or t
  modified_base (221)..(225): a, c, t, g, unknown or other
  misc_feature (221)..(225): n is a, c, g, or t
tcagacatacgcgtcacgaccggtgctcgatttagatagatagacagggggactcctgtgccccaccatggacacactttgctccacgctcctgctgctgaccatccccttcatgggtcttgtcccagatcaccttgaaggagtctggtcctacgctggtagaaaccccanacacgaccctcacgctgacctgccacctttctctggttcctcactcactnnnnn

SEQ ID NO: 27793 - DNA, 757 bp, Homo sapiens
  misc_feature: GYAE6OF02G6D1Z.22.5.A05.1.454.CMB.1.raw
  modified_base (125)..(125): a, c, t, g, unknown or other
  misc_feature (125)..(125): n is a, c, g, or t
  modified_base (138)..(138): a, c, t, g, unknown or other
  misc_feature (138)..(138): n is a, c, g, or t
  modified_base (214)..(214): a, c, t, g, unknown or other
  misc_feature (214)..(214): n is a, c, g, or t
  modified_base (615)..(615): a, c, t, g, unknown or other
  misc_feature (615)..(615): n is a, c, g, or t
tcagacatacgcgtcacgaccggtgctcgatttagatagatagacaggggactcctgtgcccacatggacacactttgctccacgctcctgctgctgaccatcccttcatggtcttgtcccaagntcaccttgaaggngttctggtcctacgtcgtgggtacaaaccacactacgaccctcacgctagacctgctaccgttctcgtggttcacncgtccaaccgtattacgtgggtagttggggtcggttggcttcgggaccttaccgccgaccggaaccccgaacgggtaaaccggcccgttaaggaaccgttggtacttccgacgtacttacgtatttagtacggtaatagtatgaagttacgcgtactacgaactccgactcgtacgttaagaacgtacggaactacgtaactaacaaccataccgaaacgtacggtaaaccgtaaccaaacgaaaacgtacgaacgtaccggttactaaccgaacgtaaccaaccgttaaccgaacgttaacctaccggttaacgtacaaccggtaacctacgaccttaatacgttacgtactcggtaaccgaacaccggaacgttcggtaaacccttcgtccgttaccgnggttaaccttcggttaaacggacccgttacgtaacgttacccggttaccgaacccggtccggggtaaccgtaaccgggaaaccgttggaacccgtcgggttaacctcgttaccccgtaacgtaccgtaccgttaacccccgg

SEQ ID NO: 27794 - DNA, 754 bp, Homo sapiens
  misc_feature: GYAE6OF02HZK3G.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgctaccttctcgtggttctcactcaccacttagtggagtgggtggtgggctggactccgtcacgccccgaaggaaacggccctagactggtctgcactctatttagttggaactgatagtaagtaacggtcgacttacacgacccctacttctactaggtaaagacggtacgaacgtaacctaaccgtaaaccacttaaccaaacccgaaacgggaaaccctaaacccgtaaaacccgaaaaaaacgaccgtaaaccgggttaacggttaccctttaaaccgaaacgttacgtaaaccccgaaactaaccgttaccgggttaaccccgtttacgggaacctaaaccgacgaccctaaacgtaacttaacgttaacttcggttacgaacctaaccaacccgtaacggtaacgggttccttacctaccttgccgttacgttaccgtttaccgtaacgttacctaacggtttccggtaccggtaacccggtaggggacccgaacgggtaacccgttcgggtaccgacggtccggttacctacccggtcgtaccggtacccgtaaccccg

SEQ ID NO: 27795 - DNA, 670 bp, Homo sapiens
  misc_feature: GYAE6OF02GHZHR.22.5.A05.1.454.CMB.1.raw
  modified_base (655)..(655): a, c, t, g, unknown or other
  misc_feature (655)..(655): n is a, c, g, or t
tcagacatacgcgtcacgaccggtgctcgatttagatagatagacaggggggactcctgtgccccaccatggacacactttgctccacgctcctgctgctgaccatcccttcatgggtcttgtcccagatcaccttgaggagtctggtcctacgcgtggtacgaaacccacacacgaccctcacgctgacctcgctaccttctcgttgggttcctcacctcacctacttagtggagtggggtcgtggtcgtaggactccgacgtaccggaccccgtaaggaaccggcccgtaagtaccggtgtaccgttcgacctactcttagtttagtaggtaatcgaagtagtaacgtacgcgactaccacgccctagtctacgtagaacgacgacgtaactacgacaacactacaaaccggaacgaacctaaaccgtaaccgaaaacgtctaaacggttcttaacctaacaacgtacgaaaccaacgtactaccggtaccgttacgaacctacgacctaacacgtaattaccgtacgtgaccacaaccaccgtacgttacgtaccttcaacgttcgaccgtttggtcttaacgtactacgtacggttacgtaccgaccgggtacggaccgtaacggccgtagtacgcgttccgtactcccgngccggtcctaaccgg

SEQ ID NO: 27796 - DNA, 736 bp, Homo sapiens
  misc_feature: GYAE6OF02IYABU.22.5.A05.1.454.CMB.1.raw
  modified_base (718)..(718): a, c, t, g, unknown or other
  misc_feature (718)..(718): n is a, c, g, or t
tcagacatacgcgtcacgaccggtgctcgatttagatagatagacagggggactcctgtgccccaccatggacacactttgctccacgctcctgctgctgaccatcccttcatggtcttgtccagatcaccttgaagagtctggtcctacgctaggtgaaacccacacagaccctcacgtctacgtacctgacctaccttctcgttagggttcctccactcgaccctactttagtacggacggttgggtcgtagggcttaggaactccggttccgaccgacccccgaagggtaaacggcccctaggtaacctggtcctttagccgaccttacttaagttttacgttacgggaaacttaggaacttcggaacgttaaggcccggtaccttaccggaccgtacccctagtacctcgttaggaacgtagaccacggtactacgaactataccaacgtacggaacaccctaaacgaaacgacgtaacgttacggtacctttaacgaataccgaaacctaactagtaccggtaccgttacgtaccaacgaccgtaccaactattaaacgttacgtactccgtaacctacctaaccctagtaaccggtacctttacgtacgtcgtccttacgggtttaccttacgaattaaccgtagttacccggttacgaaccgtcgggaccgtaaaccggtcccgtagtaccgacgttactcccgttacccngttacccgccctaacccg

SEQ ID NO: 27797 - DNA, 791 bp, Homo sapiens
  misc_feature: GYAE6OF02IMZOC.22.5.A05.1.454.CMB.1.raw
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
  modified_base (351)..(351): a, c, t, g, unknown or other
  misc_feature (351)..(351): n is a, c, g, or t
tcagacatacgcgtcacgaccggtgctcgatttagatagatagacaggggggactcctgtgccccaccatggacacactttgctccacgctcctgctgctgaccatcccttcatggtcttgtcccagatcacttgaagagtctggtcctacgctggtagaaacccacaacacgaccctccgacgctcgaacctcgcctacccttcttcgttcgggttctaccactacctaccacttagtgggaggtgggtgggtggcgtggactcgtacaccgacccgaggaaccggtcctagacgtgctnctntactagtttatggtatgatggtaactacgacgtctaacacgtacccnttactacgtacgaacgtagaccgttaacgacctaacaaaccgtacttaaccgaaacccgggtaaaccgtaaaacccgtaaacccgttaaaaaccgaaaaaacggtaccggttaaacgggttacccggtttaaaaccctttaacgtaaacgtaacccggtaaaacccttaaacccggtaacggttttaccccgggttaaacccggtttacgaaaacccgttacccgaacctaacccgtaacctaaacgtttaacgtttccgttacggcctaactaacccgaccaacggtccggtttacctaccgtacgtggtaccgtttcgttaccgttacgtaaaccgttaaggtaccgttaccggtaaccgttaccggggaacggtacccggaaccgggtaccgtacggtcgacggttcctaccgtcgtccgtacccgtcccgtacccg

SEQ ID NO: 27798 - DNA, 702 bp, Homo sapiens
  misc_feature: GYAE6OF02I4711.22.5.A05.1.454.CMB.1.raw
  modified_base (152)..(152): a, c, t, g, unknown or other
  misc_feature (152)..(152): n is a, c, g, or t
  modified_base (165)..(165): a, c, t, g, unknown or other
  misc_feature (165)..(165): n is a, c, g, or t
  modified_base (207)..(207): a, c, t, g, unknown or other
  misc_feature (207)..(207): n is a, c, g, or t
  modified_base (250)..(250): a, c, t, g, unknown or other
  misc_feature (250)..(250): n is a, c, g, or t
  modified_base (304)..(304): a, c, t, g, unknown or other
  misc_feature (304)..(304): n is a, c, g, or t
  modified_base (609)..(609): a, c, t, g, unknown or other
  misc_feature (609)..(609): n is a, c, g, or t
tcagacatacgcgtcacgaccggtgctcgatttagatagatagacagggggactcctgtgccccacctattggacacactttgctccacgctcctgctgctgaccatcccttcatggtcttgtccagatcaccttgaacgagtctgtcctanctggtgaaacccncacagaccctcacgctgactgcaccgtttctcctgggtttcncactcacgtacttactggaaggttcgggtgttcgggcttaggnttccggtcaacgcccccagggaaacggtccctaggtaacttggcttggcacctntacgtttattcggaagttgatcgtagaagtcggtactactaccgccgtaatctacgttcgaaacacggtacacgtaaccttcaaacggtactacgaaaccgaacggtaaccaacgtaaccccaaaaaggtacccaaagggttaccgttaaaccgtttacaagtttaaccgaacccgtaacctaacgtttaccgggtacccgtttaccgggaaactacttacgaccgaaacttcggttatttaaccgtcgttaccgacgtaaccacctagtaccgttacgttctacgttgtcgttcgtacgttacncggttacttaggtcgttaacccggtccgtcgggaacccttacgggacctcgtttacgacggtacgtcctaaccgtcctacccggcttacccgg

SEQ ID NO: 27799 - DNA, 786 bp, Homo sapiens
  misc_feature: GYAE6OF02GVSBU.22.5.A05.1.454.CMB.1.raw
  modified_base (197)..(197): a, c, t, g, unknown or other
  misc_feature (197)..(197): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttcncttgggttctcactcacctacttatggagtgggtgtagggctgggactcccgttcgacgtcccccgagggtaaacggccctaaggtaccgtggccttgaccgtactacctattttataggtaatacggtattagtaagttaacggccgacgttaacgaccggtaccctacgttcccgttacgttacgaacggtacgaccgtaacgaaccgtaccaaacaacttacccaaaccgtaaacggaaccctaaacccgtaaacctaaaaacgtaccgtaagtccggttaaccctaacggtaaactacgaaaccctaactacggttaaccggttaccccgtttaggaaacccgtaacaccggtaaccctaacgtacttaacggtttacctcggtaccgtacctaacccgtaccgtaccggaggttacctaccgtcgtacggtaccttccgggttatttaccggtagtaaccgtaacccgtttaggaaccccggtaaccggtacgggggtaacccgtaaccggggtaacccgtttggtacccgtaacgggttccctttacccgtacccggtacctacccggacccttaacccccgg

SEQ ID NO: 27800 - DNA, 683 bp, Homo sapiens
  misc_feature: GYAE6OF02FR26P.22.5.A05.1.454.CMB.1.raw
  modified_base (213)..(213): a, c, t, g, unknown or other
  misc_feature (213)..(213): n is a, c, g, or t
  modified_base (383)..(383): a, c, t, g, unknown or other
  misc_feature (383)..(383): n is a, c, g, or t
  modified_base (662)..(662): a, c, t, g, unknown or other
  misc_feature (662)..(662): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtcgaaacccacacagacccctcaccgctcgacctgcctaccttcgtctgggttcncactcacctacttagtggagttcgggtgtgggctaggactccgtcgaccgccccgaagggaaacgcccgtaagaccgtggtacttacggctacgtcctaagttttagttacggaattcggaagtagtaacgtacgccgtactacgactcctagttcgtacgtaggaacgngacgtacgacctacaactactaccgaacgtaaccgaacctaacccgtaaacgaaaacggtactaacgggtaccgttacctaagtaaccgtacgaaacctaacgtacgtaccggttaccgttacggaacctacgtacgacctactaacgttacgtacgtctacgccctaacgaccgacgtacgtactacgtacgtgtcgttacgtcttaacgcgtacgtaccgttcggtacgtaccggtcggacggtaccggtcccgtagtaccgtacgtcccgttaccnccgtactccgtaccctaccgg

SEQ ID NO: 27801 - DNA, 611 bp, Homo sapiens
  misc_feature: GYAE6OF02GW4TB.22.5.A05.1.454.CMB.1.raw
  modified_base (170)..(170): a, c, t, g, unknown or other
  misc_feature (170)..(170): n is a, c, g, or t
  modified_base (224)..(224): a, c, t, g, unknown or other
  misc_feature (224)..(224): n is a, c, g, or t
  modified_base (306)..(306): a, c, t, g, unknown or other
  misc_feature (306)..(306): n is a, c, g, or t
  modified_base (320)..(320): a, c, t, g, unknown or other
  misc_feature (320)..(320): n is a, c, g, or t
  modified_base (460)..(460): a, c, t, g, unknown or other
  misc_feature (460)..(460): n is a, c, g, or t
tcagacatacgcgtcacgaccggtgctcgatttagatagatagacagggggactccgtgtgccccaccatggacacactttgctccacgctcctgctgctgaccatcccttcgatgggtcttgtcccagatcaccttgaaggagtctggtcctacgctggtgaaacccanacagaccctcaccgctgacctgccaccttctctgggttctcactcaccacttanggagtgggtgttgggctggatccgtcacgccccgaggaacgccctagactggcttgcactcatttatcgaatgatgatagcnctacacgccatctnttagaagacgcagactacaactactacaaccgaacgaccaaccgtaaccaaaaacgtcaaaggtcggttaccttaacactacgaaccaactacgtcgtaacccgtttaggacaacgacgaccacgtaattacttaacgtntaccgacctaccgaaccacgtagggttacctacttacgtactccgtcgtcttacacgtaactacgtcgtacccggtaaccgtggggacccgttaacgggacccttggtaccgaccggtcggttacctccgtaccgtacgcccgtaaccccg

SEQ ID NO: 27802 - DNA, 677 bp, Homo sapiens
  misc_feature: GYAE6OF02FSTGB.22.5.A05.1.454.CMB.1.raw
  modified_base (326)..(326): a, c, t, g, unknown or other
  misc_feature (326)..(326): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctcgtgggttctcactcacctacttagtggagtgggtgtggctggatccgtcaccgaccccgaggaaacggccctaggaccgtggtcttgccactctatttagtaggatgattagaacgtagcgactacncgtccctatctctagaagtcgcgtacactacaactacaccgaaccaacggaccaaccgtaaacaaaacgcgtaaacgtcgttaacccttaagaacgtaccgaaaccaacgtaacgtacggtaacccgtttagaacctacgaacgaccaactaatttacgtaacgttaggtaccaccgaacctaccgtaacggtacgttccttaccgtacgttcggtacgttcgggtacctttacgaacgttaaccgtaccggttagggttaccccgaacccgggttcggggacccgtaacggggttaccctcgggtaccgtcggttaccctccgttacctcgtacccgtcccctaacccgg

SEQ ID NO: 27803 - DNA, 762 bp, Homo sapiens
  misc_feature: GYAE6OF02IJWVX.22.5.A05.1.454.CMB.1.raw
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtacgaaacccacacacgaccctcacgctcgacctgcctaccttctcgtggttcctcactccacctattagtggagtgggtgtgggctggactcgcaccgacccgaacggaacggtcctaggactcggcttgccacttctattttagtagagtcgtagtaggtaataacggccgtactaaccgtaccgcccgtattctacgtaacggaaggtacgacgaacgtacctaaccaaactactaaccgaaaccgaaaccggtaacctaaaccaaaccgaaaaagtaccgttaaacgggttacggtaaacccttacggtaaactacgaaacccgtaaacgtaccgttaccgtacccgttacggacctaccaaccggtacaacctactttaacttacggtactacggtacccaacgtaaccgaccggtaaccgggttccttaaccgttacccgtacgtacgttccggttacctttaacggtaccttaacggttaccgtaccggttaaccgggtaccccgggttacggggacccggttaaccggggtaccgttaccgggttacgaccggttcccggtacctccccgttacggtccctaacccgtaaccccgg

SEQ ID NO: 27804 - DNA, 673 bp, Homo sapiens
  misc_feature: GYAE6OF02GOYS3.22.5.A05.1.454.CMB.1.raw
  modified_base (211)..(211): a, c, t, g, unknown or other
  misc_feature (211)..(211): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtacgaaacccacacagacccctcacgctgacctgcctaccttctcgtggttcncactcaccacttatagaggtgggtgtgggctggactccgtcaccgccccgaaggaacggcctagactggcttgctatctatttagttggaatgatagatacgcgactacacgccatctgagaagcgacagacctacaactactaccaaccgaacggaacctaaccgaaaccgaaaaagcgtaaacggttcgtaaccctttaacgaagtacaaacctaacgtacgttaacccggttaaccgtttacggaaccgtaccgaacgaccctaaactacttaactttcgtagacgaccctaaccaaccgtacggtacgtacctacttacgtcgtaccgtcgttaccttacgaagttaccctaacggttccggtaaccggtaacccgggtcgggtaacccggtaacgggttacccgtacggttaccgacggttcccgttaccgtacctaccgtacctcccgtaaccccg

SEQ ID NO: 27805 - DNA, 715 bp, Homo sapiens
  misc_feature: GYAE6OF02FGCGL.22.5.A05.1.454.CMB.1.raw
  modified_base (168)..(168): a, c, t, g, unknown or other
  misc_feature (168)..(168): n is a, c, g, or t
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
tcagacatacgcgtcacgaccggtgctcgatttagatagatagacagggggactcctgtgcccaccatggacacactttgctccacgctcctgctgctgaccatcccttcatgggtcttgtcccagatcaccttgaaggagtctggtcctacgctggtacgaaacccncaacagaccctcacgctgacctgcaccttcnctgggttctacactccgacctattacgnggacggttgggtcgtgggctggactccgtcacgccccgaggaacgcctagactggctttcgctacgtactagttttagtacgaagttgactgaacgttacgaccgtactaaccgacggacccctagttcgtaccgtagaaacgacgaccgtaaggtaccctacgaaacctacgacctaaacccgaaaggaaccctacccgtaaaaccgaaaaagtccgtaaacggtcggttaaccctaacgaacgttacgaacctaactacgtacggtacccgtttaggaacctacgacgacctaacgtattactacgttacgtacgacctaacgaacccgtaacgacggttacctacgttacgtacgtaccgttcggtacctttacgtacgttaaccttacggttccggtaaccttaaccgggtcgggtacccgtaacgggcccgttacggtaccgacggttccttaccgtacccgtcgtaccgtccccgtaacccg

SEQ ID NO: 27806 - DNA, 807 bp, Homo sapiens
  misc_feature: GYAE6OF02H3XCW.22.5.A05.1.454.CMB.1.raw
  modified_base (436)..(436): a, c, t, g, unknown or other
  misc_feature (436)..(436): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggtagagccggccacccttctcctgacgacgggccaagtagacgagtatagcgacttactagcctacggtacaacgagacggctcggaccacggtcctaccgacggtcctaccgtcctagttacgtagtgtaacgtcgtcttaccgttaccggaacgggtaccctacgtcggttaaccgtcccccgtcggtaacggttacgtcggtaccgtaccggtagggttcgggttaacggtcggggtaaaccncgggttaagtacccgtacttaccggtaacctaccgtaacgtcggaccgaccgtaccgccgttaccggtagtaccggttaacggttaacggtaaagtttacgtttacgggtaaccttttaacctttaagttacccggttagttacgaaaggttaaccctaaagtttaaacgttaaacgttcggttaaacgtttcgggtttaaccttaacggtaaccttcccgttaaccggtttaccggaacccgggttaaccggtaacgtaacgtaccgttagggtaacgttaaaccgttaaacgtaccggtagtaccggtgttaacccgaccggttaactacgtttaccggtaccgtttacttaccgtaccttacccccgg

SEQ ID NO: 27807 - DNA, 776 bp, Homo sapiens
  misc_feature: GYAE6OF02FWYPW.22.5.A05.1.454.CMB.1.raw
  modified_base (139)..(139): a, c, t, g, unknown or other
  misc_feature (139)..(139): n is a, c, g, or t
  modified_base (144)..(144): a, c, t, g, unknown or other
  misc_feature (144)..(144): n is a, c, g, or t
  modified_base (160)..(160): a, c, t, g, unknown or other
  misc_feature (160)..(160): n is a, c, g, or t
  modified_base (194)..(194): a, c, t, g, unknown or other
  misc_feature (194)..(194): n is a, c, g, or t
tcagacatacgcgtcacgaccggtgctcgatttagatagatagacaggggggagaactgctcagttaggacccagagggaaccatggaagccccagctcagcttctcttcctcctgctactctcggctcccagaaaccncgganaagttgtgttgacacngtctccagccacctgtctttgcctcgaggggaangcccacctctctgacaggccagtcagtacgtagttaactaccgtacttacgccgttaggtaaccaacgtaggaaacccgttggaccctaacgggtcccttaccccggaaggtccccttacctaccgtaacttccgttaagtaccggacttccggaaccttacgtttacccgttaaccggaaccggggtccctaacggtacgggtaacctaccgtaccccggaacggttccgtaaagggtttccgaagggttcggaccgttagggttcgggtacgtacggggtactacggttaccttcgaccttccgtaccacgtactaccgaggccgaacgtccagccgtacgtaagtagttacgttttgacgttacttttaacgttcgtcggtacacgttaacgaccggttactaacgtaccctaccctacccgttacggtaccggttacggggtaccggaacgggtacgtaagggtacgtaacgtaacgaacgtaaccgtaggtacggttagcgtaaaccggccgtaacctccgttacgttaccgttaccgttacgtacccgttcccggtacccgtactaccgttacccg

SEQ ID NO: 27808 - DNA, 786 bp, Homo sapiens
  misc_feature: GYAE6OF02JQ0OH.22.5.A05.1.454.CMB.1.raw
  modified_base (200)..(200): a, c, t, g, unknown or other
  misc_feature (200)..(200): n is a, c, g, or t
  modified_base (271)..(271): a, c, t, g, unknown or other
  misc_feature (271)..(271): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtcctccagcccacccttgtctttgtcctcgaagggtaanacgccacctctctgcgacgggccagtcagagtacgttaactacttacgttacgccgttacggtaacccaanaaccgtaaaccgtcggaccgaaggtccctacccgaaggtccttaccctacgtaacttccttaagtcggaacttcgacctacttacgttaaccggacgggtccctaaccgtcgggtaacctacccgtacccgtacggtacccgtaaggtttaccgaggttaccgggtacgtacggggtcggttacggtacggggtaaccgtaaccgtttaccgttaccgtaacccgtttacccgtaacgtaaaccgttaccgtaaccggtaacggttcccgaacccgtaaccgttacggaacccggtaccgtaagttaacgttacgttacgtacgtttaacgtttacgtacgtacgtacgtacgtacgtacgtaccgtactaaccctaccgttccgttacggtaccggtttacgggacgggtaacggtacgtacgggtagaacgtaacgaccgtaacgtcgtacgtactacggactaccgtactacgtaccgtagttccctacgtccgtaccttccagtcctacgg

SEQ ID NO: 27809 - DNA, 554 bp, Homo sapiens
  misc_feature: GYAE6OF02HECDP.22.5.A05.1.454.CMB.1.raw
  modified_base (313)..(313): a, c, t, g, unknown or other
  misc_feature (313)..(313): n is a, c, g, or t
  modified_base (366)..(366): a, c, t, g, unknown or other
  misc_feature (366)..(366): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcacctacttagtggagtgggtgtgggctggactccgtcacgccccaaggaaacggccctagactggcttgcactctatttatggaatgatgatagcgctacancccatctctagaagagcagactcaacataccaacaaggacaacctacaaaaancgaagtcgtaccttacaactacgacaacactacggtaccgttacgacacacaccacatactactgtcgacacacctacgacggtactctatcgtctacgtcttactacgtactacgtacgtaccgtaccggtcgggaccgtacgggtaccgtcggtcgacgtacgtcctccgcttttacgcctacccg

SEQ ID NO: 27810 - DNA, 706 bp, Homo sapiens
  misc_feature: GYAE6OF02FIDVU.22.5.A05.1.454.CMB.1.raw
  modified_base (303)..(303): a, c, t, g, unknown or other
  misc_feature (303)..(303): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcacctacttatggagtgggtgtgggctggactccgtcacgccccgaggaacgcctagactggcttgcactctatttagtgatgatgataagcncgtacacgacctatcttcgtaggaacgagctaacgacctacaactactaccaaccgaaacggaccaaccgtaaaccaaaaacgtaccgtaaaggttaccggtttaccttaactaaacgtacgaacccaaacgtacgtaccggtaacccgttttacggaacctaaccgaacggacccctaaactaactttaacgtttaacttacggtaccgaacccaaccgaaccgtaaccggttaacgggttaccttaccgttacgtcggttaccgttcgttaacctttacgtaacttaaccgtaacggtttaccgtaccggtaacccggtcggggacccgtaaccggggtaacccgtttacggtaccgtacggttccgttacccgtaccacccgtaccgaccctaaccccgg

SEQ ID NO: 27811 - DNA, 806 bp, Homo sapiens
  misc_feature: GYAE6OF02G9ZIL.22.5.A05.1.454.CMB.1.raw
  modified_base (144)..(144): a, c, t, g, unknown or other
  misc_feature (144)..(144): n is a, c, g, or t
  modified_base (251)..(251): a, c, t, g, unknown or other
  misc_feature (251)..(251): n is a, c, g, or t
tcagacatacgcgtcacgaccggtgctcgatttagatagatagacagggggactcctgtgccccaccatggacacactttgctccacgctcctgctgctgaccatcccttcagtgggtcttcgtcccagatcaccttggaaggngttctcggtcctacgcgtgggtacgaaacccacacgtacgaccctcacgcgtacgacctgacctacccttcgtcggttgggttctcctacctccaacctacgttagnggggtaggtggggtggttcggggccgttagggtaccttcccggtaccgacccggaccccccggaaagggtaaaccggtccctaagggtacgttcggtcgttccgctaccgttattacgtttagttaggaatgtatagtaacgtagccgtacctaacgacgaccctagtccgttaaggactaacggaacgccgaacgttaccacgaaaccacgtaccaaacgaaaccgacctaaaccgtaacaaaaacgaccgtaacggttaccgttactaaccgaagtaccgaaacctaacgtaacggttaccggttaaacccgtttcggaaacgtaaccgaaccgtacccaacttaaacggttactttaccgacgttaaccgacctaaaccgacccgtaaacggttacggttacccgttacttaccggacgttccggttacgttacttaacgtaaccgttacgtaacccgttacggtacccggtaccggttacccgggaccggttaacccggaccgttacgtacgtccgtaccttccgtccctccgtaccgtacccgtaacccg

SEQ ID NO: 27812 - DNA, 658 bp, Homo sapiens
  misc_feature: GYAE6OF02GFW4A.22.5.A05.1.454.CMB.1.raw
  modified_base (170)..(170): a, c, t, g, unknown or other
  misc_feature (170)..(170): n is a, c, g, or t
  modified_base (316)..(316): a, c, t, g, unknown or other
  misc_feature (316)..(316): n is a, c, g, or t
  modified_base (349)..(349): a, c, t, g, unknown or other
  misc_feature (349)..(349): n is a, c, g, or t
  modified_base (531)..(531): a, c, t, g, unknown or other
  misc_feature (531)..(531): n is a, c, g, or t
tcagacatacgcgtcacgaccggtgctcgatttagatagatagacagggggactcctgtgccccaccatggacacactttgctccacgctcctgctgctgaccatcccttcatgggtcttcgtcccagatcaccttgaaggagtctggtcctacgctggtacaaacccanacacgaccctcacgctgacctgcctaccttctcgttcgggtttactccacctccacctacttagtgggtaggtggggtggtgggtcgtaggtacgtcccgtacaccggccccgaaggtaaccgcctagacgtcggtcttgctactnttacgtttagtgaatgatagatacgcactaacnccgcctactctacgtagaagacgacacgtacctataaccactaccaaccggaacgaacctaacccaaacgaaaagcgtaacgggttacgtacctaatacacgaaccaagtacggtacgtaccgttagacaagcaccatagttactactggtccacgacctaccgtacgtaggtctactacgnggtcctacgttacttacaaccgtacgttagttcccggtaacgtaacccgggtcggaaccggtaaccggtaccggttacggccgtaccgtccgttaccgtccctacggtacccgtacccctaacccgg

SEQ ID NO: 27813 - DNA, 674 bp, Homo sapiens
  misc_feature: GYAE6OF02G0QGY.22.5.A05.1.454.CMB.1.raw
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaagagccaccctctcctgcagggccagtcagagtgtaacactactagctggtaccaacagaactggccaggcctccaggctccncatctatgatcgnattctacgacggtccacncggtaccacgtcccagccctaggtcgagtcggcgtagtcgggtcgtacgggacgacttctactacgtctaccaactctacgaccgtgtaaccgtccgtaacggacgtcccgtaaggtaagtttagtttcggtacgttagttttaactttacctagttcgtacgtacggtaacgtacggtacgaaccttaccccgtaccgttaccgttaccgggtaccggacggggtaaccgggaaggtacggggtcgaaacggactaaacccgaaacggtacgttacggtacggtaccgtaacgtaaacccgacgtaacgttccgttacgttccttacgttcccgttacccgtttccccgaacttacttacccgg

SEQ ID NO: 27814 - DNA, 801 bp, Homo sapiens
  misc_feature: GYAE6OF02FZWTQ.22.5.A05.1.454.CMB.1.raw
  modified_base (198)..(198): a, c, t, g, unknown or other
  misc_feature (198)..(198): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccgggagaagttgtgttgacacagtctccagcccaccctgtctttgcctccgaggggaancgccaccctctcctgccgagggccagtcagtagtgttaactacttacgttagcccgttaggtaaccccaagaacgtaaaccctcgggacccaacgggtcctacccccgaagggcccttcccctacctaacttcctaagtcggtaacgtcgaccttaacgttaccgttttaacccggacgggggtcccctaaccgttcggggaccctaaccgttccccccggaacggtaccccggttaacggggttttctaaccgggtcggggtaccctaggggttccgggggttccgtaacgggggaacctacggtacccgttacctacgtccttacccgactacgttccgaaacgccgtagtaccccgtaggacgtccgtaggtacgtttagtttacgtacgttaagttttaactttacgtacggtcacggttacgacgtaccggtactaccgtaccgttcccgtaccgttaccgggttaccggacgggtacgggtaaccggtagggtacgacgtaacgtacgtaaaccgtaggttcgtacggtacgttcgaccgttacctcgttaccttacgtccgttactaccgttccgttacccctccgtaccgttacg

SEQ ID NO: 27815 - DNA, 705 bp, Homo sapiens
  misc_feature: GYAE6OF02G32IS.22.5.A05.1.454.CMB.1.raw
  modified_base (141)..(141): a, c, t, g, unknown or other
  misc_feature (141)..(141): n is a, c, g, or t
  modified_base (168)..(168): a, c, t, g, unknown or other
  misc_feature (168)..(168): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (327)..(327): a, c, t, g, unknown or other
  misc_feature (327)..(327): n is a, c, g, or t
tcagacatacgcgtcacgaccggtgctcgatttagatagatagacagggggactcctgtgccccaccatggacacactttgctccacgctcctgctgctgaccatcccttcatgggtcttgtcccagatcaccttgaaggngtctggtcctacgctggtgaaacccanacagaccctcacgctgacctgcaccttctcgtgggttctcactcaccacttatggagtgggtgtgggctggatccgtcacgccccaggaacgcccagactggcttgcactctatttntaggatgangataagccgctacacgcccatctctagaagacncgacactacaacactaccaaccaaaggacccaaacctaaccgaaaaacgcgtaaacgtacggttaccttaacaacgtaccggaaccctaaaccgtacttaccgggttaaccccgtttacggaaccgtaaccgaaccgtacccaaacttaacgttaaactttaccgttaacggtccaacccacccgtaacccgtaaaccgtacggggttaccttaccgttaccgtggtacccgttggttcctttaaacgtacgttaaccgtaccgttaccgggttaccggaaccccggtacggggtacccggtaacgggtaccccgttacgggtacctacggttacccgttaccgttaccccgtaccggaccgtacccccgtaacccgg

SEQ ID NO: 27816 - DNA, 710 bp, Homo sapiens
  misc_feature: GYAE6OF02IN9FY.22.5.A05.1.454.CMB.1.raw
  modified_base (175)..(175): a, c, t, g, unknown or other
  misc_feature (175)..(175): n is a, c, g, or t
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (305)..(305): a, c, t, g, unknown or other
  misc_feature (305)..(305): n is a, c, g, or t
tcagacatacgcgtcacgaccggtgctcgatttagatagatagacagggggactcctgtgccccaccatggacacactttgctccacgctcctgctgctgaccatcccttcagtgggtcttcgtcccagatcaccttaggaaggagtctaggtcctagctcggtacgaaacccanaacacgaccctcacgctgacctgactaccttctcgtcggtctcactcactacttagnggtaggtggtggngggtctacggctccgtcgaccgacccgaaggaaccgtccgtagcgtgtctcgactacgtntagttacgtgtatgagttagagtacgcgtactacgactacctactcgtagagtaacgctacgcgaactacaactactaccaacgaacgtacctaaaccaacgaaaacgacgtaacgttaccggtaacctaagaacgtacgaacctaacgtaccggttacgtaccgttaacgaaccgtaacgaccgtaactaaccgttaacgtttaacgttacgttaaccgtcgaaacccaccggtaccgtacggttaccggtacttcgtaagtaccggttcgttaccgttaactacgtaacgttaaccgtacggttccggtaaccggtcccgggtacggtaacccggtacccggttacgtacgtaacgtccgttaccggttacctaccggtacgtacccgtacccgtaacccggg

SEQ ID NO: 27817 - DNA, 171 bp, Homo sapiens
  misc_feature: GYAE6OF01B4G1E.49.38.D05.1.454.CMB.1.raw
  modified_base (171)..(171): a, c, t, g, unknown or other
  misc_feature (171)..(171): n is a, c, g, or t
tcagagtcgagagacacgaccggtgctcgatttagtatctgatagttgggtttggggaagaggaagactgacggtccccaggagttcaggtgctgggcacagcggccctgggctgcctggtcaaggactacttcctctctcgactctgagcgggctggcaaggcgcatagn

SEQ ID NO: 27818 - DNA, 271 bp, Homo sapiens
  misc_feature: GYAE6OF01BVOGD.49.38.D05.1.454.CMB.1.raw
  modified_base (267)..(271): a, c, t, g, unknown or other
  misc_feature (267)..(271): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttcccctggcgccctgctccaggagcacctctggggcacagcggccctgggctgcctggtcaaggactacttcctctctcgactctgagcgggctggcaaggcgcatagnnnnn

SEQ ID NO: 27819 - DNA, 307 bp, Homo sapiens
  misc_feature: GYAE6OF01DS9OE.49.38.D05.1.454.CMB.1.raw
  modified_base (270)..(307): a, c, t, g, unknown or other
  misc_feature (270)..(307): n is a, c, g, or t
tcagagtcgagagacacgaccggtgctcgatttagtatctgatagttgggtttgggggtgctcgatttagtatctgatagttgggtttgggggaggtgtgtcacaagatttgggccctggtcaccgtctcctcagcttccaccaagggcccatcggtcttccccctggcgccctgctccaggagcacctctgggggctacagcggccctgggctgcctggtcaaggctacttcctctctcgactctgagcgggctggcaaggcgcatagnnnnnnnnnnnnnnnnnnnnnnnnnnnnnnnnnnnnnn

SEQ ID NO: 27820 - DNA, 274 bp, Homo sapiens
  misc_feature: GYAE6OF01B0RXB.49.38.D05.1.454.CMB.1.raw
  modified_base (268)..(274): a, c, t, g, unknown or other
  misc_feature (268)..(274): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttcccctggcgccctgctccaggagcacctctgggggcacagcggccctgggctgcctggtcaaggactacttcctcgtagcactctgagcgggctggcaaggcgcatagnnnnnnn

SEQ ID NO: 27821 - DNA, 501 bp, Homo sapiens
  misc_feature: GYAE6OF01DO332.49.38.D05.1.454.CMB.1.raw
  modified_base (296)..(296): a, c, t, g, unknown or other
  misc_feature (296)..(296): n is a, c, g, or t
  modified_base (337)..(337): a, c, t, g, unknown or other
  misc_feature (337)..(337): n is a, c, g, or t
  modified_base (364)..(364): a, c, t, g, unknown or other
  misc_feature (364)..(364): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggagcgtggtccagcctgggaggtccctgagactctcctgtgcagcctctggattcgtctctagtgtctaccctatcgcactgggtccncaggctccaggcaaggggctggaatggggtggctacgttanctcatctgatggaagtctgaatcttancgccgactccgtgaaggccgattccaccatcctccagacgacaattaccaagaacacaactaatatcttacaaatcgaaacactctagagacgtgagacacggctgtctattcgtgtgcgtactgagatgtcttaag

SEQ ID NO: 27822 - DNA, 272 bp, Homo sapiens
  misc_feature: GYAE6OF01CM0P6.49.38.D05.1.454.CMB.1.raw
  modified_base (266)..(272): a, c, t, g, unknown or other
  misc_feature (266)..(272): n is a, c, g, or t
tcagagtcgagagacacgaccggtgctcgatttagtatctgatagttgggtttggggtgctcgatttagtatctgatagttgggtttggggaggtgtgtcacaagatttgggccctggtcaccgtctcctcagcttccaccaagggccatcggtcttcccctggcgccctgctccaggagcacctctgggggcacagcggccctgggctgcctggtcaaggactacttcctcgtagcactctgagcgggctggcaaggcgcatagnnnnnnn

SEQ ID NO: 27823 - DNA, 286 bp, Homo sapiens
  misc_feature: GYAE6OF01CAIPM.49.38.D05.1.454.CMB.1.raw
  modified_base (269)..(286): a, c, t, g, unknown or other
  misc_feature (269)..(286): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttccccctggcgccctgctccaggagcacctctgggggcacagcggccctgggctgcctggtcaaggactacttcctctctcgactctgagcgggctggcaaggcgcatagnnnnnnnnnnnnnnnnnn

SEQ ID NO: 27824 - DNA, 276 bp, Homo sapiens
  misc_feature: GYAE6OF01CYU88.49.38.D05.1.454.CMB.1.raw
  modified_base (267)..(276): a, c, t, g, unknown or other
  misc_feature (267)..(276): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccacaagggcccatcggtcttcccctggcgccctgctccaggagcacctctgggggcacagcggccctgggctgcctggtcaaggactacttcctcgtagcactctgagcgggctggcaaggcgcatagnnnnnnnnnn

SEQ ID NO: 27825 - DNA, 274 bp, Homo sapiens
  misc_feature: GYAE6OF01CQGMI.49.38.D05.1.454.CMB.1.raw
  modified_base (268)..(274): a, c, t, g, unknown or other
  misc_feature (268)..(274): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttcccctggcgccctgctccaggagcacctctgggggcacagcggccctgggctgcctggtcaaggactacttcctctctcgactctgagcgggctggcaaggcgcatagnnnnnnn

SEQ ID NO: 27826 - DNA, 221 bp, Homo sapiens
  misc_feature: GYAE6OF01D53ZP.49.38.D05.1.454.CMB.1.raw
  modified_base (219)..(221): a, c, t, g, unknown or other
  misc_feature (219)..(221): n is a, c, g, or t
tcagagtcgagagacacgaccggtgctcgatttagtatctgatagttgggtttgggggaagaggaagactgacggtcctcccaggagttcaggtgctgggcaccgtgggcatgggggaggtgtgtcacaagatttgggctctgggcacagcggccctgggctgcctggtcaaggactacttcctctctcgactctgagcgggctggcaaggcgcatagnnn

SEQ ID NO: 27827 - DNA, 276 bp, Homo sapiens
  misc_feature: GYAE6OF01CX7NZ.49.38.D05.1.454.CMB.1.raw
  modified_base (269)..(276): a, c, t, g, unknown or other
  misc_feature (269)..(276): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttccccctggcgccctgctccaggagcacctctgggggcacagcggccctgggctgcctggtcaaggactacttcctctctcgactctgagcgggctggcaaggcgcatagnnnnnnnn

SEQ ID NO: 27828 - DNA, 299 bp, Homo sapiens
  misc_feature: GYAE6OF01ENQ9X.49.38.D05.1.454.CMB.1.raw
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (275)..(299): a, c, t, g, unknown or other
  misc_feature (275)..(299): n is a, c, g, or t
tcagagtcgagagacacgaccggtgctcgatttagtatctgatagttgggtttggggtgctcgatttagtatctgatagttgggtttggggaggtgtgtcacaagatttgggccctggtcaccgtctcctcagcttccaccaagggcccatcggtcttcccctggcgccctgctccaggagcacctctggggcacagcggccctgggctgccctggtcaaggctacttcctctctcgactctgagcgggctggcaaggcgcattaaggangnacnnnnnnnnnnnnnnnnnnnnnnnnn

SEQ ID NO: 27829 - DNA, 501 bp, Homo sapiens
  misc_feature: GYAE6OF01CPCLP.49.38.D05.1.454.CMB.1.raw
  modified_base (296)..(296): a, c, t, g, unknown or other
  misc_feature (296)..(296): n is a, c, g, or t
  modified_base (432)..(432): a, c, t, g, unknown or other
  misc_feature (432)..(432): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggagcgtggtccagcctggggaggtccctgagactctcctgtgcagcctctggattcgtctctagtgtctaccctatgcactgggtccnccaggctccgaggcaaggggctgggaatggggtgcacttatctcatctgatggaagtctgaatcttatgccgactccgtgaacgggccgattcaccatctaccagacgacaacttccaagaacacactatatctanaaatgaacactctagagacgtgacgacacggctgtactattactgtagcgtactgagtatgttcttaag

SEQ ID NO: 27830 - DNA, 272 bp, Homo sapiens
  misc_feature: GYAE6OF01B7NC6.49.38.D05.1.454.CMB.1.raw
  modified_base (265)..(272): a, c, t, g, unknown or other
  misc_feature (265)..(272): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggccatcggtcttcccctggcgccctgctccaggagcacctctgggggcacagcggccctgggctgcctggtcaaggactacttcctctctcgactctgagcggctggcaaggcgcatgnnnnnnnn

SEQ ID NO: 27831 - DNA, 303 bp, Homo sapiens
  misc_feature: GYAE6OF01BK7NR.49.38.D05.1.454.CMB.1.raw
  modified_base (272)..(272): a, c, t, g, unknown or other
  misc_feature (272)..(272): n is a, c, g, or t
  modified_base (275)..(303): a, c, t, g, unknown or other
  misc_feature (275)..(303): n is a, c, g, or t
tcagagtcgagagacacgaccggtgctcgatttagtatctgatagttgggtttggggtggctcgatttagtatctgataggttgggtttgggggaggtgtcgtcacaagatttgggccctggtcaccgtctcctcagcttccaccaagggcccatcggtcttcccctggcgccctgctccaggagcacctctcgggggcactagcggccctggggactgcctggtcaaggactacttcctctctcgactctgagcgggctggcaaggcgcanagnnnnnnnnnnnnnnnnnnnnnnnnnnnnn

SEQ ID NO: 27832 - DNA, 541 bp, Homo sapiens
  misc_feature: GYAE6OF01C2YPU.49.38.D05.1.454.CMB.1.raw
  modified_base (245)..(245): a, c, t, g, unknown or other
  misc_feature (245)..(245): n is a, c, g, or t
  modified_base (268)..(268): a, c, t, g, unknown or other
  misc_feature (268)..(268): n is a, c, g, or t
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
  modified_base (366)..(366): a, c, t, g, unknown or other
  misc_feature (366)..(366): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtcgtgggggagcgtggtccagcctggggaggtccctgagactcncctgtgcagcctctggattcgtntctagtgtctaccctatgcactgggccncaggctccgaggcaaggggctaggaatggggngcacttanctcatctagatgggaagtctgaattcttancggccgtactcggtagacgggccgtatacaccatcctacgagagaacaacttaccaacgaacacaactatatacttacaaatacgaacactactgacgtacgtaggaagaccgacggcgttcgtacttacttacgttaggtggtacgtacgttagagtagttcgttatttaaacg

SEQ ID NO: 27833 - DNA, 519 bp, Homo sapiens
  misc_feature: GYAE6OF01DSFP2.49.38.D05.1.454.CMB.1.raw
  modified_base (172)..(172): a, c, t, g, unknown or other
  misc_feature (172)..(172): n is a, c, g, or t
  modified_base (329)..(329): a, c, t, g, unknown or other
  misc_feature (329)..(329): n is a, c, g, or t
  modified_base (360)..(360): a, c, t, g, unknown or other
  misc_feature (360)..(360): n is a, c, g, or t
  modified_base (472)..(472): a, c, t, g, unknown or other
  misc_feature (472)..(472): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatgggagtttgggctgagctgggttttcctcgttgctcttttaagnggtgtccagtgtcatgtgcagttgatacagtctgggggagcgtggtccagcctgggagtccctgagactctcctgtgcagcctctggattcgtctctagtgtctaccctatgcactgggtccgcaggctccaggcaagggctggatgggtgcattanctcatctgatggaaggtctagaattcttaancgccgactccggtgaacgggccgtattccacctatcctaccagacgactaacttaccaaagaccacactatatcttacaaatgaacactcagacgacgtgacgacgaccggnttcgtattacttcgtaggtcgacgtactaggagattgtactttaacg

SEQ ID NO: 27834 - DNA, 501 bp, Homo sapiens
  misc_feature: GYAE6OF01BDFIY.49.38.D05.1.454.CMB.1.raw
  modified_base (296)..(296): a, c, t, g, unknown or other
  misc_feature (296)..(296): n is a, c, g, or t
  modified_base (366)..(366): a, c, t, g, unknown or other
  misc_feature (366)..(366): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggagcgtggtccagcctgggaggtccctgagactctcctgtgcagcctctggattcgtctctagtgtctaccctatgcactgggtcccnccaggcctccaggcaaggggctgggaatggggtggctacttatctcatctgatggaagtctgaatcttangccgactccgtgaagggccgattcaccatcctcagacgacaattaccaagaacacactatactctacaatgaacactctagagacgtgaggacacggctgttactagttctgtcgcgtactgagtatgtcttaag

SEQ ID NO: 27835 - DNA, 609 bp, Homo sapiens
  misc_feature: GYAE6OF01DBIMA.49.38.D05.1.454.CMB.1.raw
  modified_base (357)..(357): a, c, t, g, unknown or other
  misc_feature (357)..(357): n is a, c, g, or t
  modified_base (388)..(388): a, c, t, g, unknown or other
  misc_feature (388)..(388): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttggctgagcttgggttttcctcgttgctcttttaagaggtgtccagtgtcatgtgcagttgatacagtcgtgggggaggcgtggtccagccgtggggacggtccctgagactctcctggtgcagcctcgtggattcgtctctagtcgtcctaccctatcgcctacgtcggggtcccgccaggcctccgaggcgaaggggctagggaatggggtgctatttacnctcatcgtgagtggaagtctagaattcttancgaccgtacgtccggtaggaacgggccgtaacttccaccctactacccgtacccgaacaacctaaacttaccaaacgaacctactatttacgtttacctactcgacctagaacctacgaccctagaacggtaacggtacgaaccggacgaccggtactacggtaatatcacgttggcgacggtacgaacggaccaaacgtaacttaacccggtaacccggg

SEQ ID NO: 27836 - DNA, 548 bp, Homo sapiens
  misc_feature: GYAE6OF01CX4QZ.49.38.D05.1.454.CMB.1.raw
  modified_base (297)..(297): a, c, t, g, unknown or other
  misc_feature (297)..(297): n is a, c, g, or t
  modified_base (369)..(369): a, c, t, g, unknown or other
  misc_feature (369)..(369): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggagcgtggtccagcctgggaggtccctgagactctcctgtgcagcctctggattcgtctctagtgtctaccctatgcacgtgggtcccnccaggcctccgaggcaaggggctagggaatggggtgctacttatctcatctgatggaagtctagaatcttancggccgacgtccgtaggaacgggccgtattccaccactcctaccagacgactaacttacccaaagaaccaacacttaattactaccttaacaaattacgaaacctactctagacgtacgtagacggaccgacggtctcgtacttaattactgtcgcgtactagagtactgttacttaag

SEQ ID NO: 27837 - DNA, 646 bp, Homo sapiens
  misc_feature: GYAE6OF01EG17F.49.38.D05.1.454.CMB.1.raw
  modified_base (305)..(305): a, c, t, g, unknown or other
  misc_feature (305)..(305): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtcgtggggggagcgtggtccagcctggggacgtccctgagactctcctgtgcagcctcgtggatttccgtctctagtcgtcctaccctatgcacgtgggtcccnccgaggcctccgagggcgaaggggctagggaagttggggtgacctaacgtttatccgtacattcgtaggtagtaagggtaacgtctagtaacttcgttagtccggacccgtacgttccggtaggtaacgggtccgtacttaccgaaccctacgtccgtaccgaaggtaacgtaaccctaaacgttaacccgaaagtaaaccctactaacttaacttaacttaccttaactaaactacgtaaacctacttcgtaagaacgtcggtaggaacggaccgaacggtcgtacgttacttaattaccgtgtacggacgtacgtagagtacgtttgttacgtttaacg

SEQ ID NO: 27838 - DNA, 227 bp, Homo sapiens
  misc_feature: GYAE6OF01E2T8Z.49.38.D05.1.454.CMB.1.raw
  modified_base (220)..(227): a, c, t, g, unknown or other
  misc_feature (220)..(227): n is a, c, g, or t
tcagagtcgagagacacgaccggtgctcgatttagtatctgatagttgggtttggggggaagaggaagactgacggtcctcccaggagttcaggtgctgggcaccgtgggcatgggggaggtgtgtcacaagatttgggctctgggcacagcggccctgggctgcctggtcaaggactacttcctctctcgactctgagcgggctggcaaggcgcatagnnnnnnnn

SEQ ID NO: 27839 - DNA, 605 bp, Homo sapiens
  misc_feature: GYAE6OF01C3SLU.49.38.D05.1.454.CMB.1.raw
  modified_base (289)..(289): a, c, t, g, unknown or other
  misc_feature (289)..(289): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcttgggttttcctcgttgcttcttttaagaggtgtccagtgtcatgtgctagttgatacaggtcgtgggggagcgtggtccagtccgtggggacgtccctgagtacctctcgtgtgcagcctcgtggtacttccgtctcgtaggtntcctaccctatcgcctacgtcgggtccctccgaggcctaccgaggcgaaggggtctagggaagtggggtcgactacgttatcgtacaacgtcgtagtagtagggtaaggtcctaggtaaacttcttaagtcgacccgtagtccggtaggaacgggtcctagtccactacgtcctacaagtacaactaacttaccaaagacactactaatactcctaataaactacgaactacgtcgtagacggacgttaggaacggtactcggtacttggtaactagttacgtgtacgacgttcgtagagttagttctcgttaaag

SEQ ID NO: 27840 - DNA, 279 bp, Homo sapiens
  misc_feature: GYAE6OF01CFVVM.49.38.D05.1.454.CMB.1.raw
  modified_base (271)..(279): a, c, t, g, unknown or other
  misc_feature (271)..(279): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggccatcggtcttcccctggcgccctgctccaggagcacctctgggggcacagcggccctgggctgcctggtcaaggactacttcctctctcgactctgagcgggctggcaaggcgcattaaggcnnnnnnnnn

SEQ ID NO: 27841 - DNA, 615 bp, Homo sapiens
  misc_feature: GYAE6OF01BLBTK.49.38.D05.1.454.CMB.1.raw
  modified_base (304)..(304): a, c, t, g, unknown or other
  misc_feature (304)..(304): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtcgtgggggagcgtggtccagccgtgggagtccctgagactctcctgtgcagcctcgtggattcgtctctagtcgtcctaccctatcgctacgtcgggtcccnccgaggcctaccgagggcgaagggggcctagggaagtggggtggacctacgtttatcctcatcgtagagttgggaacggttctagaactttcttagtcgcccgacgttccggtagggaacgggtccgtattccaacctactcctaccgaagacgtaactaacttaccaaacgtaaccaactactaatactacttaacaaagtacgaacctacttacgtagacgaacggtagaaccggacgaccggtacttcggttacttaacgttacgtggtacgtacgtacgtaggtagtacgttcgttacgttaaacgg

SEQ ID NO: 27842 - DNA, 621 bp, Homo sapiens
  misc_feature: GYAE6OF01CZLCT.49.38.D05.1.454.CMB.1.raw
  modified_base (304)..(304): a, c, t, g, unknown or other
  misc_feature (304)..(304): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtcgtgggggagcgtggtccagcctggggaggtccctggagactctcctgtgcagccttcgtggattcgtctctagtgtcctaccctatcgcacgtgggtcccncaggcctaccgaggcgaaggggctgggaagtggggtcgctaactttatcctactactcgtaggaacgtggggtaaaggttctaggtaaatttccttaagtccggacccggtaccgttccgggttagggaaccggggtccgtactttacccaaccctacttccgtaccgaagaacgaacctaaacttacccgaaagaaccaactacttaatactacttaacaaactacgaactactcgtagacgacgtaggacggacgacggtcgtacgttcgttaattacgtggtacgcgtaacgtagacgtattcgttcttaaacg

SEQ ID NO: 27843 - DNA, 507 bp, Homo sapiens
  misc_feature: GYAE6OF01COYO7.49.38.D05.1.454.CMB.1.raw
  modified_base (256)..(256): a, c, t, g, unknown or other
  misc_feature (256)..(256): n is a, c, g, or t
  modified_base (298)..(298): a, c, t, g, unknown or other
  misc_feature (298)..(298): n is a, c, g, or t
  modified_base (346)..(346): a, c, t, g, unknown or other
  misc_feature (346)..(346): n is a, c, g, or t
  modified_base (372)..(372): a, c, t, g, unknown or other
  misc_feature (372)..(372): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtcgtgggggagcgtggtccagcctggggagtccctgagactctctgtgcagcctntggattcgtctctagtgtcctaccctatcgcacgtgggcccncaggcctccgaggcaaggggctagggaagtggggtgctacttactctnatctgatgggaagtctagaatcttancgctactcgtgaggccgatcacatcacaganacaacttacaanaacacactatatactacaatacgaacactactagagacgtagacggacacggctgtactattactgtgacgtactagagtattgtcttaacg

SEQ ID NO: 27844 - DNA, 662 bp, Homo sapiens
  misc_feature: GYAE6OF01C0DHU.49.38.D05.1.454.CMB.1.raw
  modified_base (262)..(262): a, c, t, g, unknown or other
  misc_feature (262)..(262): n is a, c, g, or t
  modified_base (306)..(306): a, c, t, g, unknown or other
  misc_feature (306)..(306): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacaggtcgtgggggagcgtggtccagccgtggggacggtccctgacgactctcctgtgcagcctntggtattcgtctctagtgtcctacctatcgccacgtcgggtccnccaggcctccgaggccgaaggggtctagggaagtggggtagctaacgttatctacatcgtaggaagtagggaaggttctagtaaacttcttaagtccgggacccgtaacgttcccgggtagggaaaccggggtcccgtaagtttacccaacccgtaacttcccgtaaccgaagaaacggtaacctaaaccgttacccgaaaacgtaaacctaacctaactttaacttaaacttcctttaaacaaaagttcgtaaaacctaccgttacgtaaggacgtaacggtaggaaaccgaccggtacggtactcgttacctaattacgtgtacgacgtacgtagagttactgttacgttaacg

SEQ ID NO: 27845 - DNA, 590 bp, Homo sapiens
  misc_feature: GYAE6OF01EEMEI.49.38.D05.1.454.CMB.1.raw
  modified_base (285)..(285): a, c, t, g, unknown or other
  misc_feature (285)..(285): n is a, c, g, or t
  modified_base (302)..(302): a, c, t, g, unknown or other
  misc_feature (302)..(302): n is a, c, g, or t
  modified_base (352)..(352): a, c, t, g, unknown or other
  misc_feature (352)..(352): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtcgtgggggagcgtggtccagccgtgggacggtccctgagactctcctgtgcagcctctggattcgtctctagtctctaccctntcgcacgtcggggtccnccaggcctccgaggcgaaggggctagggaagtggggtgctacttatcctnatctgagtgggaagtctagaattcttaagtcgccgtacgtccggtaggaacgggtccgtattccacctatcctaccgaagaacaactaacttaccaaagaaccaactaacttaatacttacttaacaaatacgtaaacctaccttacgtaggaacggtacggtaggaacggaccgacggtcgttacgttacttaagttactggtcgacggtactaggaagtattcggttactttaacg

SEQ ID NO: 27846 - DNA, 583 bp, Homo sapiens
  misc_feature: GYAE6OF01CDEH1.49.38.D05.1.454.CMB.1.raw
  modified_base (301)..(301): a, c, t, g, unknown or other
  misc_feature (301)..(301): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (372)..(372): a, c, t, g, unknown or other
  misc_feature (372)..(372): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagccgtgggaggtccctgagactctccgtgtgcagcctctggattcgtctctagtgtctaccctatcgcacgtcgggtccnccaggcctccgaggcaaggggctaggaagtgggtgctacttanctnatctgatggaagtctagaatcttancgaccgtacgtccggtaggaacgggcctattccaccctatcctaccgagacgaactaacttacccaaagaaccaactaactaattactaccttaacaaactcgaaacctactacgtaggaacgtacgtaggacggaccgacggtcgttacggttaccttaagtttcgtcgtacggaccgtacgttaggaagtacgttgttactttaaacgg

SEQ ID NO: 27847 - DNA, 707 bp, Homo sapiens
  misc_feature: GYAE6OF01DLXL3.49.38.D05.1.454.CMB.1.raw
  modified_base (195)..(195): a, c, t, g, unknown or other
  misc_feature (195)..(195): n is a, c, g, or t
  modified_base (305)..(305): a, c, t, g, unknown or other
  misc_feature (305)..(305): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttnatacagtctgggggagcgtggtccagcctgggaggtccctgagactctcctgtgcagcctcgtggattccgtctctaagtcgttctaccctatcgcctacgtgggtcccnccgaggcctccgagggccaaagggggctagggaagtggggtacgcctaacgtttatccgtacaacttctaggtagtagggtaaggttctaggtaaatttccttaagtcccggtaccggtaccgttacccgggtaaggaaccggggtacctaacgttaccgaacctagtaccgttacccgaaggtaacgtaacctaaaccgtttacccgaaaacgtaaacctaacctaaccttaaacgttaccttaaccgtttaacctaaaaacgttaccgtaaaaccctaccgttaccgttaggtaacgggtaaccggttaggaaacgggacccgtaaccggtccgttacggttacttaacgtttacgtaggtacgaccgtacttaggtagtacgttggttactttaaacgg

SEQ ID NO: 27848 - DNA, 607 bp, Homo sapiens
  misc_feature: GYAE6OF01CF15O.49.38.D05.1.454.CMB.1.raw
  modified_base (305)..(305): a, c, t, g, unknown or other
  misc_feature (305)..(305): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgcttcttttaagaggtgtccagtgtcatgtacagttgatacagtcgtgggggagcgtggtccagcctgggagtccctgagactctccgtggtgcagcctcgtggattcgtctctagtgtcctaccctatcgctacgtggggtcccnccaggctccgaggcaaggggctgggaagtggggtgcacttatctcatctgactgggaagtctagaatcttagtcgccggtactccggtaggaacgggtccgtattaccgaccgtatcctaccgaagaacgaacctaaacgttacccgaaagtaaccaacctaacttaacttacttacttaacaaattacgaaacctactacttagaacgtacgtaggacggtaccacgggtacttcggttaccttagttaccgtggttcgacggtacgttaggtacgtagtttcgttcgtttagttaaccgg

SEQ ID NO: 27849 - DNA, 685 bp, Homo sapiens
  misc_feature: GYAE6OF01BGR86.49.38.D05.1.454.CMB.1.raw
  modified_base (302)..(302): a, c, t, g, unknown or other
  misc_feature (302)..(302): n is a, c, g, or t
tcagagtcgagagacacgaccggtgctcgatttagtatctgatagttggctctgggagacgagcccagcactggagtcgccggtgtttccattcggtgatcatcactgaacacagaggactcaccatggagtttgggctgagcttgggttttcctcgttgctcttttaagaggtgtccagtgtcatgtgcagttgatacagtcgtgggggagcgtggtccaggcctgggagtccctgagctctcctgtgcagcctcgtggatttctctctagtgtcctacctatcgctacgtcggggtcccnccgaggcctccgagggcgaagggggtctagggaagtcggggtaggcctaacgtttactccgtactacgttcgtaggaagttacggggtaaaggttccttagggtaaactttccgttaagtccggtaccccgttaacgttccccgggtaagggaaccgggtcccgtaacgtttacccgaaacctacgttcccgtaaccgaaggtaaccggtaaaccttaaacgtttaacccgaaaacgtaaaccctaacctaacgttaaacttaacgttacccttaaactaaacgtaccgtaaacctacgttacgtacgaacggtacgtaggtacgaccgtacggtctacgttactagttcgtgtacgacgtacgtagagtattcgtcttaacg

SEQ ID NO: 27850 - DNA, 618 bp, Homo sapiens
  misc_feature: GYAE6OF01BKSXZ.49.38.D05.1.454.CMB.1.raw
  modified_base (258)..(258): a, c, t, g, unknown or other
  misc_feature (258)..(258): n is a, c, g, or t
  modified_base (342)..(342): a, c, t, g, unknown or other
  misc_feature (342)..(342): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtcgtgggggagcgtggtccagccgtgggaggtccctgagactctcctgtgcagcctntggattcgtctctagtgtctaccctatgcacgtgggtccgccaggcctccgaggcaaggggctgggaatggggtgctacgttanctcatctagagtggaagtctagaacttcgttagcgacccgtacgttccggtaggaacgggccgtattcccaacccgtattcccgtaccaaggaacgtaacctaacttaacccgaaaagtaaccaacctaactttaactacttaccgtttaaccaaaagttcgtaaaacctcgttacgtaaggtacgtacggtacggaacggacccgaacgggtcttaggttaccttaagtttaccgtggtaggacctagtacggaaggtactttggttacttaacg

SEQ ID NO: 27851 - DNA, 776 bp, Homo sapiens
  misc_feature: GYAE6OF01CF933.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcttgggttttcctcgttgctcttttaagaggtgtccagtgtcatgtgcagttgatacagtcgtgggggagcgtggtccagcctggggagtccctgagactctcctgtgcacgccttcgtgggtactttccggtcttcgttagttcgttcccttacccctagtcgcctacggttcggggtccccgccgaggcctaccggagggcgaaagggggtctagggaagtgggggtacggctaacctttagtcctacgtacttcgtaggaagttacgggtaaaggtttctagtaaactttctttaaggtcggacccgttaccgttacccgggtacgggaaaccgggtacccttaaacgtttcccaaacccgtacttacccgtaacccgaaaggtaaccgtaaaccttaaacgtttaaccccgaaaacggtaaacccaaacttaacccttaaatttaacttaccctttaaacgtaaacgttaacggtaaccctaaccgtttaccgtaacggtaaccggtaaccggttaagggaaccgggtaaccgtaaccggtccgtttacggtttacctttaacgtttaccgttgggttaccaccgggttaacgttagggtaacgttaacgttgtttaccgtttaaacgg

SEQ ID NO: 27852 - DNA, 274 bp, Homo sapiens
  misc_feature: GYAE6OF01EWVRT.49.38.D05.1.454.CMB.1.raw
  modified_base (269)..(274): a, c, t, g, unknown or other
  misc_feature (269)..(274): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttccccctggcgccctgctccaggagcacctctgggggcacagcggccctgggctgcctggtcaaggactacttcctctctcgactctgagcgggctggcaaggcgcatagnnnnnn

SEQ ID NO: 27853 - DNA, 776 bp, Homo sapiens
  misc_feature: GYAE6OF01CRKQG.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagaggactcacatggagtttgggctgagtcgttgggttttcctcgttgcttacgttttaagaggttgtcctagtgtcatgtgctagttgatacgaggtcggtgggggagtcgtcggtccaggtccgtggggacgtcccgtagacgtacttccgtcgtgtcgacgtacgtccttcggtggtaactttcggtcctacgttaggttcgtacccttaaccctagttcgaccgtacggttcgggtcccgaccgacggtcctacggacggacgggtaacggggtctagggtaagtcgggggtctaccttacgtttactccgacgtatacggtaggaacgttgggtaaacgtttcgtaagtaacgtttcgttacgaccggtacccgttaacggttcccgggtaaaggaacccggggtccttaacgttaccccgaacttacgttacccgtaaaccggaaggtaaacctaaacgttaaaccgtaaccgaaaacgaacccttaacgttaacttaaatttaacgtttaacctaaacctaaacgtaaccgtaactaccgtttagaacggtacgtaacggtacggaaccggtacgtaccggttcgttacgtaactttacgtaccggtggtacgtacgtaacgtaggtaattacggtttacgttacgtttaacggg

SEQ ID NO: 27854 - DNA, 223 bp, Homo sapiens
  misc_feature: GYAE6OF01EEHKO.49.38.D05.1.454.CMB.1.raw
  modified_base (219)..(223): a, c, t, g, unknown or other
  misc_feature (219)..(223): n is a, c, g, or t
tcagagtcgagagacacgaccggtgctcgatttagtatctgatagttgggtttgggggaagaggaagactgacggtcctcccaggagttcaggtgctgggcaccgtgggcatggggggaggtgtgtcacaagatttgggctctgggcacagcggccctgggctgcctggtcaaggactactcctctctcgactctgagcgggctggcaaggcgcatagnnnnn

SEQ ID NO: 27855 - DNA, 637 bp, Homo sapiens
  misc_feature: GYAE6OF01AI41I.49.38.D05.1.454.CMB.1.raw
  modified_base (307)..(307): a, c, t, g, unknown or other
  misc_feature (307)..(307): n is a, c, g, or t
tcagagtcgagagacacgaccggtgctcgatttagtatctgatagttggctctgggagacgagcccagcactggaagtcggccggtgtttccattcggtgatcatcactgaacacagaggactcaccatggagtttgggctgagcttgggttttcctcgttgcttcttttaagaggtgtccagtgtcatgtgctagttgatacagtcgtgggggagcgtggtccagccgtgggacgtccctgagctctccgtgtgcagcctcgtggtattcgtctcttagtgtcctacctatcgctacgtcggtccnccaggtcctccgaggcggaaggggctagggtaagtggggtacgacttacttactcctacagttcgtaggtagtgggaacggttctagtaactttcgttaagtcggacccgtacgtccggtaggaaaccgggtcccgtaattacccacctacttccgtaaccgagaacgtaacctaacgtaccaaacgaactactaacttaattacttaccgtaacaaacgtcgtaacctacctgtacggaactacgggtagacggtaaccctcggtactttcgtactttaacgttcgtcggtacgccgtaagtacggaagtttcttagtttcgttaaacg

SEQ ID NO: 27856 - DNA, 771 bp, Homo sapiens
  misc_feature: GYAE6OF01DEK9Z.49.38.D05.1.454.CMB.1.raw
  modified_base (174)..(174): a, c, t, g, unknown or other
  misc_feature (174)..(174): n is a, c, g, or t
  modified_base (322)..(322): a, c, t, g, unknown or other
  misc_feature (322)..(322): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcttgggttttcctcgttgcttcttttaaggnggtgtccagtgtcatgtgctagttgatacgaggtcgtgggggagcgtggtcaggccgtggggacgtcctgagactccgtctgtcgcacgcctcgtggtacttcgtctcgtaggttctacctacctagtcgcctacggttcgggtcccncgacggtcctacgagggaccgaagggggtcgtaggggtaacggtcgggggtacgtaccttacgtttaagtcctacgtacttcggttaggaaggtacggggtaacggttacgtagttaaactttaccgtttaggacccgggtaccccggttaacggtcccgggttaaggggtaaaccccgggtcccgtttaaacgtttccccgaaaacccgttaccgttaaccccgtaacccgggaaaggtaaacccgtaaacccttaaaaccgttaaccccgaaaaacgttaacccaaacgtttaaaccttaacgtttaactaaccttaaaacgtaaactaccggaaaacccttcgtacgtaggtaacggtacggtaggaacgccggtaaccgtcttaccggtactttacgtcgtaggttacccgagttacgtagaacgtttcgtttgtaacgtttacg

SEQ ID NO: 27857 - DNA, 655 bp, Homo sapiens
  misc_feature: GYAE6OF01CF5R2.49.38.D05.1.454.CMB.1.raw
  modified_base (168)..(168): a, c, t, g, unknown or other
  misc_feature (168)..(168): n is a, c, g, or t
  modified_base (172)..(172): a, c, t, g, unknown or other
  misc_feature (172)..(172): n is a, c, g, or t
  modified_base (317)..(317): a, c, t, g, unknown or other
  misc_feature (317)..(317): n is a, c, g, or t
  modified_base (371)..(371): a, c, t, g, unknown or other
  misc_feature (371)..(371): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagttgggctgagctgggtttcctcgtgctcttttaagnggtntccagtgtcatgtgcagttgatacagtcgtgggggagcgtggtccaggccgtggggacggtccctggacgtacctctccgtgtacgcacgcctcgtggacttcgtcgtctagtcgtcctaccctatcgactacgtcggggtcccncctaggcctacgagggtaccgaaggggctagggaagtgggtcggctacttatcncgtatcgtagagtggtaaggtctagtaacttcttaagcgtaccgtacgtccggtagggaacggtccgtacttaccaaccgtactcctaccgaaggaacctaactaaacttaccgaaactaactaacctaattaaactaacttacgtaaacctaaagtaaccggtaaaacctccgtaacgttacggaacggtacccgtaagggaaccggtaaccgacgggttccttagttactaacgtttacgtagtccgtacgtaccgtagaaggttcttggttacttaaacgg

SEQ ID NO: 27858 - DNA, 790 bp, Homo sapiens
  misc_feature: GYAE6OF01CGOXT.49.38.D05.1.454.CMB.1.raw
  modified_base (206)..(206): a, c, t, g, unknown or other
  misc_feature (206)..(206): n is a, c, g, or t
  modified_base (313)..(313): a, c, t, g, unknown or other
  misc_feature (313)..(313): n is a, c, g, or t
tcagagtcgagagacacgaccggtgctcgatttagtatctgatagttggctctgggagacgagcccagcactggaagtcgccggtgtttccattcggtgatcatcactgaacacagaggactcacatggagtttgggctgagcttgggttttcctcgttgcttcgttttaaggaggtgtccagtgtcagtgtgctagttgatacgnggtcgtgggggagcgtggtccaggccgtgggacgtcctgacgctctctgtgcagtcctgtggattcgtctcgtagtcgttcctacctatcgcctacgtcgggtcccnccgaggtccctaccggaggtaccgggaaagggggtctagggaacggttgggggacggtaccttaacggttactccgtacgtaagttccgtaggaagtaggggtaacggttcttaagtaaactttcgttaacgccgggacccgttaaccgtccgggtaaggaacccggggtccctaacttaccgaacctacttacccgtaccgaaaggtaaccgaaacttaaaccgttacccgaaaaagtaaccctaacgttaattaaactacctttaaccctttaaaacaaaccgttaccgaaaaacccgtttccgttaacggttaaccgggaacggtttaaccgggaaggggtaacccggaaacccgttaccggggtacttttacgggttaacccttttaagttaccgggttccggttcggaaaccccggttaaaggttaacgggaggtttttaaaccttccggggttttaaattttaacccgggg

SEQ ID NO: 27859 - DNA, 801 bp, Homo sapiens
  misc_feature: GYAE6OF01CWCHO.49.38.D05.1.454.CMB.1.raw
  modified_base (115)..(115): a, c, t, g, unknown or other
  misc_feature (115)..(115): n is a, c, g, or t
tcagagtcgagagacacgaccggtgctcgatttagtatctgatagttggctctgggagacgagcccagcactggaagtcgccggtgtttccattcggtgatcatcactgaaaacngaggactcaccatggagtttgggctgagcttgggttttcctgttgcttcttttaagaggtgtccagtgtcagtgtgctagttgatacgagtcgtggggggagcgtggtaccaggccgtggggacgtccctaggacgtcttcctccgtgtcgcacggtccctgtggatttccgtcttctagttcgtacctacctagtcgactaccggttcgggtccccaccgagggtcctacccgggaaggggcggtaaaacggggggtcttagggggaaagttcggggggtacgtacctaacgtttactccgtactaacgtttccgtagggaacgtttaggggaacggttctaacggtaaatttccgtttaaggccggtaacccgtaccggttccggtaacgggtaaccgggtccgtaacgttaccgtaaccctacgtccctaaccgaacggtaacgtaacctaacgttaaccgaaacgtaacccgttaaccgttacgtaacctaaccttaaccgtaaacctaaacgttaccgtaacctaacggtaacgttaccggtaacggtaccgaacccggtaaggtaaacgggtaccggtaccggtacggttggttaacgttacgtttacgggttagggtacgggtaacgggggtaagggggttaagggttacggttttacggacgttacgggttaacccgg

SEQ ID NO: 27860 - DNA, 800 bp, Homo sapiens
  misc_feature: GYAE6OF01CK2YN.49.38.D05.1.454.CMB.1.raw
  modified_base (172)..(172): a, c, t, g, unknown or other
  misc_feature (172)..(172): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttggctgagcttgggttttcctcgttgcttcttttaagnggtgtccagtgtcatgtgcagttgatacgaggtcggtgggggaggcgtggtccgaggccgtggggacggtcccgtgacgacctcctccgtggtcgccgacgccgttcgtggtactttccggtcttcgtaggttcgtccctaccctagtcgcctacggtccgggtcccgccgacggtccctaccggagggtaccggaaagggggtccgttaggggtaacggttgggggtacggtaccttaacgtttacgtcctacgtacgttcgtaggtaacggttacggggaaacggtttccgttaaggtaacgtttaccgtttaggtccggtaccccggttaccggttcccgggtaacgggaaacccggggtcccgttaactttaccccgaacccgttaccgttcccgtaacccgaaggtaacccgtaaaccttaaacccgttaacccgaaaacggaaacccttaaacctaactttaaacttaacgtttaacccttaaactaaacgtaacgaaacccttaaccgttacgtacggaacgtacggtacggaaccggaccgtaaccggttcgttacgttacgttaacgttcgttcggtacgaccgttaacgaggttaagtacgtttcgttaatttaacgg

SEQ ID NO: 27861 - DNA, 588 bp, Homo sapiens
  misc_feature: GYAE6OF01BW6RR.49.38.D05.1.454.CMB.1.raw
  modified_base (239)..(239): a, c, t, g, unknown or other
  misc_feature (239)..(239): n is a, c, g, or t
  modified_base (474)..(474): a, c, t, g, unknown or other
  misc_feature (474)..(474): n is a, c, g, or t
  modified_base (496)..(496): a, c, t, g, unknown or other
  misc_feature (496)..(496): n is a, c, g, or t
  modified_base (502)..(502): a, c, t, g, unknown or other
  misc_feature (502)..(502): n is a, c, g, or t
  modified_base (510)..(510): a, c, t, g, unknown or other
  misc_feature (510)..(510): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcggtggtttcgtcgtagctcttagaggtgtcagtgtcatgtgctagttgatacagtcgtgggggagcgtggtccagccgtgggacggtccctgganaccgtctcctggtacgcaactccgtcgtaggtactttccgtctctaggttcgtcctaccctagtcgctaccgtggtcccgacgaggtcctcgaggcgagggtcgtaggagtcggggtcgctacgttatctacattcgtaggagtaggtaagtctaagtacttcgttagcgtaccgacgttccggaggaaccggtctaacttccaacgtctacgtacaaggacactaactcgaaanacctatactacgtattactaanaacttnaaaccgtntacgagacgtacgacgaacgtcgacgttcgtagttactacggtcgtagtaccgtacgtgtacgattcttacgtctacg

SEQ ID NO: 27862 - DNA, 551 bp, Homo sapiens
  misc_feature: GYAE6OF01C368T.49.38.D05.1.454.CMB.1.raw
  modified_base (171)..(171): a, c, t, g, unknown or other
  misc_feature (171)..(171): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
  modified_base (434)..(434): a, c, t, g, unknown or other
  misc_feature (434)..(434): n is a, c, g, or t
  modified_base (471)..(471): a, c, t, g, unknown or other
  misc_feature (471)..(471): n is a, c, g, or t
  modified_base (490)..(490): a, c, t, g, unknown or other
  misc_feature (490)..(490): n is a, c, g, or t
  modified_base (534)..(534): a, c, t, g, unknown or other
  misc_feature (534)..(534): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagnggtgtccagtgtcatgtgcagttgatacagtcgtgggggagcgtggtccagccgtgggacggtccctgacgactctcctgtgcagcctcgtggacttcgtctctaggttcgtcctacccctatcgctaccgtggggtccctcgaggtcctccgagggcgaaaggggctagggatggggtgctacttatctctatcgngagtgggaagtcngtaatcttatcgaccgtatcggtaggacggccgtatccactatcctacgaganaactaactaccaagaacactatatatctaacaaagtnaactctacgtagagtacgnggaagacgacggacttgtacttagttcgtggtacgacgtactanaggtattgttacttaag

SEQ ID NO: 27863 - DNA, 708 bp, Homo sapiens
  misc_feature: GYAE6OF01CY43T.49.38.D05.1.454.CMB.1.raw
  modified_base (320)..(320): a, c, t, g, unknown or other
  misc_feature (320)..(320): n is a, c, g, or t
tcagagtcgagagacacgaccggtgctcgatttagtatctgatagttggctctgggagacgagcccagcactggaagtcgccggtgtttccattcggtgatcatcactgaacacagaggactcacatggagtttgggctgagtcttgggttttcctcgttgcttacttttaaggaggtgtccagtgtcatgtgctagttgaatacaggtcgtgggggagcgtggtccagccgtgggacggtcctgacgactctcgtgtgcagcctcgtggtacttcgtcttactagttcgtcctaccgtatgacctacgttcgggtcccnccgacggcctaccggaggacggtaaacggggtcgtaaggggaacgttgggggacgtacctaactttacgtcccttactagtacttggtaagttcggggtaaaggttccttaagtaaaccgtttacgtttaagacggtacccggtaacgtccggtaacgggtaacgggtaccgttacttaccgacccttaacgtacctaaccgaagtaacgtaactaaacgttaaaccaaacgaaccgtaaactaacttaacttaacttacctttaacaaactacgtaaacctaccgttactaggtacgtaacggtacggaacggaccgaacggtcgtacgttacgttaactttacggtcgtacggaaccgtacgttagtagtattacgttagttaacg

SEQ ID NO: 27864 - DNA, 799 bp, Homo sapiens
  misc_feature: GYAE6OF01B1I2M.49.38.D05.1.454.CMB.1.raw
  modified_base (245)..(245): a, c, t, g, unknown or other
  misc_feature (245)..(245): n is a, c, g, or t
tcagagtcgagagacacgaccggtgctcgatttagtatctgatagttggctctggggagacgagcccagcactggaagtcgccggtgtttccattcggtgatcatcactgaacacagaggactcaccatggagtttgggctgagtcttggggtttttcctcgttgcttcttttaaggaggtgtccagtgtcatgtgcagttgatacaggtcgtgggggagcgtggtccagccgtgggacgtcccngacgtctctcgtgtcgctacgcctgtggtacttccgtcttccttagtcgttacctaacccttagtccgacctacggtccggggtccccgaccggtacgggcccttaccggacggggtacggaaacggggtcgtagggtaaggttcggggtaggtcctaaccgtttatccgtacgtaacttcgtaggtaacggttacgggtaaggttcctagttaactttcgttacgtacggtaccccgttaacggttcccgggtaagggaaaccccggggtccgttaacttacccgaaccccgtaacttccccgtaaacgacggaaactaacccgtaaaacttaacccgaaaacgtaacctaaaccttaacttaaacgtttacctttaacccgttaaacgtaaaacgtaccgtaaaacccttaccgttaacggtggtaaacccggtacgggaaccggttaaaggaccccggtacggtacgtttaacgtaccggttttaacttaccgttcgggtaaccgtaccggttaagtacggtaattaacggtttcgtttacgtttaaacgg

SEQ ID NO: 27865 - DNA, 653 bp, Homo sapiens
  misc_feature: GYAE6OF01BPAA7.49.38.D05.1.454.CMB.1.raw
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
  modified_base (618)..(618): a, c, t, g, unknown or other
  misc_feature (618)..(618): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcttgggttttcctcgttgcttcttttaagaggtcgtccagtgtcatgtgctagttgatacaggtcgtgggggagcgtggtccagccgtgggacgtccctgagactctccgtgtcncagcctgtggtacttcgtctctagtntacctacctatcgcctacgtcgggtcccgccgacggtctccgaggccgaaggggtctagggtaagtggggtgacctaacgttctaccgtctacgttcgtaggtaacgttagggtaaggttcctaaggtaacttcgttacgccgtacccggttacgtccggtaagggaaccgggtccgtacttacccacccgtactaccgtacgaacgtaacctaaccgtaaacttacccaaagaacctaacgtaaacttacttacttaaccgttaaacaaactaccgtaactccgttacgtacgacggtacgacggaacggaccgacgtgtcttactagttacngttacgacgtacggtatacgtattcgttaagttac

SEQ ID NO: 27866 - DNA, 579 bp, Homo sapiens
  misc_feature: GYAE6OF01DMUMV.49.38.D05.1.454.CMB.1.raw
  modified_base (175)..(175): a, c, t, g, unknown or other
  misc_feature (175)..(175): n is a, c, g, or t
  modified_base (309)..(309): a, c, t, g, unknown or other
  misc_feature (309)..(309): n is a, c, g, or t
  modified_base (328)..(328): a, c, t, g, unknown or other
  misc_feature (328)..(328): n is a, c, g, or t
  modified_base (408)..(408): a, c, t, g, unknown or other
  misc_feature (408)..(408): n is a, c, g, or t
  modified_base (472)..(472): a, c, t, g, unknown or other
  misc_feature (472)..(472): n is a, c, g, or t
  modified_base (491)..(491): a, c, t, g, unknown or other
  misc_feature (491)..(491): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatgggagtttgggctgagtcttgggttttcctcgttgcttcttttaagnggtgtccagtgtcatgtgctagttgatacgagtcggtgggggagcgtggtccaggccgtggggacgtccctggacgtaccttcgtcctggtacgcacgtcctcgtggtacttcgtctcgtagtctcctaccctntcgctacgtcggggtcccnccgaggccctacggaggcgaggggctagggagtgggtcgactacttatctctagtcgtagagtcggaaggttcagtactnttagcgtaccgtagtccggtagacggtcctatccactctacacgagactaactaactaccgaanaacacactatactactaanactacgaactacgtactagtacgagtagacgacgtacgtcgttgtacttattacgtcgtacgtacgtatagagttcttgttgttaacg

SEQ ID NO: 27867 - DNA, 281 bp, Homo sapiens
  misc_feature: GYAE6OF01A4ZVL.49.38.D05.1.454.CMB.1.raw
  modified_base (268)..(281): a, c, t, g, unknown or other
  misc_feature (268)..(281): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttcccctggcgccctgctccaggagcacctcgtgggggcacagcggccctgggctgcctggtcaaggactacttcctctctcgactctgagcgggctggcaaggcgcatgnnnnnnnnnnnnnn

SEQ ID NO: 27868 - DNA, 991 bp, Homo sapiens
  misc_feature: GYAE6OF01ELO9K.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagagactcaccagtggagtttgggctggagtcgttggggtttttccctcgttgtcttacgtttttaaggagggttcgtacccgtaggttgtacctagttgggttcgtcgtaaggtttcggaaacttaaccggtagggttaccgggtgggggggggtaacggtccggtttccggggtacccctaacggggtcccggttgggggggtaacccgtccccgttagggaccgtaccgttccgttcccgttacggtcgacgtacggtcccttccggttggtacttccggttctacgttagtccgttaccttaccctagtccggtacccgtacggttccggggtacccgccggtacggtcccgtaccggaggggtaccggtaaggggtccgtaagggtaaacggttccgggggttacgacccttaacgtttaccgtccgttaacgtaccgttagtacgggtacggttaaacgggggttactccgtttaaaggtaccttttacggttaccggtcccggtaacccggttaccggtttacccggggtaacggggttaacccgggtaaccgttaaccgttacccgtaaacccgtacgttaacccctaaccgttaaaccggtaaccgtaaacccttaaaccggttaaacccaaacggtaacccctaattaaccggtttaaacttaacgttccttaaactaaaccgtaaccgttaaacgtcccttaacggtaacgggaaccggttaaccgggtaacgggtaacccggaaaccggttaccggtaccgggttttaacgttaaccctttaacgggtttaccgtacgggttaacccggttaccggttaagttacccgggttaagtttaaccgtttggttaaaccggtttaaacg

SEQ ID NO: 27869 - DNA, 753 bp, Homo sapiens
  misc_feature: GYAE6OF01EPOS1.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtcgtgggggagtcgtggtccagccgtgggagtccctgagactctccgtgtgcacgcctcgtggattcgtctctagtgtcctaccctatcgctacgtcggggtcccgccgaggtcctaccgagggaccgaaagggggccttaggggaaacgttcgggggtaggtccctaacgtttatccttacgaattccgtaggtaagttaggggtaacgttcgtaacggtaaatttccgttaacgtcggtaccccggtaccgttcccgggtagggtaaaccggggtccgtaacgtttacccgaacccgtacttccgtaaccgaaggtacgtaaaccgtaaactttaacccgaaaacgtaaaccctaacgttaaccttaagttaaccttaccgtttaaaccgtaaaacgttaacgggtaaaacccttaccttaaccggtacgggtaacggtaaccgggtaacgggtaaaccgggaaccgtaccgggttacgttacccggttaacttaaccgttacgttacgtacgaccggtaacgtagtaagtcgttacgttcgtttaaacg

SEQ ID NO: 27870 - DNA, 712 bp, Homo sapiens
  misc_feature: GYAE6OF01BKHLF.49.38.D05.1.454.CMB.1.raw
  modified_base (259)..(259): a, c, t, g, unknown or other
  misc_feature (259)..(259): n is a, c, g, or t
  modified_base (314)..(314): a, c, t, g, unknown or other
  misc_feature (314)..(314): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatgggagtttgggctgagcttgggttttcctcgttgcttcttttaagaggtgtccagtgtcatgtgctagttgatacaggtcgtggggggagcgtggtccagccgtgggacgtccctgagcctctcctgcgcncgtcctgtggtattccgtctcgtagtcgtcctacctatcgcacggtcgggtcccnccgaggcctcggagggacgaggggcgttagggagttcggggtcgactacgtttacgtcctactagttcgtaggtaggtacgggtaaggtctaaggtaactttcggtagtccggtacccgttacgttccgggaacggtaacgggccccttaagttacccaaccctatacccgtaaccgaaggaaccgtaaactaacgttacccgaaaacgaacctaactaaccttaattaacctttaactaactaaacgtactaacccttacgttacgtaaggaacgtaccgggtaaggaaaccggtacccgtaaccggggttcttacgggtttaacccttaggttaacccgtgggttaacccgaaccggttacgtacgttaagttaccgttttgttaaccggtttaac

SEQ ID NO: 27871 - DNA, 273 bp, Homo sapiens
  misc_feature: GYAE6OF01ETMYN.49.38.D05.1.454.CMB.1.raw
  modified_base (266)..(273): a, c, t, g, unknown or other
  misc_feature (266)..(273): n is a, c, g, or t
tcagagtcgagagacacgaccggtgctcgatttagtatctgatagttgggtttggggtgctcgatttagtatctgatagttgggtttgggggaggtgtgtcacaagatttggccctggtcaccgtctcctcagcttccaccaagggcccatcggtcttcccctggcgccctgctccaggagcacctctgggggcacagcggccctgggctgcctggtcaaggactacttcctctctcgactctgagcgggctggcaaggcgcatgnnnnnnnn

SEQ ID NO: 27872 - DNA, 279 bp, Homo sapiens
  misc_feature: GYAE6OF01D503X.49.38.D05.1.454.CMB.1.raw
  modified_base (268)..(279): a, c, t, g, unknown or other
  misc_feature (268)..(279): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttccccctggcgccctgctccaggagcacctcgtgggggcacagcggccctgggctgctggtcaaggctacttcctctctcgactctgagcgggctggcgaaggcgcatannnnnnnnnnnn

SEQ ID NO: 27873 - DNA, 713 bp, Homo sapiens
  misc_feature: GYAE6OF01DBNDU.49.38.D05.1.454.CMB.1.raw
  modified_base (172)..(172): a, c, t, g, unknown or other
  misc_feature (172)..(172): n is a, c, g, or t
  modified_base (319)..(319): a, c, t, g, unknown or other
  misc_feature (319)..(319): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttggccctgagctgggttttcctcgttgctcttttaagnggtgtccagtgtcatgtgcagttgatacgaggtcgtgggggaggcgtggtccaggcctggggacggtccctgacgtactctctgtgcagcctcgtaggtacttcgtctactagtacgtactaccctatgaccacgttcggggtcccncgacggcctccgaggcgaaggggtctagggaagtggggcgactacgtttatcctacgtaattcgtagtagttagggaacggttcctaggtaaacttcgtttaagtccgggacccgttacggttaccgggttaacggggaacccggggtacccttaacgtttacccgaaacccgttacgttaccccgtaacggaacgtaacggtaacctaaaccttacccgaaaagtaaaccctactaacttaactacttaaccgttaactaaactaacgtaaactccttacgtaggtacgtaacggtaggaacggaaccgtcggtaccgttcgtaacttttaaacgttaccggcggttacggacggttactaagggttagtaactttgggttaccctttaaagg

SEQ ID NO: 27874 - DNA, 565 bp, Homo sapiens
  misc_feature: GYAE6OF01CBW10.49.38.D05.1.454.CMB.1.raw
  modified_base (306)..(306): a, c, t, g, unknown or other
  misc_feature (306)..(306): n is a, c, g, or t
  modified_base (356)..(356): a, c, t, g, unknown or other
  misc_feature (356)..(356): n is a, c, g, or t
  modified_base (391)..(391): a, c, t, g, unknown or other
  misc_feature (391)..(391): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcttgggttttcctcgttgctcttttaagaggtgtccagtgtcatgtgcagttgatacagtcgtgggggagcgtggtccagccgtggggacgtccctgagactctcctgtgcagcctctggattcgtctctagttcgtctacccctagcgcacgtggggtcccnccgagggcctcgaggcgaagggggctagggaagtggggtcgctactttanctcattctgacgtgggaagtctagtaattcgttancggaccgtacgtcgtaggacgggcctattccgacctatcctacagacaactaacttaccgaagaaccactactaatactactaacaatacgaactactcgtagacgacgtggacgaccgacggtcttcgtacttacgttcgttaggtgacgtacgtgagtctgttctttaaacg

SEQ ID NO: 27875 - DNA, 286 bp, Homo sapiens
  misc_feature: GYAE6OF01BHYCE.49.38.D05.1.454.CMB.1.raw
  modified_base (61)..(61): a, c, t, g, unknown or other
  misc_feature (61)..(61): n is a, c, g, or t
  modified_base (261)..(261): a, c, t, g, unknown or other
  misc_feature (261)..(261): n is a, c, g, or t
  modified_base (264)..(264): a, c, t, g, unknown or other
  misc_feature (264)..(264): n is a, c, g, or t
  modified_base (267)..(286): a, c, t, g, unknown or other
  misc_feature (267)..(286): n is a, c, g, or t
tcagagtcgagagacacgaccggtgctcgatttagtatctgatagttgggtttgggggtgntcgatttagtatctgatagttgggtttgggggaggtcgtgtcacaagatttgggccctggtcaccgtctcctcagcttccacaaggcccatcggtcttcccctggcgcctgctccaggacgcacctctgggggcacagcggccctgggctgcctggtcaaggctacttcctctctcgactcgtgagcgggctggcaggcncanagnnnnnnnnnnnnnnnnnnnn

SEQ ID NO: 27876 - DNA, 315 bp, Homo sapiens
  misc_feature: GYAE6OF01BZ6I0.49.38.D05.1.454.CMB.1.raw
  modified_base (172)..(172): a, c, t, g, unknown or other
  misc_feature (172)..(172): n is a, c, g, or t
  modified_base (186)..(186): a, c, t, g, unknown or other
  misc_feature (186)..(186): n is a, c, g, or t
  modified_base (193)..(193): a, c, t, g, unknown or other
  misc_feature (193)..(193): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (285)..(315): a, c, t, g, unknown or other
  misc_feature (285)..(315): n is a, c, g, or t
tcagagtcgagagacacgaccggtgctcgatttagtatctgatagttgggtttggggtgctcgatttagtatctgatagttggggtttgggggaggtgtgtcacaagatttgggccctggtcaccgtctcctcagcttccaccgaagggcccatcggtcttccccctggccncctgctccgaggancactcgngggggcacagcggccctgggctgccgtggtcgaacggtactaccttcctctctacgactctggacgcgggcctaggacgagggcnctaangnnnnnnnnnnnnnnnnnnnnnnnnnnnnnnn

SEQ ID NO: 27877 - DNA, 279 bp, Homo sapiens
  misc_feature: GYAE6OF01BVW5B.49.38.D05.1.454.CMB.1.raw
  modified_base (264)..(264): a, c, t, g, unknown or other
  misc_feature (264)..(264): n is a, c, g, or t
  modified_base (269)..(279): a, c, t, g, unknown or other
  misc_feature (269)..(279): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttcccctggcgccctgctccaggagcacctctgggggcacagcggccctgggctgcctggtcaaggactacttcctctctcgactctggagcgggctggcaagggcncatgnnnnnnnnnnn

SEQ ID NO: 27878 - DNA, 666 bp, Homo sapiens
  misc_feature: GYAE6OF01AM5PW.49.38.D05.1.454.CMB.1.raw
  modified_base (197)..(197): a, c, t, g, unknown or other
  misc_feature (197)..(197): n is a, c, g, or t
  modified_base (253)..(253): a, c, t, g, unknown or other
  misc_feature (253)..(253): n is a, c, g, or t
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
  modified_base (645)..(645): a, c, t, g, unknown or other
  misc_feature (645)..(645): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatgggagtttgggctggagcggtggtttccgtcgttaggcttacttttaagaggtgtccagtgtcatgtgntagttgactagaggtcggtggggggagtcggtggtccaggccgtggggacgtcccnggaccgtctctccgttgngcncgtctcgtggtacttcgtctctagttcgtactaccgtatcgcgtacggtcggtccgccgacggcctaccgacgggacggaggggcggttagggaaggtcggggcggtactacttactcacctagtcctaggtagtacgggaacgttacgtaggttaacttacgttacgaccggtacccggtacgttaccggaacgggtaccgggaccttactacccgtaccacttccaaccgtaagaacgtaactaactaaccgaaacgtaaccaacttaactaattaacttactaaacgtaactaacgtaacgtactacgtagacggtaacgcgtacgtaacgtcgtaacgttcgtagttacgtgtacgtacgaggtacngtaattcgttggttccttaag

SEQ ID NO: 27879 - DNA, 698 bp, Homo sapiens
  misc_feature: GYAE6OF01D14CF.49.38.D05.1.454.CMB.1.raw
  modified_base (180)..(180): a, c, t, g, unknown or other
  misc_feature (180)..(180): n is a, c, g, or t
  modified_base (278)..(278): a, c, t, g, unknown or other
  misc_feature (278)..(278): n is a, c, g, or t
  modified_base (668)..(668): a, c, t, g, unknown or other
  misc_feature (668)..(668): n is a, c, g, or t
  modified_base (678)..(678): a, c, t, g, unknown or other
  misc_feature (678)..(678): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctggagtcgttgggttttcctcgttgtcttacttttaaaggnggtgtccagtgttcatgtgctagttgatacgaggtcggtgggggagtcggtcggtccaggtcgtggggcgtccctaggctacctcgttcctggtcgcncgtctcggtgtacttccggtctcgttagtcgttacctacccgtagtgaccgtacggttccgggtaccccgccgtaagggtcccctacggaacgggtaccggtagggggtctaggggtaacgtcgggggtcgtacttacttacgtccgtactacgtcgtggtaacgtagggtacgttcgtaaagtacttacgttacggtcccgacccggttaaccggtccgggtaacgggaccgggtacttacctaccgactacgtccctaacgacgaacgtactaacgtaacctaaacgtaacctacgttaacttaactacgtacctaactaataacctacctatacgacgtacgtacggacgtacggtacctacggtcgttactacttagtcgttcganaccggttagngtaacgttctgttactaacg

SEQ ID NO: 27880 - DNA, 575 bp, Homo sapiens
  misc_feature: GYAE6OF01C2LHP.49.38.D05.1.454.CMB.1.raw
  modified_base (100)..(100): a, c, t, g, unknown or other
  misc_feature (100)..(100): n is a, c, g, or t
  modified_base (173)..(173): a, c, t, g, unknown or other
  misc_feature (173)..(173): n is a, c, g, or t
  modified_base (177)..(177): a, c, t, g, unknown or other
  misc_feature (177)..(177): n is a, c, g, or t
  modified_base (355)..(355): a, c, t, g, unknown or other
  misc_feature (355)..(355): n is a, c, g, or t
tcagagtcgagagacacgaccggtgctcgatttagtatctgatagttgggctctgggagacgagcccagcactggaagtcgccggtgtttccattcggtnatcatcactgaacacagaggactcaccatggagtttgggctgagcttgggtttcctcgttgctacttttaagnggtntccagtgtcatgtgcagttcgatacagtcgtgggggagcgtggtccagccgtgggacgtccctgacgtactctctgtgcagcctgtggtacttcgtctactagtcgtactacctatcgctacgtgggacccgaggcctccgaggtcgaaggggtctaggaagtggggcgctaactttntctacattcgtagacgtggaacgttcagtaacttcttaagcgaccgtcgtaccgtaggacggtaccgtatcgacctatctaccagtacgaactaactaccaagaacactaatatattactaacaaagtcgtaactactgtaaggacgtacggtagaacggcaacgggtcttacgtacttagttacgtggtaccacgtacgtagtgtagtcttacgtaacg

SEQ ID NO: 27881 - DNA, 798 bp, Homo sapiens
  misc_feature: GYAE6OF01ER19J.49.38.D05.1.454.CMB.1.raw
  modified_base (260)..(260): a, c, t, g, unknown or other
  misc_feature (260)..(260): n is a, c, g, or t
  modified_base (282)..(282): a, c, t, g, unknown or other
  misc_feature (282)..(282): n is a, c, g, or t
  modified_base (399)..(399): a, c, t, g, unknown or other
  misc_feature (399)..(399): n is a, c, g, or t
tcagagtcgagagacacgaccggtgctcgatttagtatctgatagttggctctgggagacgagcccagcactggaagtcggccggtgtttccattcggtgatcatcactgaacacagaggactcaccatgggagtttgggctgagcttgggttttcctcgttgcttcttttaagaggtgtccagtgtcatgtgctagttgatacaggtcgtggggggagcggttggtcccaggccgtggggacgtccctgagactctccngtgcagcctcgtgattcgtctntgtcgtctaccctagtcgctacgtcgggtccgccgaggcctccgaggccgaaggggtctagggtaacgtggggtagtccaactttactctacgattcgtagagttaggggaacggtntacgtaaagtttcgttaacgtcgggtaccccgtaccgtacccggggttaaggaaccgggggtaccccttaacgttaccctaaccccgtaacgttacccgtaaccggtaaacggtacccgtaaaacgttaaacccgtttaaaccccggaaaaaccgtaacccgtaaacccgttaaacctttaaacctttaactttaaccctttaaaccgttaaaaccggttaaccggtaaacccttaaccgttacccggttaacggtaaccgggtaccgggtaacgggaaaccgggtaaccccggtaccgggtttaccgttaccggtttacccgttaacgtttaccggttaccgggttcgtaaaccgtccggttaaggtacgtttacggttaccgtttacgtttaaacgg

SEQ ID NO: 27882 - DNA, 790 bp, Homo sapiens
  misc_feature: GYAE6OF01CX45Z.49.38.D05.1.454.CMB.1.raw
  modified_base (177)..(177): a, c, t, g, unknown or other
  misc_feature (177)..(177): n is a, c, g, or t
  modified_base (190)..(190): a, c, t, g, unknown or other
  misc_feature (190)..(190): n is a, c, g, or t
  modified_base (209)..(209): a, c, t, g, unknown or other
  misc_feature (209)..(209): n is a, c, g, or t
tcagagtcgagagacacgaccggtgctcgatttagtatctgatagttggctctgggagacgagcccagcactggaagtcgccggtgtttccattcggtgatcatcactgaacacagaggactcacatggtagtttggctgagtcttgggtttttcctcgttgtcttacttttaaggnggttgtcagtgtnattgtgctagttgatacgnggttcggtggggggagcgttcggtccaggtccgtggggacgttccctggacgtacttccgtcgttggtgcctacgtccgttcgtaggtactttccggtccttacgtacggttcgttacccttaccccgtaagtccgtaccggtccgggttaccggggtaccccgtacccggaacgggtccccttaccgggaacggggtaccgggaaacggggggtccgttaaggggtaaaccgggttcggggggttacgaccttaacgttttcgaccttacgtaacgttcgtagggtaggtaggggaaactttcgtaagtaactttcgtacgcgtaccgtaccgtacggtacgggaacggtaccttacgtacctactactcgtaacccgaggtacctaaacgttaacctaaccgaaagtaaacctaaccgtaacctttaattaacctttaaccgttaaactaaagttaaccgtaaccgtacgtacgttaagaacggtccgtaggaccggtaccgtacggtcttacgttactttaacgttacgtgggttacctacgggtaccttaggttaagtcgtttaagttcgtttaaag

SEQ ID NO: 27883 - DNA, 666 bp, Homo sapiens
  misc_feature: GYAE6OF01DIUG5.49.38.D05.1.454.CMB.1.raw
  modified_base (329)..(329): a, c, t, g, unknown or other
  misc_feature (329)..(329): n is a, c, g, or t
  modified_base (650)..(650): a, c, t, g, unknown or other
  misc_feature (650)..(650): n is a, c, g, or t
tcagagtcgagagacacgaccggtgctcgatttagtatctgatagttgggctctgggagacgagcccagcactggaagtcgccggtgtttccattcggtgatcatcactgaacacagaggctcacatggagtttgggctgagtcgttgggttttcctcggttgcttacttttaagaggttgtccagtgtcatgtgcagttgactacagtcgtgggggagcgtgtccaggccgtgggacgtcctggacgtactctccgtggtagctacggtcctgtaggtacttccggtctctacggtctacctacctagtcgcgtacggtcgggtcccncgaggtcctaccggagggcgtaagggtctagggaacgtcgggtagactacttacgtctactacgtcgtaggtaagtacgggtaacgttctagttaaacttcgttacgtcggtacccgtacgttccgggtaaggaccgggtacctacttaccgaaccgttataccgtaacggacggtaactacttaaaccgtacgaaacgtaactactacgttattactacttaagaaactcgaaccttagtacgtaggacgtacgggtagaacgcgtacggtaccttaggtactttaacgtgggtacgtcggaaccgttgtaaggactttntagttaccttaaacgg

SEQ ID NO: 27884 - DNA, 799 bp, Homo sapiens
  misc_feature: GYAE6OF01DXVGS.49.38.D05.1.454.CMB.1.raw
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
tcagagtcgagagacacgaccggtgctcgatttagtatctgatagttggctctgggagacgagcccagcactggaagtcgccggtgtttccattcggtgatcatcactgaaccacagaggactcaccagtggagtttggctgagcttgggtttttcctcgttgtcttacttttaaaggacggtgtccagttgtcatgtgctagttnatacnggtcgngggggagcggtcggtccagtccgtgggacggtcccgtgacgtactccgtccgtgtcgcgacgtccctgtcggttacttcgttctcgttagttcgtaccttacccctagtcgcgtaccggtcggggtcccgaccgacggtccctaccggacgggaccggtaaacgggggccgttagggtaacggttcgggggtacgtacccgttacgtttaacgttccgttacgacgtttaccggtagggtaacgttagggggttaaaccgttccggttaagttaacgttaccgtttaaaccgccgggtaccccgttaacccggttccgggtaacgggtaacggggtaccccttaacggttaaccctaacccctacttaccgtaaccgtaaaggtaccgtaaaccgttaacctaaccgaaacgtaaaccaaccgttaacttaacttaccttaacgttaacgaaacgttaacacttacgtaacgtagacgggtacgtacggtaaaccggccggttacgtacggtagttaaccttacggtttctcggtacggtaaccctggttaaccaagggtttacttgtttaaccgggttaaa

SEQ ID NO: 27885 - DNA, 574 bp, Homo sapiens
  misc_feature: GYAE6OF01B9NML.49.38.D05.1.454.CMB.1.raw
  modified_base (459)..(459): a, c, t, g, unknown or other
  misc_feature (459)..(459): n is a, c, g, or t
  modified_base (528)..(528): a, c, t, g, unknown or other
  misc_feature (528)..(528): n is a, c, g, or t
  modified_base (543)..(543): a, c, t, g, unknown or other
  misc_feature (543)..(543): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcttgggttttcctcgttgctcttttaagaggtgtccagtgtcatgtgcagttgatacagtcgtggggggagcgtggtccagccgtggggacgtccctgacgctctctgtgcacgcctcgtggacttcgtctcgtagtcgtcctaccctatcgctacgtcggggtcccgccgagggcctccgagggccgaagggggtctagggtaagtggggtcggactacgttacgtctcattcgtagagtcgggaagtctagtacttcgtacgtcgaccgtacgtccggtaggaacgggcctacttaccactactcgtacaaganacctaatacaagacactatatactactaacaatcaactctcgtagacgtacgtaggacgtacgacggtntcgtacttaattcgnggtcgcgtaagtgagtacttgttacttaacg

SEQ ID NO: 27886 - DNA, 577 bp, Homo sapiens
  misc_feature: GYAE6OF01C5CB6.49.38.D05.1.454.CMB.1.raw
  modified_base (298)..(298): a, c, t, g, unknown or other
  misc_feature (298)..(298): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttggctgagctgggttttcctcgttgctcttttaagaggtgtccagtgtcatgtgcagttgatacagtcgtgggggagcgtggtccagcctgggagtccctgagactctcctgtgcagcctctggattcgtctctagtgtctacccctatgctacgtgggtcccnccaggcctccgaggcgaaagggggctagggaagtggggtgctacttatcctcatctagatgggaagtctagaattcttatcgccgtacgtccggtaggaacgggccgtattccacctatacctaccgagacgaacctaaacttaccaaagtaaccaacaacttaataacttacttaacaaagtacgaactactactaggagtaacgtggaacggaccgtacggtcgtacgttacttacttacgtgtggaccgtaagtagagtacttgttactttaaacg

SEQ ID NO: 27887 - DNA, 740 bp, Homo sapiens
  misc_feature: GYAE6OF01B3WDE.49.38.D05.1.454.CMB.1.raw
  modified_base (177)..(177): a, c, t, g, unknown or other
  misc_feature (177)..(177): n is a, c, g, or t
  modified_base (685)..(685): a, c, t, g, unknown or other
  misc_feature (685)..(685): n is a, c, g, or t
  modified_base (720)..(720): a, c, t, g, unknown or other
  misc_feature (720)..(720): n is a, c, g, or t
  modified_base (727)..(727): a, c, t, g, unknown or other
  misc_feature (727)..(727): n is a, c, g, or t
tcagagtcgagagacacgaccggtgctcgatttagtatctgatagttggctcgtgggagacgagcccagcacgtggaagtcgccggtgtttccattcggtgatcatcactgaacacagaggactcacatggtagtttgggctggagcttgggttttcctgttgtcttcttttaaggnggtcgtccagttgtctagtgtgcgtagttgactacgaggtcgtaggggggacgtcgtgggtcccaggcccgtggggacgtccctaggacgtacttcctccgtagtcgactacgccttcgttagtactttccgtcttacgttagtcgttcctaaccctgtcgaccgtccgggttccgggtcccgaccgacggtcccgtaccggtacgggacggtaaacggggtcgttaaggggtaacggtttcggggtaccggtaaccttaacgtttacgtaccgttacgtaacgtcggtaacggtaggttacgggggtaaaccgttcgtaaacggtttaaacccgtttcgtttaacggtcccggtacccgttacggggtaccggtacggaaccggttctaacgttacccacgtaacgtccgaaccgaggttaacaaacttaccgtaacaaactactaactacttaatcgttaactaacgaattacgtaactcgttcgaggaacgtggtaaccgaacgngtaaccggttttacgtatacgttgcgactcgtagnttagttnttcgttagtaacg

SEQ ID NO: 27888 - DNA, 589 bp, Homo sapiens
  misc_feature: GYAE6OF01DMY3Y.49.38.D05.1.454.CMB.1.raw
  modified_base (171)..(171): a, c, t, g, unknown or other
  misc_feature (171)..(171): n is a, c, g, or t
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
  modified_base (444)..(444): a, c, t, g, unknown or other
  misc_feature (444)..(444): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagnggtgtccagtgtcatgtgcagttgatacagtcgtgggggagcgtggtccagccgtgggacgtccctgagactctccgtgtgcacgcctcgtggtacttcgtctctagtcgtcctaccctntgcctacgtcgggtcccnccgaggtcctacgagggacgaaggggctaggagtggggtgactacgttactctacgtatcgtgagtagggacgttcgtagtaacttcgttatcggacccgtacgttccggtaggacgggtcctacttacccactntcctacgagacactaactaccaagaacactaactatactacttaacaaagtacgaactactacgtaggacgaacggtaggacgaccgtacgtcgttactacttattcgtaggtcgacgtactagagttagttcgttacgttaacg

SEQ ID NO: 27889 - DNA, 837 bp, Homo sapiens
  misc_feature: GYAE6OF01C5XP9.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacgagaggactcaccatgggtaggtttgggctggagtcgttcgggttttcctcggttgtcttacgttttaaggaggtcgtccagtgtcagtgtcgcgtagttagatacgtaggtcggtagggggagtcggtcggtcccaggtccggtaggggaccgttcccgagtacggtaccttccgttccgtgtacgcctacggtcccgttcgtaggttcctttaccggttaccttacggttaacggttcgttaacccccttaacccgttacggttcggtacccgtaccgggttccggggtcccccggaccggtaacgggtcccgtaacccggtaaggggaccggttaacggggtaccttaaggggaacgggttcggggtacggtccttaaacgtttcgtccgtaactacgtacgtaggtaacggttaagggtaacgtcgtaaggtttaaccgtacgttacggtaccgtacccggtaacggtccggtaacgggtacccgggtacctaacgtacccgtaccctaaccgtcctaaccgaacggtaaccgtaaaccttaactaaacccgaaataacccacgtaacttaacgttaactaacttaacgaaagttacccgaacttacgtacgtagtacggtacgtaacgggaaacgtccgtaccggtacttacgttacgtttacgttcgtaacgggtctaccgggtacgttaacgtagttacggttagtttaagttacg

SEQ ID NO: 27890 - DNA, 866 bp, Homo sapiens
  misc_feature: GYAE6OF01AY6YG.49.38.D05.1.454.CMB.1.raw
  modified_base (181)..(181): a, c, t, g, unknown or other
  misc_feature (181)..(181): n is a, c, g, or t
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
  modified_base (282)..(282): a, c, t, g, unknown or other
  misc_feature (282)..(282): n is a, c, g, or t
tcagagtcgagagacacgaccggtgctcgatttagtatctgatagttggctctgggagacgagcccagcactggaagtcgccggtgtttccattcggtgatcatcactgaacacgagaggactcacatgggagtttggctgagtcgttggggttttcctcggttgtcttacgttttaaggnggtgtccagtgtcatgtgctagttgatacgnggtacggtgggggacgtcggtcggtccnggtccggtgggacgtccctggacgaccttcgtccgtggtacncgtacgtcctggtggtacttccggttcttcgtaagttcgttaccctaccgtagtcggtaacgtcggtccggggtacccacggtacgggcccttaccgggaggacgggtaaggggcggttaagggtacgggtggggtaccgtaccttaacgttactcgtactcgttacggagtaacggttacgggtaagttcgttaacgtacttaccggtttacgcccggggtacccgttaccggttacccgggtacgggtaacccgggttaccgttaaccgtaaccccgtacccgtaaccgttcccgtaaaccggtaaacggtaacccaaaccgttaaacccgtaacccgtaaaagtaaacccgtaacctttaaaccgtttaaacctttaacgtttaacccttaaaactaaaccgttacgggtaaaacccttaccgttaacgggtaacgggtaacggttaaccgggtaaacggggtaaccgggttacccgggaccgggttttaccttaaggtttaacccgtttaacggttcggttaaccgggtcggtaacggttaacggtagtaacgtttacgttacggtttacgtttaaacgg

SEQ ID NO: 27891 - DNA, 820 bp, Homo sapiens
  misc_feature: GYAE6OF01A1U1U.49.38.D05.1.454.CMB.1.raw
  modified_base (235)..(235): a, c, t, g, unknown or other
  misc_feature (235)..(235): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatgggagtttgggctgagtcgttgggttttccctcgttagtcttacttttaaggaggttgtccaggttgtctagtgtgcgtagttgatacgtaggttcggtaggggggngtcgtggtcccaggtcgtggggacgtccccgtaggtacgtaccttccgtcgtacggtcggtcgtaccgtccgttccgttacggttacgttccggttccgttccgttacggttccgttaccgttacccgttaccgtcggtaccgtacggttccgggtcccggtcccggtaccggtccgtaccggtacggtaccggaacgggtacggtacgggtacggttacgggtacggtacgtcgttaaaaaaacttcgttacgtacgtacgtacgtacggtacggtaacggttacgttagtaacgttacgttaacgttaccgtaccggttacgtaccggttacgggacggtaccgtacgtacctaaccgtaccgtccgtaaccgacgtaacgtaaccgtaaccgtaacgtaaacctaaacgtaacctaacttaacttaacttaaccttaacgtaaacgtaaccgttaaacctaaccgttaaccgttaacgtaacggtaaccggtaaggacccgtaacgtaccggtacgtaccgttagttacgttaggttacgtacggttacgtacggtacgtaagtacgttcgttacgttaacg

SEQ ID NO: 27892 - DNA, 743 bp, Homo sapiens
  misc_feature: GYAE6OF01AN18B.49.38.D05.1.454.CMB.1.raw
  modified_base (172)..(172): a, c, t, g, unknown or other
  misc_feature (172)..(172): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcttgggttttcctcgttgctcttttaagnggtgtccagtgtcatgtgctagttgatacagtcgtgggggagcgtggtccagccgtgggacgtccctgacgacttctcctgtgcagcctgtggattcgtctctagtgtcctaccctatcgctacggtcggccgccgtaggcctccgaggcgaaggggtctagggaagtggggtcgacctacgttacgtcctactagttcgtaggtacgttgggaacgtttctaagtaactttcgttactacgggtcccgttacccggttccgggtaagggaaaccgggttaccccgtaatttaccccgtaaccgtacgtttccccgtaaaccgtaacgaacgtaaaccctaaacgttaaaccccgaaaacgtaaaccccgtaaacttaaccgtttaaacctttaaacgtttaccctttaaaacgtaaaacttcgggtaaaacccttaccggttacgtaacgggaccgtaacggtacgggaaccggtaaccgtaaccggtacgttaccgttactttaaacgttccgttaggtaccggtaacgtaccggttaggtaacgttacgtttcgttaaccgtttaacg

SEQ ID NO: 27893 - DNA, 657 bp, Homo sapiens
  misc_feature: GYAE6OF01C4PNQ.49.38.D05.1.454.CMB.1.raw
  modified_base (301)..(301): a, c, t, g, unknown or other
  misc_feature (301)..(301): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (402)..(402): a, c, t, g, unknown or other
  misc_feature (402)..(402): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcgttggttttcctcgttgcttcgttttaagaggtgtccagtgtcatgtgctagttgatacagtcgtgggggagcgtggtccagccgtgggacgtccctgacgtactcgtcgtgtcgacacgcctcgtggtacttcgttctcttagtcgtctaccctancgtcacgttcgggcctcgagcctacgaggcgaacgggctaggagtgggtgacttactgtcntatcgtaggntgggaacttcgtaagtacgttcgtttaacncggtaccgttaccgtccggttaacgggaaccgggtacctaccggtacctaacccggttactaccggtaaccgtacgtaacggacttaacctaacccgaagaacctaactaacgtaacttacttactaactaaatcggtaacctactacgttacggacgtaggtacgacggacgtaccgtacgttacgttacggtttacgttacgtaggtcccggagtacccggtaagttggaacgtttcgttagttttaaaccgg

SEQ ID NO: 27894 - DNA, 642 bp, Homo sapiens
  misc_feature: GYAE6OF01ARZOZ.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagagactcaccatggagtttggctgagtcttgggttttcctcgttagccttacgttttaagaggttgtccgagttcgtctagtgtgctagttgatacgagtcggtgggggagcgttggtaccaggccgtgggtacgtccgtagcgtacctccgttccgtgtcgcgtacgccttacggtaggtcttccgttactcgtacgttcgtcctactatcgccgtacgtcggtcccacggacgccgtacggaggacgaacgggtctagggtacggtgggtgaccttagtttacgtctacgtagttcgtgtagacggtacgtactagtaacttcgtgtacggcctagttcggagtacggacctagtaccactaccgtcgtacgaacgtacgtactaactacgaaacgacaacgattagtactaataactacgaacgtacacgttacaacgtacgacgttacgacgtaccgtacgttcgtacgttacttaagttcggtagcgtaccgtacgtagtacgttaacttcgttagttaacg

SEQ ID NO: 27895 - DNA, 648 bp, Homo sapiens
  misc_feature: GYAE6OF01CYW5C.49.38.D05.1.454.CMB.1.raw
  modified_base (169)..(169): a, c, t, g, unknown or other
  misc_feature (169)..(169): n is a, c, g, or t
  modified_base (172)..(172): a, c, t, g, unknown or other
  misc_feature (172)..(172): n is a, c, g, or t
  modified_base (177)..(177): a, c, t, g, unknown or other
  misc_feature (177)..(177): n is a, c, g, or t
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
  modified_base (296)..(296): a, c, t, g, unknown or other
  misc_feature (296)..(296): n is a, c, g, or t
  modified_base (412)..(412): a, c, t, g, unknown or other
  misc_feature (412)..(412): n is a, c, g, or t
  modified_base (470)..(470): a, c, t, g, unknown or other
  misc_feature (470)..(470): n is a, c, g, or t
  modified_base (498)..(498): a, c, t, g, unknown or other
  misc_feature (498)..(498): n is a, c, g, or t
  modified_base (514)..(514): a, c, t, g, unknown or other
  misc_feature (514)..(514): n is a, c, g, or t
  modified_base (524)..(524): a, c, t, g, unknown or other
  misc_feature (524)..(524): n is a, c, g, or t
  modified_base (547)..(547): a, c, t, g, unknown or other
  misc_feature (547)..(547): n is a, c, g, or t
tcagagtcgagagacacgaccggtgctcgatttagtatctgatagttggctctgggagacgagcccagcactggaagtcgccggttgtttccattcggtgatcatcactgaaccacagaggactcaccatggtagttggctgagtcgtggttcgtcgtagctcttaagngtncagtntcatgtgctagtgactacaggtcgnggggactggttacgctacgccgtaggggtctcctaggatccgtctctgacacgtcgnttacgtggtctaccgtctgtacgttaccgcttacccngtaccgcgtcgtccggtaccggtaccgtggtaccccaagggtgaaccggagggtcctagggtcgtacggggtcaacgtctttacactcgcttagggtataccggtagtccgttaanggtaacccttgaccgtaggtacccgacggtaactcggtacgaccgttactaccgtacncttaccgaagagtaacgtctaactacanaacgttgtaggttacngtaaccgtanagtacgacgtccgtaactacggngaaccggtccggtacgacccgtaccggtaacgttacggtagtaacggttacgtacgtacgtacgttacgggtacgtacgtaacgttaccgtacgttaaacg

SEQ ID NO: 27896 - DNA, 736 bp, Homo sapiens
  misc_feature: GYAE6OF01DAC6O.49.38.D05.1.454.CMB.1.raw
  modified_base (708)..(708): a, c, t, g, unknown or other
  misc_feature (708)..(708): n is a, c, g, or t
  modified_base (728)..(728): a, c, t, g, unknown or other
  misc_feature (728)..(728): n is a, c, g, or t
tcagagtcgagagacacgaccggtgctcgatttagtatctgatagttggctctgggagacgagcccagcactggaagtcgccggtgtttccattcggtgatcatcactgaacacagaggactcacagtggtagttgggctgaggtcgttcgggttttcctcgttgtacctttacgttttaaaggaggttcgtccgtaaggttcgtctagttggtgtacgtagttagaatacgaggttcggtggggggacggtcggttcggtccgacggtccggtaggggaccggttcccgtaggacgtactccgttcgtgtcgctacgtcctcgtggtacttcgtcgtcgtagttcgtacctacctagtcgtactacggtccgggtcccgaccgtacggtccgtaccgagggtaccggaagggtcgtaagggtaaggtcggggtacgtaccttacttaccgtctacgttagtcgtagtaaggtggtaacgttcgtaataacgtttctacgtacccgtacggttaccggtaccggtaacggtaccgtccgtacttacccgaccctacgtcccgtacgtaacggaactaccgtaaccgtaaccaaacgtacctaataacttactaaccttacttaaacgaactaaccgtaactacgtacgtaggtacgacgtacggacgtaaccgcgttactcggttactagttccgtgtacgtaacgtntataccgggttttaccgttnttaaacgg

SEQ ID NO: 27897 - DNA, 704 bp, Homo sapiens
  misc_feature: GYAE6OF01ATWCI.49.38.D05.1.454.CMB.1.raw
  modified_base (180)..(180): a, c, t, g, unknown or other
  misc_feature (180)..(180): n is a, c, g, or t
  modified_base (184)..(184): a, c, t, g, unknown or other
  misc_feature (184)..(184): n is a, c, g, or t
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (455)..(455): a, c, t, g, unknown or other
  misc_feature (455)..(455): n is a, c, g, or t
  modified_base (594)..(594): a, c, t, g, unknown or other
  misc_feature (594)..(594): n is a, c, g, or t
tcagagtcgagagacacgaccggtgctcgatttagtatctgatagttggctctgggagacgagcccagcactggaagtcgccggtgtttccattcggtgatcatcactgaacacagaggactccacagtgggtagtttcgggctgagtcgttgggttttcctcgttgtcttcttttaagnggtntccagtctcatgtcgngtagttgatacgnggtcggtgggggacgtcgttacggtccgaggtccggttggggtaccggtcccgtaggaacgtcgttccttccgtggtcgaccggtactcccgttaaggttcggttacttccggttccttagttacggttccgtacccttaacgtacgtcggtccgacggttcccgggtacccaccgtcggtcccacggagggaccggtaaggggtgtacgggtaggtcgggtacggtacttaagtttccgtntactgtgtaggtacggtaggtactacgttataacgttcgttacgaccgtcgtacgtcggtacggtaacgtcgtaccttcaacgtcgtactcgaagtacacgtaacctagacgaactaacttctaacttactaacgtaanaacggtatacttacgcgtaagaccggtacgcggtacgaccggtacttcgtaacggtactttacgtcggtacgtacgtcgtagttagtaacctaggtttccctaaggtaac

SEQ ID NO: 27898 - DNA, 809 bp, Homo sapiens
  misc_feature: GYAE6OF01CJ2DI.49.38.D05.1.454.CMB.1.raw
  modified_base (172)..(172): a, c, t, g, unknown or other
  misc_feature (172)..(172): n is a, c, g, or t
  modified_base (335)..(335): a, c, t, g, unknown or other
  misc_feature (335)..(335): n is a, c, g, or t
  modified_base (767)..(767): a, c, t, g, unknown or other
  misc_feature (767)..(767): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagttggctgagtcttgggttttcctcgttgcttcttttaagnggtgtccagtgtcagtgtgcgtagttagattacgaggtccggtggggggacggtcgtcggtccgacgccgttggggacgtcccgtggacgtacttccgtccgtgtcgaccacgtccttcgtggtacgtttccgtcttacgtacgttcgttaccctaacccgtntcgtaccgtacggtccgggtaccccgaccgacggtaccctaccggagggtaccggtaacggggtcgtaacggggtaacgtgggggttaccgcgttaaaccgttttacgtccgtaacctacgttcgtaaggtacgttaaaggggttaacggtcgttaagtaacgtttacccgtttaacggtcccggtaccccgttacggtacccggtaagggtaacccgggtaccccgttaacgtaccccggtacccttaccgttacccgaaaccgtaacgaaccgtaaacgttaaccgtaacctaaaaacggaaccctaaaccttaaaccttaaagtttaacctaccgtttaaactaaaccgtaacgtacctaacgtacgtacgacggttaaccgtacggaaacgtacccgtaacggttcgtaaccgttattacggttacgngttacgaccgtagtaacggtattacgttcgttcgttaaacgg

SEQ ID NO: 27899 - DNA, 696 bp, Homo sapiens
  misc_feature: GYAE6OF01BV0LU.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagaggactcaccatgggagtttggggctggagtcgttgggttttccctcgttgtcttcttttaaagaggtgtccagtgtcatgtgctagttgatacagtcggtgggggagcgtcggtccaggccgtggggacgtccctggacgtacctctcctgtcgccagtccctagtgggtacttcgtctcgttagtcgtcctaccctagtcgcctacggtccgggtccgccgtaggcctaccgagggacgaaggggtcctaggaaggtcgggtcgtactaacttactcgtacgattcgtagaaggttcgggaaggttcgtagtaacgttcgttacgtccggtacccgtacgtaccggtacggaccgggtaccgtacgttcccacgtacgttcccgacaacgtaccgtaactaaaccgtacctaaacgaaccgtaaacctaacttaacttaactaccttaaactaaacgttaaccgtaacctaccgttactaaggtaacgtaacggtaggaacccgggtaccagggtaccgttagttacttaacggttcgtagtaccggacgtacgtaggatagttcgttaagttaacgg

SEQ ID NO: 27900 - DNA, 825 bp, Homo sapiens
  misc_feature: GYAE6OF01B4DEL.49.38.D05.1.454.CMB.1.raw
  modified_base (99)..(99): a, c, t, g, unknown or other
  misc_feature (99)..(99): n is a, c, g, or t
tcagagtcgagagacacgaccggtgctcgatttagtatctgatagttggctctgggagacgagcccagcactggaagtcgccggtgtttccattcggtnatcatcactgaacacagaggactcaccatggagtttgggctgagcgttgggttttcctcgttagcttcttttaaagaggtgtccagtgtcatgtgctagttgatacgaggtcgtgggggagcgtggtccaggccgtggggacgtccctgacgacttccgtcctggtcgcagcccgttgtggtattccgtcttacttacggtcgttccttaaccccgttagtcgaccgtaccggttcggggtcccgaccgtacgggtccttaccggagggtaccggtaaggggggtcctaggggtaaacggttggggtacgggtacctaacgtttagtcctacctagttaccgtaggtaggttacgggtaaacggttccgtagtaacttcgttttaaacggtccggtacccgttaaccggttaccgggtacgggtaaaccggggtacccgtttaacgttacccgtaaccttaccgtacccgtacccgtaaaggtaaccgtaaacttaaaacccggttaacccgtaaaacggtaaaccctaaccggtaaacctttaacgttaaacctttaccgttaaacgtaaaacgtaccgtaaacccgtaccgttactaacgggacgttaaccggttaacgggacggtaacccggtaggttcccgttaacgttacgtttaactttacgggtacgttcggtaaccggttatacgggttaacttacggttagtttaaccgtttaacgg

SEQ ID NO: 27901 - DNA, 746 bp, Homo sapiens
  misc_feature: GYAE6OF01BPO7F.49.38.D05.1.454.CMB.1.raw
  modified_base (99)..(99): a, c, t, g, unknown or other
  misc_feature (99)..(99): n is a, c, g, or t
  modified_base (449)..(449): a, c, t, g, unknown or other
  misc_feature (449)..(449): n is a, c, g, or t
tcagagtcgagagacacgaccggtgctcgatttagtatctgatagttggctctgggagacgagcccagcactggaagtcgccggtgtttccattcggtnatcatcactgaacacagaggactcaccatggagtttgggctgagtcttgggttttcctcgttgcttcttttaagaggtgtcctaggtgtctagtgtgctagttgaatacgaggtcggtggggggaggtcgttcgggttccgaggtcccgttacgggggtacgttccccgtaggaacgtaccgttcccgttcctaggtcggtcctacggtcccgttcgtgggtaacctttccggtccgttctacggtcgttaccttacccgtagtccggcctaccgggttccggtcccgaccgtaggtcccgtacggcgggacggtaacgggtcgttaggacggttgggcgtactacgttnccgtacagttcgtagagttacggtaacgttctagtactttcgtatccggtacgtccgtaccggtgtaaccgggtaccttacgttacccaccgttaccgtcgtaaccgaagtaaccgtaaccttaacgttaaacccgaaacgtaaccctattaaccttagttaacttaaccttaattaaccgcgtaaactcttacgtaggaacggtcgtacgacgggtacgacgttcgtacgtttaccttagttaccggttcaccggttaccgtagttagtaaccggttcttacgtttcggttaaacg

SEQ ID NO: 27902 - DNA, 225 bp, Homo sapiens
  misc_feature: GYAE6OF02G0IWC.49.38.D05.1.454.CMB.1.raw
  modified_base (217)..(225): a, c, t, g, unknown or other
  misc_feature (217)..(225): n is a, c, g, or t
tcagagtcgagagacacgaccggtgctcgatttagtatctgatagttgggtttggggaagaggaagactgacggtcctcccaggagttcaggtgctgggcaccgtgggcatggggaggtgtgtcacaagatttgggctctgggcacagcggccctgggctgcctggtcaaggactacttcctctctcgactctgagcgggctggcaaggcgcatagnnnnnnnnn

SEQ ID NO: 27903 - DNA, 219 bp, Homo sapiens
  misc_feature: GYAE6OF02I16KQ.49.38.D05.1.454.CMB.1.raw
  modified_base (218)..(219): a, c, t, g, unknown or other
  misc_feature (218)..(219): n is a, c, g, or t
tcagagtcgagagacacgaccggtgctcgatttagtatctgatagttgggtttggggaagaggaagactgacggtcctcccaggagttcaggtgctgggcaccgtgggcatgggggaggtgtgtcacaagatttgggctctgggcacagcggccctgggctgcctggtcaaggactacttcctctctcgactctgagcgggctggcaaggcgcatagnn

SEQ ID NO: 27904 - DNA, 220 bp, Homo sapiens
  misc_feature: GYAE6OF02FXZAG.49.38.D05.1.454.CMB.1.raw
  modified_base (219)..(220): a, c, t, g, unknown or other
  misc_feature (219)..(220): n is a, c, g, or t
tcagagtcgagagacacgaccggtgctcgatttagtatctgatagttgggtttgggggaagaggaagactgacggtcctcccaggagttcaggtgctgggcaccgtgggcatgggggaggtgtgtcacaagatttgggctctgggcacagcggccctgggctgcctggtcaaggactacttcctctctcgactctgagcgggctggcaaggcgcatagnn

SEQ ID NO: 27905 - DNA, 269 bp, Homo sapiens
  misc_feature: GYAE6OF02GPDCL.49.38.D05.1.454.CMB.1.raw
  modified_base (265)..(269): a, c, t, g, unknown or other
  misc_feature (265)..(269): n is a, c, g, or t
tcagagtcgagagacacgaccggtgctcgatttagtatctgatagttgggtttgggtgctcgatttagtatctgatagttgggtttggggaggtgtgtcacaagattgggccctggtcaccgtctcctcagcttccaccaagggcccatcggtcttcccctggcgccctgctccaggagcacctctgggggcacagcggccctgggctgcctggtcaaggactacttcctctctcgactctgagcgggctggcaaggcgcatagnnnnn

SEQ ID NO: 27906 - DNA, 222 bp, Homo sapiens
  misc_feature: GYAE6OF02IIHEF.49.38.D05.1.454.CMB.1.raw
  modified_base (176)..(222): a, c, t, g, unknown or other
  misc_feature (176)..(222): n is a, c, g, or t
tcagagtcgagagacacgaccggtgctcgatttagtatctgatagttgggtttgggggaagaggaagactgacggtcccccaggagttcaggtggcctgggcacagcggcccgtgggctgcctggtcaaggactacttcctctctcgactctgagcgggctggcaaggcgcatagnnnnnnnnnnnnnnnnnnnnnnnnnnnnnnnnnnnnnnnnnnnnnnn

SEQ ID NO: 27907 - DNA, 221 bp, Homo sapiens; identical to SEQ ID NO: 27826
  misc_feature: GYAE6OF02GT8UY.49.38.D05.1.454.CMB.1.raw
  modified_base (219)..(221): a, c, t, g, unknown or other
  misc_feature (219)..(221): n is a, c, g, or t

SEQ ID NO: 27908 - DNA, 271 bp, Homo sapiens
  misc_feature: GYAE6OF02F1FSC.49.38.D05.1.454.CMB.1.raw
  modified_base (269)..(271): a, c, t, g, unknown or other
  misc_feature (269)..(271): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttccccctggcgccctgctccaggagcacctctgggggcacagcggccctgggctgcctggtcaaggactacttcctctctcgactctgagcgggctggcaaggcgcatagnnn

SEQ ID NO: 27909 - DNA, 272 bp, Homo sapiens
  misc_feature: GYAE6OF02GHBOF.49.38.D05.1.454.CMB.1.raw
  modified_base (268)..(272): a, c, t, g, unknown or other
  misc_feature (268)..(272): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttcccctggcgccctgctccaggagcacctctgggggcacagcggccctgggctgcctggtcaaggactacttcctctctcgactctgagcgggctggcaaggcgcatagnnnnn

SEQ ID NO: 27910 - DNA, 529 bp, Homo sapiens
  misc_feature: GYAE6OF02HBEC9.49.38.D05.1.454.CMB.1.raw
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (402)..(402): a, c, t, g, unknown or other
  misc_feature (402)..(402): n is a, c, g, or t
  modified_base (474)..(474): a, c, t, g, unknown or other
  misc_feature (474)..(474): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcgtggtttcgcgtagctctttaagaggtgtcagtgtcatgtgcagttgatacagtcgtgggggagcgtggtccagccgtgggaggtccctgagactctcctgtgcagcctctggattcgtctctagtgtctaccctatgcactgggtcccgccaggcctccgaggccaagggggctgggaatggggnggctacttanctcatctgatggaaggtctgaatcttatgccgtactccgtggaacgggccgattccgacctntctccagacgactaacgttaccaagaaaccacaactatacttacttacaaatgaaactctactagaatacgngaggacacgtcgtagtcttatacgtgtcgacggactagaggtattcgtattaacg

SEQ ID NO: 27911 - DNA, 287 bp, Homo sapiens
  misc_feature: GYAE6OF02GW7X2.49.38.D05.1.454.CMB.1.raw
  modified_base (268)..(287): a, c, t, g, unknown or other
  misc_feature (268)..(287): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttcccctggcgccctgctccaggagcacctctgggggcacagcggccctgggctgcctggtcaaggactacttcctctctcgactctgagcgggctggcaaggcgcatagnnnnnnnnnnnnnnnnnnnn

SEQ ID NO: 27912 - DNA, 275 bp, Homo sapiens
  misc_feature: GYAE6OF02JI6Z4.49.38.D05.1.454.CMB.1.raw
  modified_base (268)..(275): a, c, t, g, unknown or other
  misc_feature (268)..(275): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttcccctggcgccctgctccaggagcacctctgggggcacagcggccctgggctgcctggtcaaggactacttcctcgtagcactctgagcgggctggcaaggcgcatagnnnnnnnn

SEQ ID NO: 27913 - DNA, 270 bp, Homo sapiens
  misc_feature: GYAE6OF02GKQDA.49.38.D05.1.454.CMB.1.raw
  modified_base (268)..(270): a, c, t, g, unknown or other
  misc_feature (268)..(270): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttccccctggcgccctgctccaggagcacctctgggggcacagcggccctgggctgcctggtcaaggactacttcctcctcgactctgagcgggctggcaaggcgcatagnnn

SEQ ID NO: 27914 - DNA, 175 bp, Homo sapiens
  misc_feature: GYAE6OF02JBKZ4.49.38.D05.1.454.CMB.1.raw
  modified_base (173)..(175): a, c, t, g, unknown or other
  misc_feature (173)..(175): n is a, c, g, or t
tcagagtcgagagacacgaccggtgctcgatttagtatctgatagttgggtttgggggaagaggaagactgacggtcccccaggagttcaggtgctgggcacagcggccctgggctgcctggtcaaggactacttcctctctcgactctgagcgggctggcaaggcgcatagnnn

SEQ ID NO: 27915 - DNA, 516 bp, Homo sapiens
  misc_feature: GYAE6OF02GBZBE.49.38.D05.1.454.CMB.1.raw
  modified_base (295)..(295): a, c, t, g, unknown or other
  misc_feature (295)..(295): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggagcgtggtccagcctgggagtccctgagactctcctgtgcagcctctggattcgtctctagtgtctaccctatgcacgtgggtccnccaggcctccgaggcaaggggctggaatggggtgctacttatctcatctgatggaagtctagaattcttagcgaccgacgtccggtagaacgggccgtattccacctatcctaccagacgactaattccaaagacacactatatactacaaatcgaacactactagagacgtgaggacacggtctagtcttaattctgtgcgtactggatatgtacttaag

SEQ ID NO: 27916 - DNA, 218 bp, Homo sapiens
  misc_feature: GYAE6OF02IH6DD.49.38.D05.1.454.CMB.1.raw
  modified_base (218)..(218): a, c, t, g, unknown or other
  misc_feature (218)..(218): n is a, c, g, or t
tcagagtcgagagacacgaccggtgctcgatttagtatctgatagttgggtttgggggaagaggaagactgacggtcctcccaggagttcaggtgctgggcaccgtgggcatgggggaggtgtgtcacaagatttgggctctgggcacagcggccctgggctgcctggtcaaggctacttcctctctcgactctgagcgggctggcaaggcgcatagn

SEQ ID NO: 27917 - DNA, 548 bp, Homo sapiens
  misc_feature: GYAE6OF02JAF2D.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcacgtgggtccgccaggcctccgaggcaagggggctgggaatggggtggctacttatctcatctgagtggaagtctagaatcttagcgccgtactccgtaggaacgggccgtattcacctatcctaccagacgacaacttaccaagaacacactatactcttacaaatacgaactactactagacgtacgtagacggacgtacggcttgtacttaacgttacgtcgttacgacgtacgtaggacgtacttcgttactttaacg

SEQ ID NO: 27918 - DNA, 556 bp, Homo sapiens
  misc_feature: GYAE6OF02IFF6C.49.38.D05.1.454.CMB.1.raw
  modified_base (456)..(456): a, c, t, g, unknown or other
  misc_feature (456)..(456): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtcgtgggggagcgtggtccagcctgggaggtccctgagactctcctgtgcagcctctggattcgctctagtcgtctaccctatgcacgtggggtcccgccaggcctccgaggcgaaggggctagggaatggggtgctacttatctcatctgagtggaaggtctagaattcttagcgcccgtatccggtaggacgggcctattccactatcctcagacgaactaactaccaaagaaccacaactatattaccttanaaatacgaacctacttacgtaggaacgacgtagacggacgtacggtcgtacgttacttagttcgtcgtcgtacgtacgtagagtattcgttactttaacg

SEQ ID NO: 27919 - DNA, 498 bp, Homo sapiens
  misc_feature: GYAE6OF02GZPKH.49.38.D05.1.454.CMB.1.raw
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
  modified_base (365)..(365): a, c, t, g, unknown or other
  misc_feature (365)..(365): n is a, c, g, or t
  modified_base (395)..(395): a, c, t, g, unknown or other
  misc_feature (395)..(395): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctggggggagcgtggtccagcctggggacggtccctgagactctcctgtgcagcctctggattcgtctctagtgtcctaccctatgcactgggtccnccaggctccgaggcaaggggctggaatggggtgcacttanctcatctgatggagtctgaatcttangccgactcgtgacggcatcacatctcaganacaatccaagacacactatatcttacaaatcgaacacttactagagacgtagacggacacggtctgtactattacgtgtagcgacgtgagacttgtattaacg

SEQ ID NO: 27920 - DNA, 539 bp, Homo sapiens
  misc_feature: GYAE6OF02IA6W1.49.38.D05.1.454.CMB.1.raw
  modified_base (297)..(297): a, c, t, g, unknown or other
  misc_feature (297)..(297): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtcgtgggggagcgtggtccagcctggggaggtccctgagactctcctgtgcagcctctggattcgctctagtgtctaccctatgcactggggtccnccaggcctccgagggcgaagggggctgggaatggggtggctacttanctnatctgatggaagtctagaattcttatcgccgacgtccggtaggaacgggccgtattccacctactcctaccgagacgactaacttaccaaagaaccacactaatatacttacaaatagaactactctagagacgtagacgacgacggctgtacttattacgtgtcgacgtacgtagagtattgtacttaacg

SEQ ID NO: 27921 - DNA, 285 bp, Homo sapiens
  misc_feature: GYAE6OF02IF0NO.49.38.D05.1.454.CMB.1.raw
  modified_base (274)..(285): a, c, t, g, unknown or other
  misc_feature (274)..(285): n is a, c, g, or t
tcagagtcgagagacacgaccggtgctcgatttagtatctgatagttggggtttggggtgctcgatttaaagtatctgatagttgggtttgggggaggtgtgtccacaagatttgggccctggtcaccgtctcctcagcttccaccaaggcccatcggtcttcccctggcgccctgctccaggagcacctctgggggcacagcggccctgggctgcctggtcaagggactaacttcctcgtctcgactctgagcgggctggcaaggcgcatagnnnnnnnnnnnn

SEQ ID NO: 27922 - DNA, 275 bp, Homo sapiens
  misc_feature: GYAE6OF02GB62L.49.38.D05.1.454.CMB.1.raw
  modified_base (269)..(275): a, c, t, g, unknown or other
  misc_feature (269)..(275): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttccccctggcgccctgctccaggagcacctctgggggcacagcggccctgggctgcctggtcaaggactacttcctctctcgactctgagcgggctggcaaggcgcatagnnnnnnn

SEQ ID NO: 27923 - DNA, 515 bp, Homo sapiens
  misc_feature: GYAE6OF02I5PDN.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggagcgtggtccagcctgggaggtccctgagactctcctgtgcagcctctggattcgtctctagtgtctacctatgcacgtgggtccgccaggcctcgaggcaaggggctgggaatggggtgctacttatctcatctgatggaagtctagaatcttagcgccgacgtccgtaggaacggccgtatccacatctacagacgactaactacaagaacacactatatctacaatcgaacactcagacgacgtgacggacacggtctgtactagttacgtgtcgacgtactaggagtacgttgttattaacg

SEQ ID NO: 27924 - DNA, 506 bp, Homo sapiens
  misc_feature: GYAE6OF02IQ47B.49.38.D05.1.454.CMB.1.raw
  modified_base (158)..(158): a, c, t, g, unknown or other
  misc_feature (158)..(158): n is a, c, g, or t
  modified_base (174)..(174): a, c, t, g, unknown or other
  misc_feature (174)..(174): n is a, c, g, or t
  modified_base (263)..(263): a, c, t, g, unknown or other
  misc_feature (263)..(263): n is a, c, g, or t
  modified_base (273)..(273): a, c, t, g, unknown or other
  misc_feature (273)..(273): n is a, c, g, or t
  modified_base (371)..(371): a, c, t, g, unknown or other
  misc_feature (371)..(371): n is a, c, g, or t
  modified_base (392)..(392): a, c, t, g, unknown or other
  misc_feature (392)..(392): n is a, c, g, or t
  modified_base (429)..(429): a, c, t, g, unknown or other
  misc_feature (429)..(429): n is a, c, g, or t
tcagagtcgagagacacgaccggtgctcgatttagtatctgatagttggctcgtgggaggacgagcccagcactggaagtcgccggtgtttccattcggtgatcatcactgaaccacagaggactcaccatggagtttgggctgagctgggttttccncgttgctcttttaagnggtgtccagtgtcatgtgcagttgatacagtctgggggagcgtggtccagcctggggaggtccctggacgactctcctggtgcagcctntggattcgtntctagtgtctaccctatcgcacttggggtccgccaggctccgaggcaaggggctggaatggggtgcattatctcatctgatggaagtctgaatcttangccatcgtgaaggcatccacntcacagagacaattccaagaacacactatatcgttanaaatgaactactgtagacgacgtgaggacacggtctgtactagttactgtcgactacgtgacgtatcgtacttaacg

SEQ ID NO: 27925 - DNA, 515 bp, Homo sapiens
  misc_feature: GYAE6OF02GAKCP.49.38.D05.1.454.CMB.1.raw
  modified_base (297)..(297): a, c, t, g, unknown or other
  misc_feature (297)..(297): n is a, c, g, or t
  modified_base (509)..(509): a, c, t, g, unknown or other
  misc_feature (509)..(509): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcacgtgggtccnccaggcctccgaggcaaggggctaggaatggggtggcattatctcatctgatggaagtctagaatcttatcgaccgtactccggtaggaacgggcctattccacatcctacgagacgactaatccaagaacacactatatcttacaaatcaacacttcagacgacgtgagacacggctgtactattacgtgtagcgtactagatcgttagtnttaacg

SEQ ID NO: 27926 - DNA, 700 bp, Homo sapiens
  misc_feature: GYAE6OF02HUP9Q.49.38.D05.1.454.CMB.1.raw
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcgtgggtttcctcgttgctcttttaagaggtgtccagtgtcatgtgcagttgatacagtcgtgggggaggcgtggtccagccgtggggaggtccctgagactctcctgtgcagcctctggattcgtctctagtcgtacctaccctatgcacgtggggtcccgccaggcctccgaggccgaagggggctgggaagtggggtggctaacgtttanccgtanattcgtgtaagtgggaacggttctagtaaattcgtttaagcggtaccccggtacgttccggtacgggaaacggggtcccgtaacgtttaccaaccctacttccgtaacccaacgggtaactaacccgttaaacgtttaacccgaaaacggtaaacccctaataaaccttaactttaacttacccgtttaaactaaaaacgtacgtaaaacctaccttaccggttaagaaccggtaacgttagggaacggtaccgaacgggtccttaggttacctttaagttaaccggttgttacggccgttaacgtacgggtaacgttacgttcggtttatttaacgg

SEQ ID NO: 27927 - DNA, 283 bp, Homo sapiens
  misc_feature: GYAE6OF02H283Q.49.38.D05.1.454.CMB.1.raw
  modified_base (271)..(283): a, c, t, g, unknown or other
  misc_feature (271)..(283): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttcccctggcgccctgctccaggagcacctctgggggcacagcgccctgggctgcctggtcaaggactacttcctctctcgactctgagcgggctggcaaggcgcattaaggcnnnnnnnnnnnnn

SEQ ID NO: 27928 - DNA, 786 bp, Homo sapiens
  misc_feature: GYAE6OF02H1QVN.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcttgggttttcctcgttgctcttttaagaggtgtccagtgtcatgtgcagttgatacagtcgtgggggagcgtggtccaggccgtggggacggtccctggacgacctctccgtggtcgccacgtccttcgtaggtactttccgtcctcgttaggttcgtaccttaacccctagttcgcctacggttcggggtccccgaccgacgggtccctccggaggggtaccggtaaacggggggtccgttaaggggtaacggttcggggggttaccgggaccttaaccgttttaacgtcccgttactaacgttcgtagggttaacggttagggggtaaacgtttccgtaaggttaaacttttacgtttacggtaccgtaccccggttaccggtttacccgggttagggaaacccggggtcccgttaacttacccgtaaccgtacttcccgtacccgaaggtaaacgtaaccttaaactttaacccgaaagtaaccctaacgtaacttactttaacttaccttaaactaaacgttaccgaaaaccttcgttacgtaacggaacgtcgttacggacggtaccgtacggtcgttaacggttcttaactacgttgtcgtaccgtacgtaggacgtactttcgttacgtttaacg

SEQ ID NO: 27929 - DNA, 554 bp, Homo sapiens
  misc_feature: GYAE6OF02FPPUL.49.38.D05.1.454.CMB.1.raw
  modified_base (257)..(257): a, c, t, g, unknown or other
  misc_feature (257)..(257): n is a, c, g, or t
  modified_base (299)..(299): a, c, t, g, unknown or other
  misc_feature (299)..(299): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctggggggagcgtggtccagcctgggaggtccctgagactctcctgtgcagcctntggattccgtctctagtgtctaccctatgcacgtgggtcccnccgaggcctccgagggcaagggggctagggaatgggggtgactacttatcctcatctagactgggaagttctagacttcttagcgaccgtactccggtaggaacgggccgactttcaccatcctaccgagacgaactaacttaccaagaaccacactatactctacaaatacgaactactcagacgtacgtagacgacgtacggactgtactagttaccgtgtacgacgtacgtggagtattacgttacttaacg

SEQ ID NO: 27930 - DNA, 535 bp, Homo sapiens
  misc_feature: GYAE6OF02GEYPS.49.38.D05.1.454.CMB.1.raw
  modified_base (428)..(428): a, c, t, g, unknown or other
  misc_feature (428)..(428): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatgggagtttgggctgagctgggttttcctcgttgctcttttaagaggtgtccagtgtcatgtgcagttgatacagtctgggggagcgtggtccaggcctgggaggtccctgagactctcctgtgcagcctctggattcgtctctagtgtctaccctatgcacgtgggtccgccaggctccgaggcgaaggggctgggaagtggggtggctacgttatctcatctgagtggagtctagattcttatcggcctacgtccgtagaacgggccgtatccaccatcctccagagacaattaccaanaaccacactatatctaacaatacgaactactactagagacgtagacggacacggacgttcggtacttattacgttgtcgacgtactaggagtactggttatttaacg

SEQ ID NO: 27931 - DNA, 646 bp, Homo sapiens
  misc_feature: GYAE6OF02GJE2G.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtcgtgggggagcgtggtccagcctgggaggtccctgagactctcctgtgcagcctcgtggtcttcgtctctagtcgtcctacctagtcgactacggtcgggtcccgccgacggtcctaccggacggacggaacggggtcgtagggtaaggttgggggtcgaccttaacttagtcctactagtcgtagtaggtagggtacggttactagtaactttcgttacgtccgtacccgtacgtaccggtagggaaccgggtactacttacccaacctacttaccaccgaagacgaacttaacgtaaccgaaacgaaccaactaactaatacttacttaacaagtacgtaactactcgtagacgtacgtaggaacgacgtacgtacgtacgtactttacgtcgttagtaccgtacgtacgtaggtaacgttacgtttcgttacgtttaacgg

SEQ ID NO: 27932 - DNA, 504 bp, Homo sapiens
  misc_feature: GYAE6OF02HNP21.49.38.D05.1.454.CMB.1.raw
  modified_base (498)..(498): a, c, t, g, unknown or other
  misc_feature (498)..(498): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggagcgtggtccagcctggggagtccctgagactctcctgtgcagcctctggattcgtctctagtgtctaccctatgcactgggtcccgccaggcctccgaggcaaggggctgggaatggggtggcacttatctcatctgatgggaagtctgaatcttatgccgactccgtgagggccgtattcaccatctccagagacaattccaagaacacatatatcttacaaatacgaactactctagagacgtagacggacacggctggtcttattactgtgcgtatgagattgtnttaacg

SEQ ID NO: 27933 - DNA, 609 bp, Homo sapiens
  misc_feature: GYAE6OF02F8UEV.49.38.D05.1.454.CMB.1.raw
  modified_base (173)..(173): a, c, t, g, unknown or other
  misc_feature (173)..(173): n is a, c, g, or t
  modified_base (179)..(179): a, c, t, g, unknown or other
  misc_feature (179)..(179): n is a, c, g, or t
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatgggagtttgggctgagcggtgttcgctaaggcgtcttaagaggtntcagtntcatgtgcagtnatangtcgnggggancgtgtcagccgtgggacgtcctgacgtctctctgcgcactctctgtatcgtctctagtcgtctacctatcgtctacgtcggtccgcgacgtcgtcgacggacggacgggacgtaggtaggtggtggtacgtactactctactacgtcgtagagtaggtaggtacgtagtacttacgttacgtacgtaccgtaccgtacgtacggtacggtacgtacctacctaccgtacctaccgtacgaacggtaacgtaactaactaacgtaaacgaaactaactactactacttacgtaactaactaacgtaactacgtacgtacgtagtacggtagtacgacgtacgtacgtcgttacgttacgtacgtacgtagtacgtacgtacgtacgtagttacgttacttaacg

SEQ ID NO: 27934 - DNA, 564 bp, Homo sapiens
  misc_feature: GYAE6OF02IGKD2.49.38.D05.1.454.CMB.1.raw
  modified_base (300)..(300): a, c, t, g, unknown or other
  misc_feature (300)..(300): n is a, c, g, or t
  modified_base (344)..(344): a, c, t, g, unknown or other
  misc_feature (344)..(344): n is a, c, g, or t
tcagagtcgagagacacgaccggtgctcgatttagtatctgatagttggctctgggagacgagcccagcactggaagtcgccggtgtttccattcggtgatcatcactgaacacagaggactcacatggagtttggctgagctgggtttcctcgttgctctttaagaggtgtccagtgtcatgtgcagttgatacagtcgtgggggagcgtggtccagccgtgggaggtcctgagactctccgtgtgcagcctcgtggtattcgtctcgtagtcgtcctacctatcgcacgtcgggtccncacggcctccgaggcgaagggctagggaagtggggtgctaactnctcagttctgagtagggaacgtctagtaatctagtcgcgtactcggtaggaacgggctactcactactcgtacagtacactaactaccgaaataacactactatatacttaaccaaatcaaacctacgactacgaacgacggtagaacggacgacggtacgttctacgttaacttaacgttgagtacgaacgttagaaggtacttcggtactttaaacgg

SEQ ID NO: 27935 - DNA, 283 bp, Homo sapiens
  misc_feature: GYAE6OF02IAH3C.49.38.D05.1.454.CMB.1.raw
  modified_base (268)..(283): a, c, t, g, unknown or other
  misc_feature (268)..(283): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttccccctggcgccctgctccaggagcacctctgggggcacagcggccctgggctgcctggtcaaggctacttcctctctcgactctgagcgggctggcaaggcgcatagnnnnnnnnnnnnnnnn

SEQ ID NO: 27936 - DNA, 533 bp, Homo sapiens
  misc_feature: GYAE6OF02G93Q9.49.38.D05.1.454.CMB.1.raw
  modified_base (299)..(299): a, c, t, g, unknown or other
  misc_feature (299)..(299): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggagcgtggtccagcctgggaggtccctgagactctcctgtgcagcctctggattcgtctctagtgtcctaccctatcgacacgtgggtccnccaggcctccagggcaaggggctagggaatggggngcacttanctcatcgtgatggaagtctagaatctatcgccgactccgtagacggccgatcaccatcctcgaagagaacaacttaccaagtaaccacaactaatataccttacaaatagaacacttctagacgacgtagacggacacggacgtcggtacttagtacttagtacgcgacttggagtattagttacttaacg

SEQ ID NO: 27937 - DNA, 807 bp, Homo sapiens
  misc_feature: GYAE6OF02JV1CO.49.38.D05.1.454.CMB.1.raw
  modified_base (152)..(152): a, c, t, g, unknown or other
  misc_feature (152)..(152): n is a, c, g, or t
  modified_base (168)..(168): a, c, t, g, unknown or other
  misc_feature (168)..(168): n is a, c, g, or t
  modified_base (172)..(172): a, c, t, g, unknown or other
  misc_feature (172)..(172): n is a, c, g, or t
  modified_base (341)..(341): a, c, t, g, unknown or other
  misc_feature (341)..(341): n is a, c, g, or t
  modified_base (612)..(612): a, c, t, g, unknown or other
  misc_feature (612)..(612): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttggctgagcgtggtttcncgtggctcttttaagnggtntccagtgtcatgtgcagttcgatacagtcgtgggggagcgtggtccaggccgtggggacggtcccctaggagaccttccgccgttggtgccacggtcctcgtggtactttccggtaaccttcgtggtcgttacctaccctagtcggtccaaccggttccggggtccccnccgtaacggtccgttcccgaaagggtcccggaaagggggttcctaaacggggtgggttacggggacggtctaaccgtttaacgtcgtaccgaattccggtagggaaccgttacggggtaaacggttctacggggttaaaatttcccgtttaaggccccgaccggttaccgtacccgggtaggtaaccggggtaccgttaaccttcgaaaccccgtgtccggttaacccaaaggttacgaacccttaaattccccgaaaaaggttaaacccnccgttaaacgttaacgttaacttcccttaaaacgtacgtaaaacgcccgttaaacgtcgtttaacgggaaaaccgttcgtaaacgggacgggtaaccaaccggggtttaacttccggggttaaaacttacggttaaccttcgggttaccgtcgaaaccggttcggtaaattaccgtttaggtcccgtttaaacgg

SEQ ID NO: 27938 - DNA, 685 bp, Homo sapiens
  misc_feature: GYAE6OF02JIRQR.49.38.D05.1.454.CMB.1.raw
  modified_base (175)..(175): a, c, t, g, unknown or other
  misc_feature (175)..(175): n is a, c, g, or t
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
  modified_base (671)..(671): a, c, t, g, unknown or other
  misc_feature (671)..(671): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtntccagtgtcatgtgcagttgatacagtcgtggggggagcgtggtccaggcctggggacggtccctggagaccttctccgtgtgctagcctcgtggactttcgtctctagtcgtcctaacctntcgctacgtcgggtccncaggtcctccgaggcaaggggctagggaagttcggggtgacctacttacgccgttacagttcctagggtagtacgggaaaggttctaggtaaactttcgttacgtcggacccgtacgttccggtacgggtaacgggtccgtaactcccaaccggtacttaccgtaccgtaacggtaaccgtaaccttaaaccgtttaacccgaaaacgtaaacctaaccgtaaaccgttaacttaactttaccgttaactaaaacgttcgaaaacctacttacgtaggtaacgtacgtacgaagtaccgaacggtccgttagttacttagttaccgtcgtacgtaaccgtacgtaggtagtacgttnttaaccgttaacgg

SEQ ID NO: 27939 - DNA, 509 bp, Homo sapiens
  misc_feature: GYAE6OF02H012L.49.38.D05.1.454.CMB.1.raw
  modified_base (364)..(364): a, c, t, g, unknown or other
  misc_feature (364)..(364): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggagcgtggtccagcctgggaggtccctgagctctcctgtgcagcctctggattcgtctctagtgtctaccctatgcactggggtccgccaggctccaggcaaggggctggaatggggtggcacttatctcatctgatggaaggtctagaatcttangcccgactccgtggaacgggccgtattccacatcctccagagaacaattccaagaacacactatatcttanaatnaacactntgagacgngaagacacggcttgtcttattactgtacgcgtacgtggagtattggtctttaacg

SEQ ID NO: 27940 - DNA, 581 bp, Homo sapiens
  misc_feature: GYAE6OF02G0TQ3.49.38.D05.1.454.CMB.1.raw
  modified_base (174)..(174): a, c, t, g, unknown or other
  misc_feature (174)..(174): n is a, c, g, or t
  modified_base (408)..(408): a, c, t, g, unknown or other
  misc_feature (408)..(408): n is a, c, g, or t
  modified_base (438)..(438): a, c, t, g, unknown or other
  misc_feature (438)..(438): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttggggctgagcttggggttttcctcgttgctcttttaagnggtgtccagtgtcatgtgcagttgatacagtcgtgggggagcgtggtccaggcctggggacggtccctggagacctctcctgtcgcagcctcgtggtattcgtctctagtcgtcctacctatcgccacgtcggggtcccgccagggcctcccgagggcgaagggggtctagggtaacgtgggggtcggcctacgtttatcgtcatcgtggagtgggaagtctagtaattcttancgcgtacgtcgtaggacggcatcactatcncagacgactaactaccaagacactactatactacttaacaacgtacaaactctacgtagacgtacgtagaacggccacggtacttacgtacttacgttacgtcggtgtaccgtacgtaggtacgtagtttacgttattaacgg

SEQ ID NO: 27941 - DNA, 287 bp, Homo sapiens
  misc_feature: GYAE6OF02G3JM5.49.38.D05.1.454.CMB.1.raw
  modified_base (269)..(287): a, c, t, g, unknown or other
  misc_feature (269)..(287): n is a, c, g, or t
tcagagtcgagagacacgaccggtgctcgatttagtatctgatagttgggtttggggtgctcgatttagtatctgatagttgggtttgggggaggtgtgtcacaagatttgggccctggtcaccgtctcctcagcttccaccaagggcccatcggtcttccccctggcgccctgctccaggagcacctctgggggcacagcggccctgggctgcctggtcaaggactacttcctctctcgactctgagcgggctggcaaggcgcatagnnnnnnnnnnnnnnnnnnn

SEQ ID NO: 27942 - DNA, 707 bp, Homo sapiens
  misc_feature: GYAE6OF02G07Q3.49.38.D05.1.454.CMB.1.raw
  modified_base (177)..(177): a, c, t, g, unknown or other
  misc_feature (177)..(177): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcgttgggttttcctcggttgcttcttttaaaggnggtcgtccagtgtcatgtgctagttgatacagtcgtgggggagcgttcggtccagtccgtggggacggtccctggagtacctcgtccgtggtcgccgtacgtccttcgtcggtatttccgtcttcgtagtcgtaccttaccctagtcgcctacggtcgggtcccgccgacggcctaccgagggacgaaggggctagggaacggttggggtacggtctaacgttacttcctacgtagtgttcggtaggtaacggtaggttctagtacttcgttagtccgtaccggtcggtccggtaacgggtacgggtacccgttactacccgaccgtacttacccgtaccgaacggtaacgtaacctaaacgtttaacccgaaacgtaacctaaacgtactaacgttacttaacgtaaactaagtacgaacctacgtacgtaaggaacgtacgtacgaacggtccgacggttactacgtttacgtaacgttacgtgtacgtaccggtagtaaggttccgtagtttccgttaattaaccgg

SEQ ID NO: 27943 - DNA, 689 bp, Homo sapiens
  misc_feature: GYAE6OF02J09H0.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggtttcctcgtgcttcttttaagaggtgtccagtgtcatgtgctagttgactacgagttcggtgggggagtcgttggtccaggcccgttggggacggttccctggacgtccttcgtcctgtgcctagtcctcgtgtattccgtctcgtagtcgtcctacccgtatcgtcgtacgtcggtccgccgtacggtcgtccgaagggcctaacgggggaccttggggtaacgtggggtacggtcctaacgttcgtcttaccattcgtcggaaggtttacgggaaacggttctacgtaagttcgttacgtacgtccggtacgtaccggtacggaacgggtaccgttaccgtactacctaccgtacgtaccaacgtacggtaacctaaacttacccgaaacgtaaccaacctactaagtttactacttaacaaactcgtaacctactacgtaacggacgtaacggtacgaacgggactaccggtaccttaacgttacctacttaccgtgtacggtctacggtacgtaaggtacgttacgttacttaacgg

SEQ ID NO: 27944 - DNA, 775 bp, Homo sapiens
  misc_feature: GYAE6OF02JO7GQ.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggtttcctcgttgctcgttttaagaggtgtccagtgtcatgtgcagttgatacagtcgtgggggagcggtggtccgaggtcctggggacggtcccctggacggacttcgtccgtgtcgctaggccctacgtgggtatttccggtctcgtacggtacggttccgtacccctagtcgcgtacgttcgggggtcccgtccaagggtccctaccggaacgggccgtaaacgggggcccttaggggtaaacgtgggggttacggaccgtacgtttaacgtccgtccgtaattccgtaagggtagtacggggtaaacgttcgttaaggtaacttttccgtttaaggccggtaccccgtaagttcccggttaaggtaaaccgggggtaccttaacggttcccggaaacccttagttacccgttaaccgaacggtaaccgtaaccgttaaacgtttaccccgaaaggtaaaccctacgtaaacgttacttaaccgttacctttaaacgaaacgtacgtaaaccctacgttacggtaacgaacgggttaaccgtagggtaaccgacgtaacggtccgttaggtaaccttacggttcgtaagtcggacgtacgcgtaacggtgttactacgtttaacgg

SEQ ID NO: 27945 - DNA, 691 bp, Homo sapiens
  misc_feature: GYAE6OF02IATGY.49.38.D05.1.454.CMB.1.raw
  modified_base (172)..(172): a, c, t, g, unknown or other
  misc_feature (172)..(172): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctacttttaagnggtgtccagtgtcatgtgcagttgatacagtcgtgggggagcgtggtccaggccgtgggacgtccctgagctctcctgtgcacgtcctcgtggacttcgtctcttagtcgtcctacctagtgcctacgtcgggtcccgccgaggtcctccgagggaccgaagggggcgtagggaagtgggggtcgctacttactccgtatactcgtaggtagtagggaacggttctagtaacttcgttagccgtacccgtacgttccggaggtaccgggtaccgtacgttaccaacctactcctaccgaaggtaacgaacctaaacgttaacccgaaagtaaccctaactaaccgtaaattacctttaaccttaaacctaaagtaccgaaacctaccgttacgtaacgggtaaccggtaacgggtacgaacgggtaacccgaccggttcttaccggttaccttaagtttaccgggttacgtacggtcgtaccggttaggtacgttaacgtttcggttaccgtttaacgg

SEQ ID NO: 27946 - DNA, 691 bp, Homo sapiens
  misc_feature: GYAE6OF02FPVCV.49.38.D05.1.454.CMB.1.raw
  modified_base (171)..(171): a, c, t, g, unknown or other
  misc_feature (171)..(171): n is a, c, g, or t
  modified_base (278)..(278): a, c, t, g, unknown or other
  misc_feature (278)..(278): n is a, c, g, or t
  modified_base (301)..(301): a, c, t, g, unknown or other
  misc_feature (301)..(301): n is a, c, g, or t
  modified_base (393)..(393): a, c, t, g, unknown or other
  misc_feature (393)..(393): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagnggtgtccagtgtcatgtgcagttgatacagtcgtgggggagcgtggtccagccgtgggacggtccctgacgactctcctgtgcagcctctggattcgtctctacgtntctaccctatcgcacgtcggccnccaggctaccgaggccgaaggggtctagggacttgggggtcgtcgtattactctcgatctaggtatgggaagttctagtaacttcgtttacncggtacccgtacgttaccggtacgggtaacggggtacccgtacttaccgtaccgtaacgttacccttacccgaaagtaaccgtaaccgttaaacttaacccgaaaacggaaaccctaaacgacctttaactaactttaccttaaacgaaattaccggtaaacctaccgtttaaccacgggtaaacttacgggtaccgggaaccgggtacgtaccggggtacttacggtttaacttacgtttaacggtggtaccggtacccgtcggttacgttaggagttttccgttaagttttaacgg

SEQ ID NO: 27947 - DNA, 780 bp, Homo sapiens
  misc_feature: GYAE6OF02I5E51.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcttgggttttcctcgttgcttcttttaagaggtgtccagtgtcatgtgctagttgatacgagtcgtgggggagcgtggtccagccgtgggacgtcccgtgacgtacctctccgtggtcgacacgtcctagtggtacttccgtcttcgtagttcgttcctacccttagtccgtacctcggttccgggtccccgaccgtacggtccttcccgagggaccgaaggggtcgtaaggggtaagtgggggtccgacttaccgtttaatcccgtagtacttacggtaggtaacgtaggtaaacggtttctacgtaatttccgttaagtccgtaccgtaccgttacggtacgggtaacgggtaccaacgttacgttaccccgaaccgttaacgttacccgtaccggaaacgtaacggtaaaccctttaaaccgtaaaccctaaaggtaaacccaaacgtttaacctaaactttaaccgttaaccgttaaaacggtaaacttacccggtaaacttaacccggtagttaaaccggaaacgggtcgtaaaccgggacggtaaccgtcggttacgttaccgttaccgtttaaacgttaccgtggtaaccgttcggaaccggttggtaacgttacggttagtttaacccg

SEQ ID NO: 27948 - DNA, 630 bp, Homo sapiens
  misc_feature: GYAE6OF02FR75H.49.38.D05.1.454.CMB.1.raw
  modified_base (172)..(172): a, c, t, g, unknown or other
  misc_feature (172)..(172): n is a, c, g, or t
  modified_base (259)..(259): a, c, t, g, unknown or other
  misc_feature (259)..(259): n is a, c, g, or t
  modified_base (306)..(306): a, c, t, g, unknown or other
  misc_feature (306)..(306): n is a, c, g, or t
  modified_base (344)..(344): a, c, t, g, unknown or other
  misc_feature (344)..(344): n is a, c, g, or t
  modified_base (377)..(377): a, c, t, g, unknown or other
  misc_feature (377)..(377): n is a, c, g, or t
  modified_base (390)..(390): a, c, t, g, unknown or other
  misc_feature (390)..(390): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgcttcttttaagnggtgtccagtgtcatgtgcagttgatacagtcgtgggggaggcgtggtccagcctgggacgtcctgacgactctctgtcgcagcctntggattcgtctctagtgtcctaccctatcggtccacggtcgggtccnccgaggtccacgaggcgaaggggctgggaagttggggngactatttgcttcatgtggagttgggaaacgtntagaatttcttanacggcccgtactcggtaggaacgggtacctagttaccaccgtacttcctaccgacgaacgtaactaacctacctaacgtaaaccaactaacttaacttagttaccttaacgaaattacgaaaccttacgtacctaggaagtaccgtaaggacggtaccgtacggtacgttacgtaacgtttacgttacgtaggttaccgtacgttaccggttagtaggtacttacgtttacgtttaacgg

SEQ ID NO: 27949 - DNA, 760 bp, Homo sapiens
  misc_feature: GYAE6OF02JQXLD.49.38.D05.1.454.CMB.1.raw
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (308)..(308): a, c, t, g, unknown or other
  misc_feature (308)..(308): n is a, c, g, or t
tcagagtcgagagacacgaccggtgctcgatttagtatctgatagttggctctgggagacgagcccagcactggaagtcgccggtgtttccattcggtgatcatcactgaacacagaggactcacatggagtttgggctgagtctgggttttcctcgttgcttcgttttaagaggtgtccagtgtcatgtgatagttgatacagtcgtgggggagcgtggtccaggccgtgggaggtccctgacgctctcttgngacngcctcgtggattcgtctctagtcgtcacctatcgcgtacgtcgggtcccncgacggcctaccgagggaccggaagggctagggaaggttcggggtcggaccttacgtttagtcccgttacacgttaccgtggttaacgtaacggggtaaggttcctaaggtaagttccgtttaagcccgggtcccgttacgttaccgggttacgggaaaccggggttaccctagttaccccgaaaccgttacctacgtaaaccggtaacgaaaccgttaaccgtaaacccgtttaacccggaaaacgaaacctaacccttaaaccgtttaaacttaccctaaacgttaaccctaaagtaaccgtaaaaccttaccgttacgtacggaaacggttaaacgggttacgaacggggtccctaacgggttaccgttcggtttaaaccttaggttaacccgttggttacccggtaccggtaagtaggttaacggttacgttcggtttaacttaccgg

SEQ ID NO: 27950 - DNA, 753 bp, Homo sapiens
  misc_feature: GYAE6OF02IIBQ1.49.38.D05.1.454.CMB.1.raw
  modified_base (303)..(303): a, c, t, g, unknown or other
  misc_feature (303)..(303): n is a, c, g, or t
  modified_base (326)..(326): a, c, t, g, unknown or other
  misc_feature (326)..(326): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttggctgagcttgggttttcctcgttgcttacgttttaagaggtgtccagtgtcagtgtgcagttgatacgaggtcgtgggggagcgtggtccagccgtgggacgtccgtgacgtacctcgtccgtgtcgcagtcctcgtggattcgtctacttgtcgtcctaacccttntcgcctaccggttcggggtcccnccgtaacggtcccgttaccggaacgggaccggaaacgggggtcctaaggggtaacgttcggggggtacggtacccgtaagtttaaccggtcccttacgactttaccgtgggtaacgttacggggtacgtccgtaagttaaaccgttcgttacgacgtcccgtacggttccggtaaggaaccgggtcctaacgttaccgaaccctcgttacctaccggaagtaactaacctaaccgttaacaaaccgttaacgacctaaacgtactacgttaccttaacgaaacgtaccgtaaacctacgttacgacggtaaccgtaaggacggtaccggacctacggggtttacttcgttaaccttaacggttaccgttaacggtaccgtaccggttacgtaggttaacgttccgtttacgtaaacggttttaacgg

SEQ ID NO: 27951 - DNA, 562 bp, Homo sapiens
  misc_feature: GYAE6OF02JM5YJ.49.38.D05.1.454.CMB.1.raw
  modified_base (256)..(256): a, c, t, g, unknown or other
  misc_feature (256)..(256): n is a, c, g, or t
  modified_base (306)..(306): a, c, t, g, unknown or other
  misc_feature (306)..(306): n is a, c, g, or t
  modified_base (400)..(400): a, c, t, g, unknown or other
  misc_feature (400)..(400): n is a, c, g, or t
  modified_base (498)..(498): a, c, t, g, unknown or other
  misc_feature (498)..(498): n is a, c, g, or t
  modified_base (536)..(536): a, c, t, g, unknown or other
  misc_feature (536)..(536): n is a, c, g, or t
  modified_base (541)..(541): a, c, t, g, unknown or other
  misc_feature (541)..(541): n is a, c, g, or t
  modified_base (557)..(557): a, c, t, g, unknown or other
  misc_feature (557)..(557): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctgttgcttcttttaagaggtgtccagtgtcatgtgctagttgatacagtctgggggagcgtggtccagccgtgggagtccctgacgtactctcctgtcgacngcctgtggtacttcgtctctagtcgtcctacctatcgactcgtcgggccnccaggcctaccggaggcgaaggggctagggagtcggggtgactattactcgtacagtcgtagtagtacgggaacgttctagtaacttcgttacncggtcctacgtcgtacggtacgggcctatcacctatctacagactaatactacaacgacactactatacttacgtacaaattccgaactactcagganacgtgacgtacaggtcctacgttactagtacgtcgtanacgtntagtagtatacggttntaacg

SEQ ID NO: 27952 - DNA, 224 bp, Homo sapiens
  misc_feature: GYAE6OF02IYZAM.49.38.D05.1.454.CMB.1.raw
  modified_base (172)..(172): a, c, t, g, unknown or other
  misc_feature (172)..(172): n is a, c, g, or t
  modified_base (177)..(224): a, c, t, g, unknown or other
  misc_feature (177)..(224): n is a, c, g, or t
tcagagtcgagagacacgaccggtgctcgatttagtatctgatagggttgggtttgggggaagaggaagactgacggtccccccaggagttcaggtgctgggcagagcggccctgggctgccctggtcaaggactacttcctctctccgactctgagcgggctggcaaggcncatgnnnnnnnnnnnnnnnnnnnnnnnnnnnnnnnnnnnnnnnnnnnnnnnn

SEQ ID NO: 27953 - DNA, 669 bp, Homo sapiens
  misc_feature: GYAE6OF02JFVFX.49.38.D05.1.454.CMB.1.raw
  modified_base (309)..(309): a, c, t, g, unknown or other
  misc_feature (309)..(309): n is a, c, g, or t
  modified_base (328)..(328): a, c, t, g, unknown or other
  misc_feature (328)..(328): n is a, c, g, or t
  modified_base (633)..(633): a, c, t, g, unknown or other
  misc_feature (633)..(633): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcttgggttttcctcgttgcttacttttaaggaggtgtccagtgtcatgtgctagttgatacaggtcgtgggggtagcgtggtccaggcctggggacggtccctgacgacctctccgtggtcgcagtccctgtagtacgtttcgtacgtcctagtcgtcctaacctntcgctacgtcggggtcccncgaggtccctcgaggtacggaacggggtctaggggtaacgtgggggtacgacctaaccgtttagtcctaacgtacttctagggtacgttacggggtaaacggttctacggtaaatttcgtaacgtcggtacccgtaacgtccggtaggtacgggcctacttccgaccgttactccggtacgagtaccgaacttaaccgactaaacgacaaccgtacttaactcttaacgtaactaaagtacaaccgttacttacgacgtaacgacgtagaaccgggtcacgtacgttggttacctagttaccggngtacgcgtacttaggccgttattcgttaacttacgg

SEQ ID NO: 27954 - DNA, 699 bp, Homo sapiens
  misc_feature: GYAE6OF02HOUZ5.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagaggactcacatggagtttgggctgagctgggttttcctcgttgctcttttaagaggtgtccagtgtcatgtgcagttgatacagtcgtgggggagcgtggtccagccgtgggacgtccctggagctctcctgtgcagcctcgtggtacttcgtctctagtcgtcctaccctatggacacgtcgggtccgcgaggcctccgagggcgaaagggggtctagggaacgtcgggggtaggcctacgtttagtcctacattccgtaggaacgttggggaaggttctaggtaaacttcgttagtccgggtacccgtaccgttccgggtacgggtaaacggggtcccgtaacgtttacccgaaccttactacccgtaccgtaacggaaccgtaaaccgttaaacgttacccgaaaacgtaaaaccctaacgtaaacgttaacttaaccgttaccgtttaaacaaaagttaccgaaacctaccgttacgtaggaacgtaacggtaggaacggaccgtacggtacgtacgttcttaacgttacgtacggttacggaccgtacgtacggtagttacgttacgttacttaacgg

SEQ ID NO: 27955 - DNA, 745 bp, Homo sapiens
  misc_feature: GYAE6OF02IDMB3.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcttgggttttcctcgttgcttctttttaagaggttcgtccagttgtcattgtgactagtttgatactaggtcgtggggggagcgtggtaccaggtcctgggacggtccctggagtcctctccgtgtcgcagtcctcgtgtacttccgtctcgtagttcgtcctaaccctatcgcctacgttcgggtccgaccgaggtcccaccgtagggaccggtacggggcgtagggtaaggtggggtacggaccttacgttacttccctactagtccgttagacggttaggtaacggttcgtaagtacctttcgttaacgtaccgttcccggtaccgttacgggtacgggtaaacggggtacccgttaactacccgtaacccttaccttacccgtaaccgtaaggtaacgtaaaccgttaaacctaacccggtaaaactaaaccctaaactaacttaaaccttacgttaaccctaaacgttaacgtaaaccgtaacctacgttacgtacgtaagccgggtaagaaccgacgtacggttaccttacggtttacttaacgttcgttacgacgttacgtaccgtaggttaactagttaccgtttagtttaacg

SEQ ID NO: 27956 - DNA, 838 bp, Homo sapiens
  misc_feature: GYAE6OF02HVBDR.49.38.D05.1.454.CMB.1.raw
  modified_base (183)..(183): a, c, t, g, unknown or other
  misc_feature (183)..(183): n is a, c, g, or t
tcagagtcgagagacacgaccggtgctcgatttagtatctgatagttggctctggggagacgagcccagcactggaagtcgccggtgtttccattcggtgatcatcactgaacacagaggactcaaccatgggtgtttgggctgagcgttcgggttttcctcgttagcttacgtttttaaggnggtcgtccagttgtctatgtgctagttgaatacgcggttcggtgggggacggtcggttggtacccacggtcgttggggacggttccctggacgtacctcgttccttggccgcgtacgtcctcgttggactttccgacttacgttacggttcttccttaaccctagtcgacccgtacgtccggggtaccctccggacggtcctaccggaagggtacgggtaacggggtcgtaagggacggttgggggtacgacgttaccgtttactaccggtttaccacttcggtaaggtaaggttacggtaaaggttctagttaaacgtttccgttaacgtacccggtaccgtaccggtacgggtaaccggtaccggtacccgttaactacccgtacccttacgtacccgtacgtaaacggtacgtaaaccttaaacgtaaccgaaacaaccttaaactaacgttaacctttaaacctttaccttaaaccgtaaacgtttaacgtaaacccttccgttaaaccggtaaggtacccggtaaacgggttagaacccggtacggtacccgggttagtttacggttaaaccttttaacgggtcccgtttaacggtacggtaccgtaacggttacggttaaccggtttacgttacgttttaacgttaacg

SEQ ID NO: 27957 - DNA, 590 bp, Homo sapiens
  misc_feature: GYAE6OF02FPDX0.49.38.D05.1.454.CMB.1.raw
  modified_base (174)..(174): a, c, t, g, unknown or other
  misc_feature (174)..(174): n is a, c, g, or t
  modified_base (259)..(259): a, c, t, g, unknown or other
  misc_feature (259)..(259): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatgggagtttgggctgagcttgggttttcctcgttgcttcttttaagnggtgtccagtgtcatgtgcagttgatacagtcgtgggggagcgtggtccagcctggggagtccctgagactctctgtgcagcctntggtattcgtctctagtgtcctaccctatcgctacgtgggtccgccgacggcctccgagggcaagggggctagggaagtggggtgactacgttatcctcatctagagtggaagtctagtaatcttagcgtccgacgtccgtaggacgggccgtattccaccactcctaccacgacgtaactaactaccgaaacgaaccaactactaactacttactaactaaatacgaactacttacgacgaacggtacgtacggaaggacctaccggtcgttcgttacttaacgttacgtaggtacgacgtacgtacggaagtagttacgttacttaacg

SEQ ID NO: 27958 - DNA, 613 bp, Homo sapiens
  misc_feature: GYAE6OF02GFVAN.49.38.D05.1.454.CMB.1.raw
  modified_base (172)..(172): a, c, t, g, unknown or other
  misc_feature (172)..(172): n is a, c, g, or t
  modified_base (265)..(265): a, c, t, g, unknown or other
  misc_feature (265)..(265): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcttgggttttcctcgttgctcttttaagnggtgtccagtgtcatgtgcagttgatacagtcgtggggggagcgttggtccagtccgtggggacggtccctgacgcctcctctgtgcagcctntggattcgtctctagtgtctaccctatgcacgtcgggtccgccgaggtcctccgaggtccggaagggggcctagggaacgtggggtggcgtactttatctcatcgtagagtagggtacggtctagtaattacttagtcgaccgtaccgtccggtagggaccgggtccgtacttaccacctatcctccaagacgactaacttacccaaagaaccaactacttataacttaccgttaacaaactacgaaacctactccgtagacgtacggtagacggtacgaccggtcgtactacgttacgttacgtcggtcggtacgtaacgtcgtaggtagtttacgttacgtttaag

SEQ ID NO: 27959 - DNA, 699 bp, Homo sapiens
  misc_feature: GYAE6OF02GN89D.49.38.D05.1.454.CMB.1.raw
  modified_base (172)..(172): a, c, t, g, unknown or other
  misc_feature (172)..(172): n is a, c, g, or t
  modified_base (253)..(253): a, c, t, g, unknown or other
  misc_feature (253)..(253): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatgggagtttgggctgagctgggttttcctcgttgctcttttaagnggtgtccagtgtcatgtgcagttgatacaggtcgtgggggagcgtggtccagccgtggggacggtccctgagctctctgtncagcctgtggtacttccgtctcttagtgttacctacccttatcgactacgttcggggtcccgaccgtaggtccctccgaagggtaccgaagggggtcctagggaagttcgggggtacgcctaacgtttatcctactacgttctaggtagtaggggtaacggttctaaggtaatttcctttagccggtacccgtacgtttaccggagggtaacgggtcccgtacgtttacccaacccgtattcccgtaaccgaaggtacgtaaaccgttaacgtaccctaaagaaaccctactaacttaacgtacttaccttaataaataccgaacttacgtcgtaagtacggtaacgtggaacggtaccgtacggtacgttgtaccttttaacgttccgttgggttaccgaccggtaccgttagggtacgtaaggttttccggttaactttaacgg

SEQ ID NO: 27960 - DNA, 801 bp, Homo sapiens
  misc_feature: GYAE6OF02IGWJX.49.38.D05.1.454.CMB.1.raw
tcagagtcgagagacacgaccggtgctcgatttagtatctgatagttgggctctgggagacgagcccagcactggaagtcgccggtgtttccattcggtgatcatcactgaacacagaggactcaccatgggtagtttgggctggagtcgttgggggtttttcctcgttggtcttcgttttaaaggaggttgtccaagttgtctatgtgcgtagttgatcgtaggtcgtgggggagtcgtggtccagccgtgggcgtcctgacgtacctctccgtgtgccacgtccgttcgtagggtactttccggtcttcgtacggttcggtaccctaccctagttcggaccgtaccggtcggggttaccgcccgtagggtcccttccggaagggcggtaaacgggggtccttaggggaagggttgggggtacggtaccgttaactttacgtccgtaccttaacgttcggtaggtaggttagggtaacgtttcgtaaggtaacttccgttaagtccgtacccggtacgttacccgggtagggaaacccggtaccgttaacttacccgtaacctaccgttaacccgacgtaaacggtaaccttaacttaaacctaaacggaaacctaaacgtaccctattaacgttaacttaccgttaaacaaacgtttaccgaaccttcgttaacgggtaatacgggtaacctagggtaaaccgcgttaaacgggttcttacgttaaaccttaagggttcccgtagggtacccgttagtacccgtagggtcctttaaggttaccgtttaacgttaaccgg

SEQ ID NO: 27961 - DNA, 841 bp, Homo sapiens
  misc_feature: GYAE6OF02JO3YT.49.38.D05.1.454.CMB.1.raw
  modified_base (190)..(190): a, c, t, g, unknown or other
  misc_feature (190)..(190): n is a, c, g, or t
  modified_base (196)..(196): a, c, t, g, unknown or other
  misc_feature (196)..(196): n is a, c, g, or t
  modified_base (360)..(360): a, c, t, g, unknown or other
  misc_feature (360)..(360): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagttgggctgagcttggtttcctcgttgctacttttaaggaggtgtccagtgtcatgtgntagttnatacaggtcgtgggggagtcgtggtccaggtccgtagggacgtccctagacgactctctgtgcagcctgtgacttcgtactgtacgtcgttacctacctatcgtctacggttcggtaccgtccgacggtcctacgagggcgaaggggtctagggacgtggggtnacttacgtactctactagtctagagttagggacgttcaagttacgttacctttagacggtacccgtaccgtaccggtacggtaaccgggtaccgttacgtacccgtaaccgtaccgttaccgtaacccggtaacgtaacgtaaacccgttaaaccgttaacccgtaaacggtaaaccaaccgttaaccgttaacttaacccgttaaccgtttaaaccgtaaacgttaccggtaaacgtaacccgtttaacgtaaacggttacccgggttaaacgttaacgggggaacccggtaaccgggttaacccggggttaaccgttaacccgggttttaaaccgtttttaaaccgggtttttaaacccccgggtttaggggttaacccgtttaaaccccccgggggttaaacggttttaaccccgggttaaacgggtttaacccggtttttttacccgggtttaaacggttttttaaaaccccggggg

SEQ ID NO: 27962 - DNA, 704 bp, Homo sapiens
  misc_feature: GYAE6OF02HJQNQ.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagaggactcaccatggagtttggctgagctgggttttcctcgttgcttctttaagaggtgtccagtgtcatgtgcagttgatacagtcgtgggggagtcgtggtccaggtccgtggggacggttcccctggacgtaccgtccgttaccgtggtcgcacggtccctcgttaggtactttccgtcttacgttagtcgtaccttaccctagtcgaccgtacgtcggggtcccgaccgacggtcctaccgagggaccggtaaggggtctagggtacggtggggtacgactacgttactctacatcgtgaagtcggaaggttctacgtaacttcgttaagtccggacccgtacggtccggtacgggtaacgggtccgttactaccacccgtactaccgttacgaggacgtaaactaacgttaaccgaaactaacctaacgtaacttaccttaacgttaccttaaacgtaaacgtacctaaacgtacttaccgaacggtaacgtaccggtaggaaccggtaccgtacggtacgttacgttaacttcgttaacgtcggtacgtacgacggttagacgttacgtcgtttaacttaacg

SEQ ID NO: 27963 - DNA, 813 bp, Homo sapiens
  misc_feature: GYAE6OF02H05EE.49.38.D05.1.454.CMB.1.raw
  modified_base (247)..(247): a, c, t, g, unknown or other
  misc_feature (247)..(247): n is a, c, g, or t
tcagagtcgagagacacgaccggtgctcgatttagtatctgatagttggctctgggagacgagcccagcactggaagtcgccggtgtttccattcggtgatcatcactgaacacagaggactcacatggagtttgggctgagcgttgggttttcctcgttgcttacttttaagaggtgtccagtgtcagtgtgctagttgatacaggtcgtgggggagtcgtggtcccaggccgtgggacggtcccngagccttctcctgtcgcacgcctcgtggcttcgtcttcgtagtcgtcctaaccctagtcgccgtacgttcgggcccgaccgacgggtccttacggtagggaccggtaagggggtccttaggggtaaggtcgggggttacggaccttaacgtttagtccgtactaacgttcgttaggtaacgttacggggtaaacgttccgttaaacgtaacttttacgtttaacgaccgggtaccccgttaacggtttacccgggtaaggggtaacccgggtacccgttaaacgttacccgtaaccgttaaccgttacccgtaaccgtaacggtaaacgtaaaccttaaacccgtttaacccgaaaaacgttaaacccgtaaacttaaaccgttaaaccgtttaacgttaaaccgttaaaccgttaaaacgttaccggtaaaccttaacgttaccgtaaggtaaaccggtacgtaacgggtaacgtacccgtaacggtccgttaacgttacccgtttaagttacccgtggtaacgtacgtacgtacggttaagtacttttacggttaacttaacgg

SEQ ID NO: 27964 - DNA, 645 bp, Homo sapiens
  misc_feature: GYAE6OF02IXZC8.49.38.D05.1.454.CMB.1.raw
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
  modified_base (372)..(372): a, c, t, g, unknown or other
  misc_feature (372)..(372): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcgtgggttttcctcgttgcttcttttaagagtcgccagtgtcatgcgctagttcgatacagtcgtggggggaggcggtggtccaggcctggggacggtccctggacgtacgtctccgtgtcgcgagtcctcgtgtacttcgctctagtcgtctacctagtnctacgtgggtcccgtacgnggccgtcgaggcgaacggggctagggagtcggggagacttattagtccntaactcgtagcgttagggaactcgtagtacttcgtaagtcggtccgtcgtaccgtgggaacggtccgtacgttcaacctacgtaccgtacgaacggaactaacgttaataccaaacgaactaaacctactaagtaattaccttaacgaataccgaacttacgtacgtaagtacgtacgtacggaacgtaccgtacgtccgttaggttacttaacgttacgttcggttaacgtccgtaacttacggtaacgtacgtttaccgttaagtttaacg

SEQ ID NO: 27965 - DNA, 825 bp, Homo sapiens
  misc_feature: GYAE6OF02HJXJU.49.38.D05.1.454.CMB.1.raw
  modified_base (159)..(159): a, c, t, g, unknown or other
  misc_feature (159)..(159): n is a, c, g, or t
  modified_base (181)..(181): a, c, t, g, unknown or other
  misc_feature (181)..(181): n is a, c, g, or t
  modified_base (224)..(224): a, c, t, g, unknown or other
  misc_feature (224)..(224): n is a, c, g, or t
  modified_base (540)..(540): a, c, t, g, unknown or other
  misc_feature (540)..(540): n is a, c, g, or t
  modified_base (808)..(808): a, c, t, g, unknown or other
  misc_feature (808)..(808): n is a, c, g, or t
tcagagtcgagagacacgaccggtgctcgatttagtatctgatagttggctctgggagacgagcccagcactggaagtcgccggtgtttccagttcggtgatcatcactgaacacagaggactctaccatggagtttgggactgagctgggtttttccngtttgaccttagtttttaaagnggttgtacctagttgtactagtgtagctaggtttagaacgtanaggtacgtgggggaaggtcgtggttacccaggtccgttaggggaacgtccccgttaggacggaacttcgtccgtggttagaccgtaggtccgttactacgggtaaccgtttcggtacttaccgtaagttcggtccttaacccttaagttcgacccttacgggtccggttacccggaccgtaacggtccttaccccggaaggtaccgaaacgggggtaccttagggtaaaacggttgggtacccggtataacggtttaacacttaccgtattaccgtaacgagtacggaaggttcgtaaacgactttacggttttanaccgggttactaccgttaccggtaaggtaaccggtacgttacgtaccctacctaacgtacggaccttaaacggaccgtaaaacttacggttaacccaaacggtaaacctaaccgtaaacgttaaacgtttaacgttaccttaaaccgtaaacggtaaccgttaacctacgttaacgtaacggttaaccggaaggttaacccggtaaggacccgtacggtactaaccttcgaacgttacgaccgtttagaacttacgagtaaccggttnttacgggacttttaacg

SEQ ID NO: 27966 - DNA, 597 bp, Homo sapiens
  misc_feature: GYAE6OF02HRKWK.49.38.D05.1.454.CMB.1.raw
  modified_base (552)..(552): a, c, t, g, unknown or other
  misc_feature (552)..(552): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgctcttttaagaggtgtccagtgtcatgtgctagttgatacaggtcgtgggggaggtcgtggtccagccgtggggacggtcccctggacgaccttctcccgtgtcgctagccctcgtggacttccgtctcgtagtcgtcctaaccctatcgcgtacgtcgggtcccgccgaggcctccgagggcgaaggggtctgggtaagtcggggtaggcctacgttactcctacatcgtagagtagggaacgttctagtaattctagtcgaccgtctcggtacggacggtccgtactccacctatccacagacgtactaacttaccgaaataaccgactaactagtactacttaacaatacgaactactactaggacgtacgtagacggacacgtacgtntactattcgtgtacgacgtactaggtactagttcttacgttaacg

SEQ ID NO: 27967 - DNA, 702 bp, Homo sapiens
  misc_feature: GYAE6OF02FR4MI.49.38.D05.1.454.CMB.1.raw
  modified_base (278)..(278): a, c, t, g, unknown or other
  misc_feature (278)..(278): n is a, c, g, or t
  modified_base (305)..(305): a, c, t, g, unknown or other
  misc_feature (305)..(305): n is a, c, g, or t
tcagagtcgagagacacgaccggtgctcgatttagtatctgatagttggcctctgggagacgagcccagcactggaagtcgccggtgtttccattcggtgatcatcactgaacacagaggacctcaccatggagtttgggactgagctgggttttcctcgttgctcttttaagaggtgtccagtgtcatgtgcagttgatacagtcgtgggggagcgtggtccagtcctgggacgtcctgagtactctctgtgcagcctcgtggattcgtctctagtntcctaccctatcgctacgtgggtcccnccaggtcctccgaggccgtaaagggggcctagggaagttgggggtcggacctacgttactcctcgactccgtagacgtagggaacgtcgtagtaactttcgttacgtccggacccgtaaccgttccggtagggaaaccggggtcccgtaacgttacccaacccgtaacgttcccgtaacccgaaacgggtaacccgtaaccgttaaaccgtttaccccgaaaacggttaacccaacccgtaacgttaaaccttaccttaacccgttaactaaacgttacgaaacctacttaccgtacgacggtaaccgtaggtaacggaccgtacggtcgttaggttaccttaacgttaccgtagtacgtaccgtacgttacggtagtacgttacgttacgttaacg

SEQ ID NO: 27968 - DNA, 875 bp, Homo sapiens
  misc_feature: GYAE6OF02H9RP2.49.38.D05.1.454.CMB.1.raw
  modified_base (187)..(187): a, c, t, g, unknown or other
  misc_feature (187)..(187): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttggctgagctgggtttcctgttgctcttttaagaggtgtcagtgtctatgtgnagttgatacagtcgtgggggagcgtcggtccaggccgttggggacgttccctggagtacctctccgtgtcgcacgtccttcgtggtactttccggtacttcttacggttcgtacccttaacccgttatcgaccctacggttcggggtccccgaccgtacgggcctaccggaggggaccggaaacgggggtccgtaggggtaaaggttggggggtaccgggtaccttaaccgtttaagtcccttacgtaacgttcgtaagggtaacggttaacggggtaaacgggttcctaaaggttacttttacggttacgtcccgggtacccggttacggtttacccgggtacggggtaaacggggtaccccttaacggttacccctaaacccgttactaccccgtaaccccgtaaaggtaaaccgttaaacccgttaaacgtttaaccccggaaaaataaaccccgtaccgttaaacttaaacgtttaccttaacctttaaacgaaaccgtttacgtaaaccgttaccgttaaccgtaaagggtaaccgtaaacggggtaccggtaacgggtaacccggtaccgggttaccgttcggtttaaccttaaccgggtttaaccggttcggttacccggtacggttaaccggttaccgggtaacggtttaacttttacccgggtttaacgtttaaccggg

SEQ ID NO: 27969 - DNA, 855 bp, Homo sapiens
  misc_feature: GYAE6OF02H5FM9.49.38.D05.1.454.CMB.1.raw
  modified_base (505)..(505): a, c, t, g, unknown or other
  misc_feature (505)..(505): n is a, c, g, or t
tcagagtcgagagacacgaccggtgctcgatttagtatctgatagttggctctgggagacgagcccagcactggaagtcgccggtgtttccattcggtgatcatcactgaacacagagactcacatggagtttgggctgagtcgttgggttttcctgttgtcttacgttttaaggaggttcgtccaggttgtctagtgtgctaggttagactacaggtcggtggggggaggtcgtcggtccagggtccgtggggtacggtcccgtggaacggtcctcgttccgtggtcgctacggtcctcgtaggtacttccgtcttcgttagtcgttccctaccgtagtcggaccctacggtccggtacccgccgacggtccctaccgggagggaccggtaacgggggtactaggggtaacgggttcgggggtacgtaccttaacgttacgtccgttacgtagtcgtaagggtaggttaacgggtaacggttctaagtaaacgtttcgttaacncccgggtaacccgtaccggtttacgggaacggggtaaccgggtcccttaaacgtaccccgtaaccgtacgttaacccgtaaccgtaagtaacccggtaaacccgttaacctttaaacccggaaaactaaacccgttaaacctaacttaaaacctttcccgttaaaacgttaaccaaaacgttaaccgaaccgttaacgtacgttaaacgggaaaccggttaaccgtagggaaaccgggttaccgtacggttaccgttacgggttaacctttacggtacccgggttttaggcccggttaacggttaaggtaccggtaaggtttaccgttttacccggtaagtttaaacggg

SEQ ID NO: 27970 - DNA, 727 bp, Homo sapiens
  misc_feature: GYAE6OF02FMH2W.49.38.D05.1.454.CMB.1.raw
  modified_base (154)..(154): a, c, t, g, unknown or other
  misc_feature (154)..(154): n is a, c, g, or t
  modified_base (171)..(171): a, c, t, g, unknown or other
  misc_feature (171)..(171): n is a, c, g, or t
  modified_base (267)..(267): a, c, t, g, unknown or other
  misc_feature (267)..(267): n is a, c, g, or t
  modified_base (313)..(313): a, c, t, g, unknown or other
  misc_feature (313)..(313): n is a, c, g, or t
  modified_base (388)..(388): a, c, t, g, unknown or other
  misc_feature (388)..(388): n is a, c, g, or t
tcagagtcgagagacacgaccggtgctcgatttagtatctgatagttggctctgggagacgagcccagcactggaagtcgccggtgtttccattcggtgatcatcactgaacacagagactcaccatggagtttggctgagcttgggttttccngttgcttacgtttaagnggtgtccagtgtcatgtcgctagttgattacaggttcgtggggggagcggtggtccagtccgtgggacgtcctggagcttcgtctgtgcgagcctntggcttcgtctctagtcgtacctacctagtcgcacgtcgggtcccncgagtcctaccgtaggacgaggggtccgtaggaacgtggggtagtaccgtactttagtccttacgtataccggtntaacggttagggtaaacggtccgtaaggtaacttcgtttagtccgtacccggtacgttccggtaaggtaaccggggtcctaacgtttacccgtaacctacgttaccgaaccgtaacggtaacgtaaacctaacgttaaccaaagtaaacccgtaaccttaacgttaattaccgttacgttaaaactaaccgttaaccaaaccgttcttaacgtaccggtaaacggtaccggtaacgggtaaaccgacggtaccggtaccggttcgttaacctttaacggtacgttacccggaggttaccggttaacgtcggtaacggtactttaccgttacgtttaacg

SEQ ID NO: 27971 - DNA, 622 bp, Homo sapiens
  misc_feature: GYAE6OF02G6IWC.49.38.D05.1.454.CMB.1.raw
  modified_base (172)..(172): a, c, t, g, unknown or other
  misc_feature (172)..(172): n is a, c, g, or t
  modified_base (352)..(352): a, c, t, g, unknown or other
  misc_feature (352)..(352): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcttgggttttcctcgttgctcttttaagnggtgtccagtgtcatgtgctagttgatacagtcgtgggggaggcgtggtccagccgtggggacggtccctgacgactctcctgtgcagcctgtggattcgtctctagtgtccttaccctatgcacgtcgggtccgccaggcctccgaggcgaaggggctagggatggggtgactacttanctcatctgagtggtaagtctagaacttcgttagtcgaccgtacgttccggtaggaacgggtccgtaattccaacctatcccgtacaagtacgtaactaacttacccgaaaagaacaacctaactaactaacttaccttaaacaaacttacgaaactaccttactaacggacgtaacggtaggaacgggtaccaccgggtacttacgttacttaacgttacgttgttacggaccgtaacgttaggtaactaacgtttcgttactttaacgg

SEQ ID NO: 27972 - DNA, 687 bp, Homo sapiens
  misc_feature: GYAE6OF02G9VQK.49.38.D05.1.454.CMB.1.raw
  modified_base (253)..(253): a, c, t, g, unknown or other
  misc_feature (253)..(253): n is a, c, g, or t
  modified_base (580)..(580): a, c, t, g, unknown or other
  misc_feature (580)..(580): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagctgggttttcctcgttgcttcttttaagaggtgtccagtgtcatgtgcagttgatacagtcgtgggggagcgtggtccaggctgggagtcccgtgagactctctgtcgcngtcctcgtaggatttcgcttcgtagtcgtacctacccgttatcgcgtaacggttgggtcccgtcccgagggtcctaccggacgggtccggtaaaaggggggtcctagggaagttacggggggttcgggaaccttacggttttaactccgttacgtaacgtttcgttaacgggtaaccgtaggggttaaacggtccgttaagttaaccggttgttaacgttacgggtacccgttaacgtaccggtaggtaacggggtccgtaactccgtaaccctagttcccgtacgacggtacgacttaacttacaaggaacaacgtacttaacgtnttacccgtaagaacctacgaactacgttcaagtagagttcgaacggacgtggtactacggttctattaccgtgacgtccgtagtacgtggtattccggttattaacg

SEQ ID NO: 27973 - DNA, 727 bp, Homo sapiens
  misc_feature: GYAE6OF02HPT03.49.38.D05.1.454.CMB.1.raw
  modified_base (443)..(443): a, c, t, g, unknown or other
  misc_feature (443)..(443): n is a, c, g, or t
  modified_base (486)..(486): a, c, t, g, unknown or other
  misc_feature (486)..(486): n is a, c, g, or t
  modified_base (530)..(530): a, c, t, g, unknown or other
  misc_feature (530)..(530): n is a, c, g, or t
  modified_base (581)..(581): a, c, t, g, unknown or other
  misc_feature (581)..(581): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctagagtcttgggttttcctcgttgcttacgttttaagaggtgtccagtgtctatgtgctagttgatacgaggttcggtagggggacgtcggtcggtaccaggtccgtagggggtacgtcccgtagaacgtaccttccgttaccgttggtcgccgtacgtcccttcgtaggtactttccgtcttcgtacgttcgttacccttacccgtagtcgaccgtaccggttcgggtaccccgaccgaggtcctacccggagggcggtaaaggggccgttaagggaagttcggggtagacctaacgtttacncctactagtcgtaggtacgtaggtaacggtctaagtaacgttntagtcgtcgtacgtcggtaaggaaccgtcctatacctaaccgtntaccctagaagtaacaaccttaactaacgaaacgtaaccctatactttaanacgttaacctaaataaactcgaaacctttccgtgttaaggactaacgtggaaccgacgtacggttactttaggtaaccttaggttcccgtagggtaccgacgttttaacggagttaccgtttaagttttccgttacggtttaaacg

SEQ ID NO: 27974 - DNA, 718 bp, Homo sapiens
  misc_feature: GYAE6OF02IGO4M.49.38.D05.1.454.CMB.1.raw
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcgttgggtttttcctcgttgcttacttttaaaggaggttcgtccagttgtcattgtgactagttgatacaggtcggtgggggaggtcgtcggtccacggccggtggggacgttccctggacgtccttccttccgtgtcgcgacgtcctgttggtactttcgtctcgttagtcgttccttacctagtcgcgtaccggttcggggtcccgccgacggtcctaccggacggtacgggaacggggttcgtgggtaacgggttggggtacggtcctaatttgtcttatacttcgtagtaagtttagggacgttcgtaagtactttacgtatcggcccgtacgttaccggtagggtaaccgggtccgttaactacccgtaccgtactaccgtaccgagaaaccgtaacttaaaccttaccgaaacgtaacctaccgtaactaattaccgttaactaacgtaaacgacctaactaccgttagacgtaaacgtcggtacggacgtacggaccgtcgttaaccttacgttacttacggtacgtacggtacgtacgttacgacgttaacgttcgttacgttaacg

SEQ ID NO: 27975 - DNA, 764 bp, Homo sapiens
  misc_feature: GYAE6OF02F3AW3.49.38.D05.1.454.CMB.1.raw
  modified_base (173)..(173): a, c, t, g, unknown or other
  misc_feature (173)..(173): n is a, c, g, or t
  modified_base (191)..(191): a, c, t, g, unknown or other
  misc_feature (191)..(191): n is a, c, g, or t
  modified_base (266)..(266): a, c, t, g, unknown or other
  misc_feature (266)..(266): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcgtgggttttcctcgttgcttcttttaagnggtgtccagtgtcatgtncgagttgactacagtcgtgggggagcgtgtccgagccgtggggacgtccctaggacgacttcgtcctgtcggacncgcccttcgttcggtatttccgttcttctacgttcgtcccttaacccgtatcgcctacggttgggtcccgccgacggtcctacggacgggtacggaaggggtcgtacggtaaggttggggcgtaccttacttaccgtgttacagttcaaggtagttacggggtaagtttacgtaagttaaccttttacgttaggaccccgtacgggttaccgttacccgggtaacggggtaaccggggtaccccgtactttaaccccgaaccttccgttaccgtacccgaaggtaacccgttaaactaaccgtttaaaccgaaaccgaaccttaaccaaacgttttactaaccgtttaccttaaacgtaactaaccgtaaacttaccgtacgtaacggacggtaccgtaaggaacggtacggtaccgtgtttacggttactttacgtttaacggtttcgtaccggtacggttacgtagggttagttacgttacgtttaacgtttacgg

SEQ ID NO: 27976 - DNA, 806 bp, Homo sapiens
  misc_feature: GYAE6OF02IGB3G.49.38.D05.1.454.CMB.1.raw
  modified_base (233)..(233): a, c, t, g, unknown or other
  misc_feature (233)..(233): n is a, c, g, or t
tcagagtcgagagacacgaccggtgctcgatttagtatctgatagttggctctgggagacgagcccagcactggagtcgccggtgtttccattcggtgatcatcactgaacacagaggactcaaccagtggagtttgggctgagtcgttcgggtttttcctcgttgtccttagtttttaaggaggttcgtccaggttgttcattgtcgactaggttgaattacgaggttcggngggggggtagcggttcggtacctacggccggtggggacggttcccctggaacgtacctcgttccgtaggtacgaccgtacggtccttcggttacggttacgtttccgttcttacgtaacggttcttacccttaacccttagttacggccgtaacggttccggggtccccgaccggacggtcctaccggagggaacggaaggggtacctaggggtaacggtcggggggtacactttaacgtttcttccgttaagtacttacgggtataaacggttcggggtaaacggtttctaacggttaactttaccgtttcggtccggtacccgtaacggtttaccgggtagggaaccggggttacctaactacgaccgtactacctacgtacgaacgtaacttaacgtacgaaacgtaccaaactaactaacgttaacttaaccgtaacgaaactacgtaactacgtaacaggtaaacgacgtaagaccggacgttacggttacgttacgttaaccttaggttaacccgttgtaccggtactacggttacggtattaacgggttttccgttaacttaacgg

SEQ ID NO: 27977 - DNA, 692 bp, Homo sapiens
  misc_feature: GYAE6OF02GLFJQ.49.38.D05.1.454.CMB.1.raw
  modified_base (158)..(158): a, c, t, g, unknown or other
  misc_feature (158)..(158): n is a, c, g, or t
  modified_base (192)..(192): a, c, t, g, unknown or other
  misc_feature (192)..(192): n is a, c, g, or t
tcagagtcgagagacacgaccggtgctcgatttagtatctgatagttggctctgggagacgagcccagcactggaagtcgccggtgtttccattcggtgatcatcactgaacacagaggactcacatggagtttgggctgagtcgttcgggttttccncgttgacttacgttttaaggaggtgtccgtagtntacatggtgcgtagttgaattacgaggtcggtgggggacggcgtacggtaccaggtccgtggggacgtccctagacgtacctcgtctgtgtaccgacgtcctagttaggactttccgtagtcgttaggtcttacttacccgtatcgtactacggtcgggcctacggtagcctacgaggacgaagggtctagggagtggggtacgtactacttacgtctatacgttcgataaggtacggtaagtctaagtaacttcgttaagccgaccggtacgtaccggaacggtaacggtacggtaactaccgtaacctacgtaccttacgaagtaaccgtaactaaacgttaaccgaaacgtaaactaacaactttaaagtattaccttaaacgaataaccgaaccttacgagtaccgtaacggtaaggtacggaacgtaccgtacggttacgtaacttacttagttcgttagacggtatacgttaggtcgtaagtcgttaccttaag

SEQ ID NO: 27978 - DNA, 611 bp, Homo sapiens
  misc_feature: GYAE6OF02JYFJP.49.38.D05.1.454.CMB.1.raw
  modified_base (166)..(166): a, c, t, g, unknown or other
  misc_feature (166)..(166): n is a, c, g, or t
  modified_base (181)..(181): a, c, t, g, unknown or other
  misc_feature (181)..(181): n is a, c, g, or t
  modified_base (301)..(302): a, c, t, g, unknown or other
  misc_feature (301)..(302): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (325)..(326): a, c, t, g, unknown or other
  misc_feature (325)..(326): n is a, c, g, or t
  modified_base (328)..(329): a, c, t, g, unknown or other
  misc_feature (328)..(329): n is a, c, g, or t
  modified_base (341)..(342): a, c, t, g, unknown or other
  misc_feature (341)..(342): n is a, c, g, or t
  modified_base (345)..(345): a, c, t, g, unknown or other
  misc_feature (345)..(345): n is a, c, g, or t
  modified_base (347)..(348): a, c, t, g, unknown or other
  misc_feature (347)..(348): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
  modified_base (356)..(356): a, c, t, g, unknown or other
  misc_feature (356)..(356): n is a, c, g, or t
  modified_base (359)..(359): a, c, t, g, unknown or other
  misc_feature (359)..(359): n is a, c, g, or t
  modified_base (363)..(364): a, c, t, g, unknown or other
  misc_feature (363)..(364): n is a, c, g, or t
  modified_base (367)..(367): a, c, t, g, unknown or other
  misc_feature (367)..(367): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
tcagagtcgagagacacgaccggtgctcgatttagtatctgatagttgggtttggggtgctcgatttagtatctgatagttgggtttgggggaggtcgtgtcacaagatttcgggccctggtcaccgtctcctcagctccacaggccatcggtccttcccgtggcnccctgctccaggacncacctcgtggggccacacggccggcccgtgggcctagccgtggtcaaacggacttaccttccttctcgtacgaactcctagacggtccgggctcgggactaacgggcaccgagtacgcgnncncncncncncngcncactntanncnncgactcgcacgnngcncnncgcncncncgngcgnnganacgtactacgctctncgtgtcgtcncgngngtacgtctgtacgtcgtacgtgttacgtactcgtcttacgtcgtacgtctacgtacgacggtactacgttacgtacgtacgttaccgacgtaacgggtacggtacggttacgttacgttaacgggtacgtaaccgtaacggtacggtaaccgtacgtacgttacgttaccggttacggttacgttaggtaacgttaaccggttaccctccgtcc

SEQ ID NO: 27979 - DNA, 692 bp, Homo sapiens
  misc_feature: GYAE6OF02I1P6F.49.38.D05.1.454.CMB.1.raw
tcagagtcgagagacacgaccggtgctcgatttagtatctgatagttggctctgggagacgagcccagcactggaagtcgcggtgtttccattcggtgatcatcactgaacacagaggactcaccagtggagttgggctgagcttgggttttcctcgttgcttcttttaagaggtcgtccagtgtctagtgtgatagttagactacgaggtcggtagggggacgtcggtcggtccaggccggttggggaccggtcccgtaggtacgcttccgtccgtggtcgaccgcgtcctgtcggtattccggtcttcgtacggttcttccgtacctgtacgaccgtcggtcggtcccgccgtacggcctaccgagggaccggaacgggcgtaggtacggtggggtcgtacctacgttactcgtactactcgtagagtaggtagtacgtagaaccttctacgtccgacgtaccgtacggtacggacggtaccgtcgttaccactactccgtaactacggtaataacctaaccgttacgaaacctaacgaacttactataacgttaccttaagaacttaccggaaccttacgtcggtacgaaacggacggttaaggaacccggttacgacggttaccgttaagttaccgttgtaaccgtttggaccggttacacggtatggtaccttaggtaccttaacgg

SEQ ID NO: 27980 - DNA, 735 bp, Homo sapiens
  misc_feature: GYAE6OF02HGDSR.49.38.D05.1.454.CMB.1.raw
  modified_base (155)..(155): a, c, t, g, unknown or other
  misc_feature (155)..(155): n is a, c, g, or t
  modified_base (402)..(402): a, c, t, g, unknown or other
  misc_feature (402)..(402): n is a, c, g, or t
  modified_base (706)..(706): a, c, t, g, unknown or other
  misc_feature (706)..(706): n is a, c, g, or t
tcagagtcgagagacacgaccggtgctcgatttagtatctgatagttggctctgggagacgagcccagcactggaagtcgccggtgtttccattcggtgatcatcactgaacacagagactcaccatggagtttgggctgagcttgggttttccngttgctcttttaaggagttgtccagtgtacatgtgcagttcgatacgagtcgtgggggagcgtggccaggcctaggggacgtccctagacgtactctccgtgtcgcgagtcctgtggactttcgtcctcgttagtcgttcctaaccctagtcgcccgtaggttaccgggtcccgtaccgaggtccctacgtaacgggcgtaaaacgggggtctagggtaaagtcgggggttggacctacggtttacnccgttaccgattccgtaggtacggtacgggtaaaggtcgttaacgtaaacgtttccttaaggtccgtaccggtaacccgttaccgggtacgggtaaaccggtccgtaaacgttacctaaccgtacctacgttccgaaagggtaacctaacttaaaccgttccgaaaaagtaaccctaaacgaaccgttaattaaccgtaccgttaaacaagttacctaaccgtactaggttaacggacggtacctagggaaccgtaccgtaaccggtcttaggtaaccttaaggttcctaggtacaccggttanacggttagtacgttagttaccttaaacgg

SEQ ID NO: 27981 - DNA, 639 bp, Homo sapiens
  misc_feature: GYAE6OF02HHOJ0.49.38.D05.1.454.CMB.1.raw
  modified_base (155)..(155): a, c, t, g, unknown or other
  misc_feature (155)..(155): n is a, c, g, or t
  modified_base (169)..(169): a, c, t, g, unknown or other
  misc_feature (169)..(169): n is a, c, g, or t
  modified_base (308)..(308): a, c, t, g, unknown or other
  misc_feature (308)..(308): n is a, c, g, or t
  modified_base (321)..(321): a, c, t, g, unknown or other
  misc_feature (321)..(321): n is a, c, g, or t
  modified_base (583)..(583): a, c, t, g, unknown or other
  misc_feature (583)..(583): n is a, c, g, or t
tcagagtcgagagacacgaccggtgctcgatttagtatctgatagttggctctgggagacgagcccagcactggaagtcgccggtgtttccattcggtgatcatcactgaacacaggaggactcaccatggagtttgggctgagctgggtttccngttgctctttaagnggtgtccagtgtcatggtgctagttgatacaggtcgtgggggagcgttgtccagtccgtggggacgtccctagacgtactctccgtagtacgcagtcctgtggtacttcgtctccgtatcgtacctaccctatgtaccncggtcgggtcccncgacggtacctccgaggacgaaggggtcgtagggaacgtggggtcggacctacgttactctactatcctaggtacgtagggtaacgttcgtaagtaacttctacggttcgacccgtacgttccggtaacggtaacggggaccttacgtaccacgtaactcccgtaccgaagtaccgtaactaacgtacctaaagaaccactaactacttactattaactaataccgaatacctacgtagacgacgttagacgaccgtacgtnttacggtacttatacgtcgtacgtaccggtatcggtatacgttacgtacgtttaag

SEQ ID NO: 27982 - DNA, 711 bp, Homo sapiens
  misc_feature: GYAE6OF02HB40K.49.38.D05.1.454.CMB.1.raw
  modified_base (174)..(174): a, c, t, g, unknown or other
  misc_feature (174)..(174): n is a, c, g, or t
  modified_base (199)..(199): a, c, t, g, unknown or other
  misc_feature (199)..(199): n is a, c, g, or t
  modified_base (449)..(449): a, c, t, g, unknown or other
  misc_feature (449)..(449): n is a, c, g, or t
tcagagtcgagagacacgaccggtgctcgatttagtatctgatagttggctctgggagacgagcccagcactggaagtcgccggtgtttccattcggtgatcatcactgaacacagaggactcaccatggagtttgggctgagcttgggttttcctcgttgcttacttttaagnggtgtccagtgtcatgtgctagttnatacaggtcggtgggggagcgtggtccacggccgtggggacgtcctgacgctctccgtgtgctacgtcctcgtaggtattccgtacttctagttcgtaccctaccgtatcgaccgtaccggttccgggtcccgaccgtacggtccgtaccggagggaccggaaggggggtccgtaagggtaggtcgggggttacgaccttcgtttactctacgattgtacggtaggtagggaacggttctaagaactttnttacgcggtacccgtacgtccggtacgggacgtaccgtacctaccgactccgtccgtaacgagaacctaacgtaactaacctaaaccgaaacttccgaaatttaccttaacttccgtaaactacgtacctaaaccgttacgttacgaaggtaaccgtacggtagaacggtcccgtacggttaccttaagggttacccttacggttacggacgtaacggtacggttcgtaagtaaccgggttctttacgtttaaaccgtaccg

SEQ ID NO: 27983 - DNA, 807 bp, Homo sapiens
  misc_feature: GYAE6OF02FI9PR.49.38.D05.1.454.CMB.1.raw
  modified_base (155)..(155): a, c, t, g, unknown or other
  misc_feature (155)..(155): n is a, c, g, or t
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
  modified_base (367)..(367): a, c, t, g, unknown or other
  misc_feature (367)..(367): n is a, c, g, or t
tcagagtcgagagacacgaccggtgctcgatttagtatctgatagttgggctctgggagacgagcccagcactggaagtcgccggtgtttccattcggtgatcatcactgaacacagaggactcaccatggagtttgggctgagctgggtttccncgttgctcttttaagaggtgtccagtgtcattgtgcagttgatacngtcgtgggggagcgtggtccagccgtggggcgtccctgagctctcctgtgcagcctctgggtattccgtctcctaggtctccttaccctatcgttacgtcggggtcccncgtaggcctcgagggtcgaagggggtctaggggtaattcggggtgacctaagtttanccttgaattccgtagaaggtcggggtaaagttcctagaaacctttctttaagcggtaccccgtaacgtccgggtaacgggaaccggggtcccgtaacttaccctaaccctacgttacccgtaaccggtaaacggtaaccggtaaccttaaacgtttaacccgaaaaacggttaaaccctaaaccttaaccgttaactttaaacttacccttttaaaaccgaaaaacgtttccggtaaaaaccccttaccggttaccgttaaacggggtaaacgtaaaccggggttaacggtaaccggggtaacccggtaaccgggttccggtttaacgttaaaccgttttaaccgtttaacgggttaacggttacccgggtaaaccggttaccggttaaggttaaaccggttcttttaaccgggttttacctttaacggtttaacccggg

SEQ ID NO: 27984 - DNA, 620 bp, Homo sapiens
  misc_feature: GYAE6OF02IPUXA.49.38.D05.1.454.CMB.1.raw
  modified_base (157)..(157): a, c, t, g, unknown or other
  misc_feature (157)..(157): n is a, c, g, or t
  modified_base (172)..(172): a, c, t, g, unknown or other
  misc_feature (172)..(172): n is a, c, g, or t
  modified_base (182)..(182): a, c, t, g, unknown or other
  misc_feature (182)..(182): n is a, c, g, or t
  modified_base (188)..(188): a, c, t, g, unknown or other
  misc_feature (188)..(188): n is a, c, g, or t
  modified_base (200)..(200): a, c, t, g, unknown or other
  misc_feature (200)..(200): n is a, c, g, or t
  modified_base (291)..(291): a, c, t, g, unknown or other
  misc_feature (291)..(291): n is a, c, g, or t
  modified_base (326)..(326): a, c, t, g, unknown or other
  misc_feature (326)..(326): n is a, c, g, or t
  modified_base (417)..(417): a, c, t, g, unknown or other
  misc_feature (417)..(417): n is a, c, g, or t
  modified_base (559)..(559): a, c, t, g, unknown or other
  misc_feature (559)..(559): n is a, c, g, or t
tcagagtcgagagacacgaccggtgctcgatttagtatctgatagttgggctctgggagacgagcccagcactggaagtcgccggtgtttccattcggtgatcatcactgaacacagaggactcgaccatggagtttgggctgagctgggttttccngttgctcttttaagngtgtccagtntcatgngcagttgatacngtcgtggggagcgtgtccagccgtgggacggtccctgacgtactctcctgtgcgtacgccttcgtgggtactttcggtcttcgtacggttnttacctacccgtatcggactaccgttcggggtccnccgacggtcctccggtacggcgtaaggggtctagggaagttggggagtcaacgttatcctacgtatcgtggattcggaagtctggaacttnttagtcgaccgtacgtccggtaggacgggtcctagttacacgtactcctacgatacgactaagttaccgaaacgtaccacgtactactagtaccttaacgaaactgaaaccctgtaccgagtacgaacggtacgacgggacnccggtttactcggttatacgttcgagtacacgtacagttaccgacgtttactcgtttaacg

SEQ ID NO: 27985 - DNA, 718 bp, Homo sapiens
  misc_feature: GYAE6OF02FGR4Z.49.38.D05.1.454.CMB.1.raw
  modified_base (189)..(189): a, c, t, g, unknown or other
  misc_feature (189)..(189): n is a, c, g, or t
tcagagtcgagagacacgaccggtgctcgatttagtatctgatagttggctctgggagacgagcccagcactggaagtcgccggtgtttccattcggtgatcgatcactgaacacagaggactcaccatcggagtttgggctgacgacgtgggttttccacgttgcttcttttaagaggttgtccagtntcatgtgcagttgatacgagtcgtgggggagcgtggtccagccgtgggagtcctgagtacttctctgtcgcagcctgtggtacttcggtctgtagtcgtcgtaccctatgtctacgtggtcccaccgaggtcctccgaggccgaacggggtcttagggaacttggggtacgcttaacgttacgtccgttacgacgttcgtacggtacgttaagggtaacggttaccttaaggtaaactttcccgtttaagccgggtacccgttacgttacccgggttaaggaaacgggttcccgtaacgtttaccgaacccttaacgttacccgtaacccgtaaggaaccgttaaaccgtaaaccttacccgtaaacgtaaccaacctaaccgttaattaaccgttccttaaacgtaaacgttacgaaaccttacgttaacgacgtaacgcgtaagtaccgggacctacgggtcttagtacctacgtttaccgtacgtacgtacgtaccgtaaggtacgtacgttacgttactttaacg

SEQ ID NO: 27986 - DNA, 591 bp, Homo sapiens
  misc_feature: GYAE6OF01DVLWE.33.5.A05.1.454.CMB.1.raw
  modified_base (257)..(257): a, c, t, g, unknown or other
  misc_feature (257)..(257): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
tcagtacacacactcacgaccggtgctcgatttagatagatagacagggggctctgggagaggagcccagcactagaagtcggcggtgtttccattcggtgatcagcactgaacacagaggactcaccatggagtttgggctgagcggtggtttcgtcgtaggcgtctttaagaggtgtcagtgtcaggtgcagctggtggagtcgtgggggaggcgtggtccagccgtgggaggtccctggagctctccgtgtgcngcctcgtggcttcaccttnagtanctatgactatcgccagttcgggccacgaggcctcgaggcgaaggggctggagngggtgntagttgttaanagtgagtagaaactaagaactatagagacgagtaccgtcgaggacggacgtactcgaccgtcacgaagacgtaactaactaccaaacgtaacctacgtttgttactacgtacgaagtacgaactacgacgtaaggagtagtacgtaggacgacgtacggtagtacggttagttacgttacggtagggtacgggaagggtagtacggtaggttacggtagtttaggttacgtggtaaccgg

SEQ ID NO: 27987 - DNA, 583 bp, Homo sapiens
  misc_feature: GYAE6OF01DNRTP.33.5.A05.1.454.CMB.1.raw
  modified_base (299)..(299): a, c, t, g, unknown or other
  misc_feature (299)..(299): n is a, c, g, or t
tcagtacacacactcacgaccggtgctcgatttagatagatagacagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgacgactctcctgtgcagcctctggattcaccttcagtagctatgacatgcactgggtccncaggctcaggcaagggactggagtgggtggctgttgttacaaagtgaatggaaactaagaaacactatgacagactcgagaacgggccattcaccgtctcagagacaatccaagactaccttgtttctagactaatacgaacacgtcctaggagacgtctaggaacgggaaccgacgggtccttaggttagtttaacgttaacggttgggttacggggtaacggggggttacgaccgggtagggttacgggaccgttaagggtttacgtttaggtaaacccggg

SEQ ID NO: 27988 - DNA, 744 bp, Homo sapiens
  misc_feature: GYAE6OF01CDBO2.33.5.A05.1.454.CMB.1.raw
tcagtacacacactcacgaccggtgctcgatttagatagatagacagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtccctgagactctcctgtgcagcctctggacttcaccttcagtagctatgacatgccacgtggggtcccgccgaggcctccgaggcgaaaggggactgggaggttggggtggcgtaggtttagttacaaagtgaataggaaacctaaagaaactactagtcgacgaacggtaccgttaccggtaggaacggggtacccgtaagtttacccgtaacccggttcccgtaccgaacggaacgtaacctaaaccgtttaacccgaaaacggtaaacccttaacccgttttacgttttacccgtaacggtaaccctaaaagttacgtaaaaccgacgtaacccgtaggaacggtaacggtaccggtacggaacgggaacccgtaaccggggtccgttaagggttacggtttaacgtttaacgggttagggggttagggggaaggggggttaacggaccgggtaacggggttacgggtaacgttaacgggttttaaaggttacggttaaacccggg

SEQ ID NO: 27989 - DNA, 830 bp, Homo sapiens
  misc_feature: GYAE6OF01CE3Y1.33.5.A05.1.454.CMB.1.raw
  modified_base (333)..(333): a, c, t, g, unknown or other
  misc_feature (333)..(333): n is a, c, g, or t
tcagtacacacactcacgaccggtgctcgatttagatagatagacagggggctctgggagaggagcccagcactagaagtcggcggtgtttccattcggtgatcagcactgaacacagaggactcaccatggagtttggctgagcttgggttttcctcgttgcttcttttaagaggtgtccagtgtcaggtgcagcgtggtggagtcggtgggggagcgtggtccagccgtgggacgtccctgacgtactctcctgtcgcacgcctcgtggtacttcacctttcaaggttacgacttaagtcgaactacgtcgacctacggttccgggtcccnccgaggtccctaccggaacgggaccgaaagggggccgttgggggtaacgggttgggggtacggtaccgttaaggttttacggtttaaaccgtaaaaaggttcggtaaacggtttaaacggggtaaaaaaccctaaaaaggtaaaaacccttacgttaaggttacggaaccgtaaacggtacccgttacccggggtaagggaaaccggggtacccgttaacgttaccccgtaacccggttacccgtaacccggaaaggtaaaccgtaaaccgtaaacctttaacccggaaaacgttaaaccccgtttaaccgttttcgttttaaccgaaggtaaacctaaagttaccggaaaccgttcggacccgttaggaacggacgtaccggaggaaccggaacgtaccgggtacttggttaaccgtttagttaccggtggggttaacggggaacggggtacgacggtaagggttcgtaaccgttagtttacgttacggtaccggg

SEQ ID NO: 27990 - DNA, 938 bp, Homo sapiens
  misc_feature: GYAE6OF01C3ZTZ.33.5.A05.1.454.CMB.1.raw
  modified_base (175)..(175): a, c, t, g, unknown or other
  misc_feature (175)..(175): n is a, c, g, or t
tcagtacacacactcacgaccggtgctcgatttagatagatagacagggggctctgggagaggagcccagcactagaagtcggcggtgtttccattcggtgatcagcactgaacacagaggactcacatggagttggctgagtcttgggttttcctcgttgtcttacttttaagnggtgtccagtgtcaggtgcagctggtggagtcggtggggaggcgtggtccgagcccgtgggacggtccctagacgacctctccgtgtcgcacgtccctagtcggtaactttccgtaccctttcgaagttacgtaccttagtacggactagttaccggaccgtacggttcccgggggtcccaccggtaacggccctaccggaacgggtacgtaaacggggacgtgggaacgggttgggtacgtacgttacggttttagttaaactaaaagtcggtaaagttaaacggaaaacctaaaaacggtaaacccttagtttaaacgacggtaaaccttaaaccgggaacccggttacccggggtaaagggtaaccccggggtacctttaacccgttaacccgaaaccccggttaccccgttaaccggaaaacggttaaaccgtaaacccgtttaaaccgtttaaaccccgaaaacccgtttaaaccccgtttacccggtttttttaccggtttaacttaaacgggaaaccctttaaaacgggttaaaccgtaacccggtaaacgttaccgggtaaggtaaccggtaaacgggttccggtaaacgggggtacccgtaaaccgggtaacggttccgtttaagggttaccggttaaaggttaaccggggtttgggggtaaaacccggggggttacggggtaaagtaccgggtttaacggggtacgggtttaacgtttaaaagggtttccggtttaacccgggtaaaccgggg

SEQ ID NO: 27991 - DNA, 843 bp, Homo sapiens
  misc_feature: GYAE6OF01DRGTF.33.5.A05.1.454.CMB.1.raw
  modified_base (214)..(214): a, c, t, g, unknown or other
  misc_feature (214)..(214): n is a, c, g, or t
tcagtacacacactcacgaccggtgctcgatttagatagatagacagggggctctgggagaggagcccagcactagaagtcggcggtgtttccattcggtgatcagcactgaacacgagaggactcaccatggtagtttgggctgagtcgttgggtttttcctcggtttgtcttacgtttttaaaggaggttcgtaccgaggttgtcgaggtcncgtaggtcgttggggtgggaggttccgggtagggggggacggtcggttcgggtacccgaggtccggtaggggtaccggttcccctaggtacgtaccttccgttccgtggtcggacgtacgtcccgttaccgtaggttaacttcccgtaacccgtttacgaaggttacgtacttaagtacggaactacgttacggccgtaaccggttccggggtaccccgacggaacggtcccgtaccggaggtaccgtaaggggtacgtgggacgggttgggtcgtacgttaggtttacgttaacgaaagtggtaagtaacggtaaaacgtaaacgaaacgtctaagtcggaagtacgtaccggttaccggggtaggtaaaccgggtcccttaacgtttaccccgtaccgttaccgacgtaacggaactaacccgttaacgttaccgaaacgttaacccgtttcgttttacgttacgaacgtaacctaagtaacgtaaccgtaggtaccgttaggaaccgtaggtaccgtagggaccgacggtacgttacgtaggttaaccgtttacggttaggttcggggtacggggtacggtagtacggtagggttacgtacgtttaacgtgtcccgggtaaaccgg

SEQ ID NO: 27992 - DNA, 668 bp, Homo sapiens
  misc_feature: GYAE6OF01AY4D7.33.5.A05.1.454.CMB.1.raw
  modified_base (264)..(264): a, c, t, g, unknown or other
  misc_feature (264)..(264): n is a, c, g, or t
  modified_base (312)..(312): a, c, t, g, unknown or other
  misc_feature (312)..(312): n is a, c, g, or t
  modified_base (523)..(523): a, c, t, g, unknown or other
  misc_feature (523)..(523): n is a, c, g, or t
tcagtacacacactcacgaccggtgctcgatttagatagatagacgagggggctctgggagaggagcccagcactagaagtcggcggtgtttccattcggtgatcagcactgaaccacagaggactcaccatgggagtttgggctgagctgggttttcctcgttgctcttttaagaggtgtccagtgtcaggtgcagctggtggagtcgtgggggagcgtggtccaggcctggggacgtccctgacgctctcctgtgcagcctntggattccaccttcagtagctaatcgaactatgcacgttggggtcccncgaggcctaccgagggccgaaacggggctggggtaggtggggtggccttaggtttcgtttacaaaagttcggaagttacgggaaactaaagaaaacctacgtagtcggacaacggtaccgttccggtaggaacggggtccctaagttcccgacccgttctaccgaagtacgtacctaacgttacccaaaagtacctaccgtttgtttacgngaactaaagtcgaaacctaggcctaggacgagtccgtaggaacggtaccgacgggtctacggttaggttaactttaggtgggtacggggtaacggggtacgacggtaacgggtcggaacttaagggtttacgtcggtaaacccgg

SEQ ID NO: 27993 - DNA, 619 bp, Homo sapiens
  misc_feature: GYAE6OF01BIMHG.33.5.A05.1.454.CMB.1.raw
  modified_base (415)..(415): a, c, t, g, unknown or other
  misc_feature (415)..(415): n is a, c, g, or t
  modified_base (460)..(460): a, c, t, g, unknown or other
  misc_feature (460)..(460): n is a, c, g, or t
  modified_base (576)..(576): a, c, t, g, unknown or other
  misc_feature (576)..(576): n is a, c, g, or t
tcagtacacacactcacgaccggtgctcgatttagatagatagacagggggctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcggtgggggaggcgtggtccgaggccgtggggacggtccctggagtacctctcctgtcgccacgccttcgtggtacttcaccttcaggtagctatgactagtgcacgttcgggtcccgccgacggcctccgagggacgaagggacgtggaggtcgggtggacgtaggtttcgttaacaaatgaagtaggaaactaaagaaactactaagngacgagtaccgtacggtaggaacggtcctactaccgtaccgtacncgaagaacgaactaacttaccaaacgtacctaccgtttagttactacgaactaacgtacaacgacgaccgtagaacgacgacgtagacggaccgtacgtcgtagtgttacttaggnggtacgggagggtagacgtggacggtagtagttgtgtaaccgg

SEQ ID NO: 27994 - DNA, 735 bp, Homo sapiens
  misc_feature: GYAE6OF01A9B6S.33.5.A05.1.454.CMB.1.raw
  modified_base (177)..(177): a, c, t, g, unknown or other
  misc_feature (177)..(177): n is a, c, g, or t
  modified_base (299)..(299): a, c, t, g, unknown or other
  misc_feature (299)..(299): n is a, c, g, or t
  modified_base (703)..(703): a, c, t, g, unknown or other
  misc_feature (703)..(703): n is a, c, g, or t
tcagtacacacactcacgaccggtgctcgatttagatagatagacagggggctctgggagaggagcccagcactagaagtcggcggtgtttccattcggtgatcagcactgaacacagaggactcaccatggagtttgggctgagcgttgggttttcctcgttgcttcgttttaagnggtcgtccagtgtcaggtgcagctggtggagtcggtgggggagcgtggtccaggtccgtggggacgtccctggacgtcctctccgtgtcgcacgtcctgtaggtacttccaccttgagtacnctagtcgactagtcgaccgtacggtcggggtcccaccgtagggccctacggagggtacgaaagggtccgtgggaacggttggggtacgtaccgttaggttttcgttaaacaaaggttggaaacgtacggtaaaactaaacggaaacctacgtagtccgtacgaacggttaacccgtcgggtaaggaaccgggtccgttaacgttaccccgaaccgttcctaaacccgaaggtaaacccgtaaccctaaaccgtttaacccggtaaacgtaacccgtttaaccgttttcgtttactaacggtaactaaacgttcgaaaccgtacgtacgtacggaagtacgtacgtacgggaacgtaccgacggttcttaagtacggttagttaccggaggttggggacggttancggttaggtagtactaggtttcgtcggtacgg

SEQ ID NO: 27995 - DNA, 954 bp, Homo sapiens
  misc_feature: GYAE6OF01A0O72.33.5.A05.1.454.CMB.1.raw
tcagtacacacactcacgaccggtgctcgatttagatagatagacagggggctctgggagaggagcccagcactagaagtcggcggtgtttccattcggtgatcagcacgtagaacacagaggactcacagtgggtaggtttgggctggagtcgtttcgggtttttcctcgttgtctttacgttttaaaggaggttcgtacctaggttgtcgtagggtcgacgaggtcggttcgggtgggtaggttcggggtgggggggaggtccgggttcgggtacccgtacggtcccgggttacgggggtaccgggttccccgtaggaaccggtccctttcccgttccggttgggtcgaccgtaccggtccccgttcggttacgggttactttaccccggtaaccttttaccgtaaggggttaacggtaccttaacggtacgtaaccgtacgtcggtccggtaccgggttccgggggtacccgaccggtacgggtcccgttaccggaacgggtaccgggtaaaggggtaccggttaggggtaagggttcggggttaacggtcggtttaacggttttacgttaacgtaaaggttcggtaaaggttaacgggtaaaacgtaaaccggtaaaccgttaacgtaagtaccgtaacgtaacgggtaccggtaaccgggttaaggacccgggtaccgttacgtccccgtacggtttaccaaccggtataaaccgtaacgtaaccgttaacctaaacggtaaccctttaccggtttacgttacgaaccgtaacgtaaacgtacgaacgtacgtccggtaacgtaagggcgttaaccggaacgggtaccggtaccgttacgggttaccgttaggttaacggtttcgtagggtaacgggggtgggggttaaacggcggttacgggtagggttacgttaacggttcggtttaacggtgggttaaacccgggg

SEQ ID NO: 27996 - DNA, 895 bp, Homo sapiens
  misc_feature: GYAE6OF01DD0H7.33.5.A05.1.454.CMB.1.raw
  modified_base (188)..(188): a, c, t, g, unknown or other
  misc_feature (188)..(188): n is a, c, g, or t
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
tcagtacacacactcacgaccggtgctcgatttagatagatagacgagggggctctgggagaggagcccagcactagaagtcggcggtgtttccagttcggtgatcagcactgaacacagaggactcacagtggtaggtttggctgagtcgttcgggtttttccttcgttgtcttcgtttttaaaggnggttgtccgtaggttgtcgagggtcgacgtagcgttggggtgggtacggttccggggtgggggggtacggtccgggttcgggttaccccgagggtcccggttacgggggtaccggttccccgttaggaccgttccgttccgttccgtggtccgacgtacggttcccttcgtacggttacctttaccctaaccgtttacaagggtttacncgtttaanacgacctagttcgtaccgtacggttccggggtcccgaccggtacggcccgttaccggaacgggacggtaaacgggggtacggtggggtagggttcggggtacggttacgttttgggttttaacgttaacgttaaaagggtcggtaaaaggttaaacgaaaccggtaaaacggtaaactaccgttagtcggtaacgtaacggtacccggttaccggaacgggtaaccgggtccttaaccgttccccggtaccgttaacccgtaccgaagtaaacaaccctttaacgttaaccaaacggtttaccttaccgttttagtttaaccgacgtaaacctaagtaaccggacttaacgtaccgtagaacgttaccggaacgaccgtacgtaaccggttagttacgttaattaacggttcgtaggtcggtaaggacgggttaagggagggttacggggagggtttaccgggacggggttacccttacggggttcccgg

SEQ ID NO: 27997 - DNA, 538 bp, Homo sapiens
  misc_feature: GYAE6OF02F2V5C.33.5.A05.1.454.CMB.1.raw
  modified_base (416)..(416): a, c, t, g, unknown or other
  misc_feature (416)..(416): n is a, c, g, or t
  modified_base (440)..(440): a, c, t, g, unknown or other
  misc_feature (440)..(440): n is a, c, g, or t
tcagtacacacactcacgaccggtgctcgatttagatagatagacagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttcagtagctatgacatgcactgggtccgccaggcctccgaggcaaggggactgggaggtgggtggctagtttgttacaaagtgagtaggaaactaagaaacactatgcaagctcgtagaacgggccgtatcgaccgtctccaganacataccaagactacttgttctanactaatagaacagtcctagacgacgctaggaggacgacgctgtagtattacgtggtacgggagggtagcgtaggtcggtacgtaggtttagtagtacg

SEQ ID NO: 27998 - DNA, 903 bp, Homo sapiens
  misc_feature: GYAE6OF02I3A3Z.33.5.A05.1.454.CMB.1.raw
  modified_base (317)..(317): a, c, t, g, unknown or other
  misc_feature (317)..(317): n is a, c, g, or t
tcagtacacacactcacgaccggtgctcgatttagatagatagacagggggctctgggagaggagcccagcactagaagtcggcggtgtttccattcggtgatcagcactgaacacagaggactcaccatggagtttgggctgagcgttgggttttcctcgttgcttcttttaaggaggtgtccgagttgtcgaggtgcagcgtgggtggaggtcgtgggggagcgtcggtccagccgtgggacggtccctgacgccttctccgtgtcgcacgtccttcgtggtacttccaacctttgacgtagtctaagtcgactntcggcctacggtgggtccccaccgtaggtccgtaccgaggaccggaaaggggtcgtacggggtaggttcggggtacggtacgttaggtttacggtttaaccaaaagggttcggtaaggtttaaacggtaaaaaccgttaaaaacggaaaaccgtttacgttaattacgggaaccgttaaacgggttaacccgttaccgggtaaacggggtaaaccggggtttacccgttaaaccggttttaacccggtaccccggtaccgttaaaccggaaaccgggtaaaacggtaaccgttttaaaacccgggttaaccaaaacccggggttaaaacccctttcgggttttaccgtttaaacggtaactaaacccgttaaagttaacccggaaaacccttgggtccccgtaaaggtaaccggtaaaccgttacggtaaccgaacggtaacccggttacgggttaaccgtttaggttaaccggtttaaacgtttaaaccgggttggggttaaaccggggtaacggggtttaagaacccggttacgggttaccgggtttaaggttaacggttttaggttacccggttaacccgggg

SEQ ID NO: 27999 - DNA, 662 bp, Homo sapiens
  misc_feature: GYAE6OF02FNPWH.33.5.A05.1.454.CMB.1.raw
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
tcagtacacacactcacgaccggtgctcgatttagatagatagacagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctccggatcagattcaccagctttggcccttcactgggtcccgccgaggcctccgtggggaaggggctgggagtggctgtcatntgcttcgngggaggtgagtggtcgtcgttccgttcgtacggccggtacttccgtggtcgggacggggtccgtatttcgagtccgtacctttaccgaggtaacgaacccgaaaccgcctaaaacccgaacccgttcccctaggaccctaacgttccctccaacggtataccggaaccctaaccggtcggaccggtaacggacccggtccggaaccgaccgggtacttaacgtaacgtttaactttaccgtacgggttacgtacccgaaacgttaccggtaaccccttttaaggaccgttacgaacggttacggttacccggggg

SEQ ID NO: 28000 - DNA, 871 bp, Homo sapiens
  misc_feature: GYAE6OF02HV5CW.33.5.A05.1.454.CMB.1.raw
  modified_base (175)..(175): a, c, t, g, unknown or other
  misc_feature (175)..(175): n is a, c, g, or t
  modified_base (301)..(301): a, c, t, g, unknown or other
  misc_feature (301)..(301): n is a, c, g, or t
tcagtacacacactcacgaccggtgctcgatttagatagatagacagggggctctgggagaggagcccagcactagaagtcggcggtgtttccattcggtgatcagcactgaacacagaggactcaccatgggagtttgggctgagcttgggttttcctcgttgctcttttaagnggtgtccagtgtcaggtgcagctgggtggagtcgtggggggagcgttggtccaggtccgtggggacggtccctggagtaccttctccgtgtcgcacgtcctgtgattccaaccttcagtagcttanacgacatgcgtaccgttcgggtcccggaccgtacggccctaccggaaggggtaccgaaacgggggtcccgggtaggttcgggggtaggacgtaggtttcggtttacaaaaggttcgaaggtacgggtaaaacgttaaacggaaaacctaacgttagtacggtaaccgtacggtaccgttaccgggtagggtaaacgggggtcccgttaaacgttaccccgtacccgttacccgtaaccgtaaagggtaacgtaaccgttaaaccgttaacccgaaaccggttaaacccgtttaacccgttttacggttttaccgtacgtaaaccgtaaaacggttaacggtaaaccgtaaccggttacccgtaagggtaaacccggttacgaaccggttcggggaaacccggtaaaccgggttacgggtaccgttttagggtaacgggttttaacgtttaaccgggttacggggttaacgggggtaaacgggggttacggtaaccgggttaacggggttaccggggttacgttaacggggttttaacgggtttaccggttaacccgggttaaccgggggg

SEQ ID NO: 28001 - DNA, 644 bp, Homo sapiens
  misc_feature: GYAE6OF02I996W.33.5.A05.1.454.CMB.1.raw
  modified_base (157)..(157): a, c, t, g, unknown or other
  misc_feature (157)..(157): n is a, c, g, or t
  modified_base (298)..(298): a, c, t, g, unknown or other
  misc_feature (298)..(298): n is a, c, g, or t
  modified_base (354)..(354): a, c, t, g, unknown or other
  misc_feature (354)..(354): n is a, c, g, or t
tcagtacacacactcacgaccggtgctcgatttagatagatagacagggggctctgggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtctgggggagcgtggtccagcctgggaggtccctgagactctcctgtgcagcctctggattcgaccttcagtagctatgacatgcactgggtccncaggctccgaggcaagggctggagtggctgtcatatgcttcgtggagtgatggtcncggttcttcgtacggtcggaccttcgtggtggtacgggggccgtattcgacgtcctaccgttaccgaggaacgtaaccgaaccgtacccaaaccgtaacccgttccctaagtaccgtacttcccgtaaccctacggtaacgttacgggaaacccgtaaacccgtacgggtaccggaaccgggaccggaacccgggtaaccgtaaccgggtaccttaaacgtaacgtttaacgtttaccggttacggtacggtaccggtaacccgtaacggttaacccgtttagtaaccgg

SEQ ID NO: 28002 - DNA, 789 bp, Homo sapiens
  misc_feature: GYAE6OF02IP0YY.33.5.A05.1.454.CMB.1.raw
tcagtacacacactcacgaccggtgctcgatttagatagatagacagggggctctgggagaggagcccagcactagaagtcggcggtgtttccattcggtgatcagcactgaacacagaggactcaccatggagtttggctgagcgttgggtttttcctcgttgcttacgtttttaaaggaggtgtaccgagtgtcgaggtgcagcgtgggtggagtcggtagggggagtcgtcggtccgacgccgtaggggacgtcccgtaggtacgacctccgttaccgtggtacgaccgaacgccccgttcgttaggtactttccgtaaccgtttccgaaggttacggtctacgtagtaaacagtcggaacctaacgggttcggggtacccccgccggtacggtcccttaaccggaacggaaccggtaaacggggtacgttaggggtacgggttagggggtacgacggtttacgtttacggttaaacgaaagtggtaagtaaacggaaaacgttaaaacgaacgtaacttagaacgtacgaaccgtaccggtacggtaacggtacgggtaccgtacgtacccgtaccgaccgttaaccgaacggaacgtaaacctaaaccgtaccgtaaaacgtacccgttaacttcgttacgtacgtactaaagttaacgaaccgtagtaccgagttaacggacgtaaccgtaggaaccgaacgtcggtagtacggttagtaagttacggtggtcgggtaagggttacgacggaggttgaacggtttaacgttacgtggtaccgg

SEQ ID NO: 28003 - DNA, 648 bp, Homo sapiens
  misc_feature: GYAE6OF02ILZP6.33.5.A05.1.454.CMB.1.raw
  modified_base (414)..(414): a, c, t, g, unknown or other
  misc_feature (414)..(414): n is a, c, g, or t
tcagtacacacactcacgaccggtgctcgatttagatagatagacagggggctctgggagaggagcccagcactagaagtcggcggtgtttccattcggtgatcagcactgaacacagaggactcaccatggagtttgggctgagcttggggtttttcctcgttgcttctttttaagaggtgtccagtgtcaggtgcagctggtggagtcgtgggggagcgtggtccagccgtgggacgtccctgacgactcgtcctgtcgcagcctcgtggattccaccttcagtacgctatgacatcgactacgtcgggtcccgaccgaggcctaccgaggaccgaaaggggtacgtgggtaggtggggtcggcgttaggtttgttacaaagtcgaagtaggaaactaaagaaactacgtancgacacgaccgtcggtaggacggtaccgtatccgaccgttctacgagaacgactaacttaccgaaagtaccgttaccttcgtttacgtagaactaaagcgaacacgtaccgtagaacgtacgtacgtaggaacggtaccgacggtcgttacggtaggtttaacgttacggttgggtaaggggtaacgggtagtccggtagggtacggtacgttaggtttacgtagttaaccggg

SEQ ID NO: 28004 - DNA, 749 bp, Homo sapiens
  misc_feature: GYAE6OF01ED5KS.39.66.F11.1.454.CMB.1.raw
  modified_base (308)..(308): a, c, t, g, unknown or other
  misc_feature (308)..(308): n is a, c, g, or t
tcagtcgcactagtcacgaccggtgctcgatttagtcacgcgagaaggggctgggagaggagccccagccttgggattccccagtgttttcattcagtgatcaggactgaacacagaggactcaccatggagtttggactgagctggattttccttgctgctattttaaagtgtccagtgtgaggtgcagctggtgaagttcgtgggggaggcgttgggtaggagggccggggggtcccttaggactctcgtgtgcagcctcgtggactctacttttagtgatcgtcccggttgaccgtcgggtcccnccgagaccgtccgaaggggaacgggacgtgggaggtcggggtaccgaacccgtaaaagttaaaacggaggacgtaggagtgggtaggaacaaacgagaactacgctgacgaggaccgtaggaaacggcagtacttaccacctatactacaagagagtagacttacaaagtaaaaccgttccgtttttccaacgtactaaagtacgaaactaacccgtaaagaaaacgtacgaaacgaaccgtaacggaacggtacgttaaggtttaacggttaacgggtaacttaacgtaaagttaacgtaggttaacggtttaaacggggttaaacgttttacgttaaccgggtacgtttacggttacccgggtttttacgggggaaccccgtaaaccgggggttaaccccgttagggttaacccctaccccggttccgttaacccccgg

SEQ ID NO: 28005 - DNA, 565 bp, Homo sapiens
  misc_feature: GYAE6OF02FRRS3.39.66.F11.1.454.CMB.1.raw
  modified_base (436)..(436): a, c, t, g, unknown or other
  misc_feature (436)..(436): n is a, c, g, or t
tcagtcgcactagtcacgaccggtgctcgatttagtcacgcgagaaggggctgggagaggagccccagccttgggattccccagtgttttcattcagtgatcaggactgaacacagaggactcaccatggagtttggactgagctggattttccttgctgctattttaaaaggtgtccagtgtgaggtgcagctggtgaattctgggggaggcttggtagagccgggggggtcccttagactctcgtgtgcagcctctggactcacttttagtgatgcccggttgacctgggtccgccagactccagggaagggactggagtgggtcgcccaaattaaaagaggcgtgatggtgggacaacagactacgctgcagccgtgaaaggcagattcaccatctacaagagatgattacaagtaaaactacgtttttaccngtacaaatgaaacaacctagaaaatcgaagacacgaggcgtagtattacgggattacaatatagattacgggaagttagtacgtactgtacgtttgggacctacgggacccttggtactaccgtctccg

SEQ ID NO: 28006 - DNA, 672 bp, Homo sapiens
  misc_feature: GYAE6OF02IL1AA.39.66.F11.1.454.CMB.1.raw
tcagtcgcactagtcacgaccggtgctcgatttagtcacgcgagaaggggctgggagaggagccccagccttgggattccccagtgttttcattcagtgatcaggactgaacacagaggactcaccatggagtttggactgagctggatttccttgctgctattttaaaaggtgtccagtgtgaggtgcagctggtgaattcgtggggaggcttggtagaggccggggggtccttagactctcgtgtgcacgcctctggactctacttttgtgatcgtccggttgaccgtgggtcccgcctagaccgtccgagggggaacgggacgtaggggaggtcggggtaccgaacccgtaaaaagttaaaaacggcggtacggtagtagtgggtaggaaccaaacgagactacgctgacgacgcgtagaagcagtattccactatctagaagagatagacttacgaaacgtaaaactttaccgttttaccagtactaaacgtacgaaacctaacctaagaaaacgtacgaacgaacacgaggtcttaaggttacgttaacgggtattaagaacgttagtacggtacgttacgggtaatttacgttacggtacgttaggtaccggttttacggggaccgtaaccgggtacccgttgggtaccctaccggttcctacccg

SEQ ID NO: 28007 - DNA, 1039 bp, Homo sapiens
  misc_feature: GYAE6OF02HZR2T.39.66.F11.1.454.CMB.1.raw
  modified_base (275)..(275): a, c, t, g, unknown or other
  misc_feature (275)..(275): n is a, c, g, or t
  modified_base (306)..(306): a, c, t, g, unknown or other
  misc_feature (306)..(306): n is a, c, g, or t
tcagtcgcactagtcacgaccggtgctcgatttagtcacgcgagaaggggctgggagaggagccccagccttgggattccccagtgttttcattcagtgatcaggactgaacacagaggactcaccatggagtttggactgagctggattttccttgctgctattttaaaaggtgtccagtgtgaggtgcagctggtgaattcgtggggagcgttggtagaggccggggggtcccttagactcgtcgtgtgcagcctctggactctacttttagngtacgtggtcccggttgaccgtcggggtccnccgagacctccgaggggaacgggacgtgggaggtcgggtaccgaccccgtaaaaagtttaaaaaacggagggtacggtacggtagtaggggttacgggaaacaaaccgaacggtaaacccgttaaccggtaccgttacggaccgtaacggtacccgggttaagggaaaacgggtccgtaaacgggtaaccgttttaacccgaaacccgtaacgtttaccccgtaacggaaaaacggtaaacggtaaaccgttaagggtaaacgttttaacccggaaaaacggttaaaaaaaccccgttttaccggttttttttaacccccgtaacggttaaaacccgttaaaaaaccgttttaaacggtaaaaaaccccgtttaaaaaccccgtttaaaaaggggtaaaaaaaacccgtttaaacccgggtaaaaacggaaaaaccccggttaaaccgggtaaaccgggggttaaacccggtttaaacggggttttaaaaccgggttttaaaaacccgggggttaacttttaaaaccggtaaaaaccgttttaagttaacgggtttaaacgtttaaccggggggttaaaaggtttttaaacggttttacccgggtaaaacgttttaccggggttttaaccggttttttaaccggggggaaccccggtttaaacgggggttaaaccccccggtttaacgggttaacccccggtttaccccggttaccccgttttaaccccccgg

SEQ ID NO: 28008 - DNA, 464 bp, Homo sapiens
  misc_feature: GYAE6OF01A4KBB.42.59.F04.1.454.CMB.1.raw
  modified_base (456)..(464): a, c, t, g, unknown or other
  misc_feature (456)..(464): n is a, c, g, or t
tcagtgacgtatgtcacgaccggtgctcgatttagtacacacacttagggattgggtgtgggctggatccgtcagcccccggaaaggccctggagtggcttgcactcatttattgggatgatgataagcgctacactccatctctgaagagcaggctcaccatcaccaaggacacctccaaagaccaggtggtccttacaatgaccaacatggactctgtggacacagccacatatttctgtgcacacaattcggctaaacttacggggagtgcttttgttgtctggggccaaggggacaatcatcaccgtctcttccgcctccaccaagggccccatcggtcttccccctggcgccctgctccaggagcacctccgagagcacagcggccctgggcctgcctggtcaaggactacttccacatacgtcactgagcgggctggcaaggcgcatagnnnnnnnnn

SEQ ID NO: 28009 - DNA, 704 bp, Homo sapiens
  misc_feature: GYAE6OF01B874L.42.59.F04.1.454.CMB.1.raw
  modified_base (697)..(697): a, c, t, g, unknown or other
  misc_feature (697)..(697): n is a, c, g, or t
tcagtgacgtatgtcacgaccggtgctcgatttagtacacacacttagggagttcgggtgtgggctggactccgtcagcccccggaacggccctggagtggcttcgcactcatttagtgggatgatgattaaggcgctacactccatctcgtgaacgagccaggcctcacctatcaccaaggccaccgtccaaagaccgaggtggtaccttaacaagtcgaaccaacgtagtacggtactcgtggtaggaccacacggccaactattactttctggtcgcaactaactaacgttcggacgttaaacgttacggggacgtcggtccgttttagttaggtcgtggggaccgaagggactaagtcactcaccgtctccgttccgccttaccgaaccgaacgggaccctaagttcccggtaccttacccccgtacggcccgacccgtcgaccgtaccgaacggaccgtaccgacccgtaccggacgacgccgaacgacggccggtacccgttggggcctcgggcccgttacgggtaccgtaaacggtaccttaacccgttaccgaacgtaagttacccggtaccaacgtcggaacgggtccgggtaccttacggggaccgtaaacgggccgtaaccgtaacgttacggacgcgtacgcgtgtacacgcgtacgtactatcgcgcgacgacgtacgacgacnctcgcgc

SEQ ID NO: 28010 - DNA, 470 bp, Homo sapiens
  misc_feature: GYAE6OF01ADGPS.42.59.F04.1.454.CMB.1.raw
  modified_base (239)..(239): a, c, t, g, unknown or other
  misc_feature (239)..(239): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (449)..(450): a, c, t, g, unknown or other
  misc_feature (449)..(450): n is a, c, g, or t
  modified_base (452)..(470): a, c, t, g, unknown or other
  misc_feature (452)..(470): n is a, c, g, or t
tcagtgacgtatgtcacgaccggtgctcgatttagtacacacacttagggattgggtgtgggctggatccgtcagccccccggaaaggccctggagtggcttgcactcatttattgggatgatgataagcgctacactccatctctgaagagcaggctcaccatcaccaaggcacctccaaagccaggtggtccttacaatgaccaacatggactctgtggacacagccacatatttcngtgcacacaattcggctaaacttacgggatgcttttgtgtctggggccaagggacaatcatcacgtctcttccgcctccaccaagggccccatcggtcttccccctgccgccctgctccaggncacctccgagngcacagcggccctggctgcctggtcaaggctacttccacactacgtcactgacgcggcctggcaaggcgacatagnngnnnnnnnnnnnnnnnnnnn

SEQ ID NO: 28011 - DNA, 476 bp, Homo sapiens
  misc_feature: GYAE6OF01AWTD3.42.59.F04.1.454.CMB.1.raw
  modified_base (241)..(241): a, c, t, g, unknown or other
  misc_feature (241)..(241): n is a, c, g, or t
  modified_base (371)..(371): a, c, t, g, unknown or other
  misc_feature (371)..(371): n is a, c, g, or t
  modified_base (466)..(476): a, c, t, g, unknown or other
  misc_feature (466)..(476): n is a, c, g, or t
tcagtgacgtatgtcacgaccggtgctcgatttagtacacacacttagggattgggtgtgggctggatccgtcagccccccggaaaggccctggagtggcttgcactcatttattgggatgatgataagcgctacactccatctctgaagagcaggctcaccatcaccaaggacacctccaaagaccaggtggtccttacaatgaccaacatggactctgtggacacagccacatatttcngtgcacacaattcggctaaacttacgggagtgcttttgttgtctggggccaagggacaatcatcaccgtctcttccgcctccaccaagggccccatcggtccttccccctggccgccctgcctccaggancacctccgagagcacagccgggccctggggctgcctgggtccaaggactacttccacataccgtcacctgacgcgggctggccaaggcgcatagnnnnnnnnnnn

SEQ ID NO: 28012 - DNA, 541 bp, Homo sapiens
  misc_feature: GYAE6OF01CAARA.42.59.F04.1.454.CMB.1.raw
  modified_base (240)..(240): a, c, t, g, unknown or other
  misc_feature (240)..(240): n is a, c, g, or t
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
  modified_base (519)..(519): a, c, t, g, unknown or other
  misc_feature (519)..(519): n is a, c, g, or t
  modified_base (521)..(541): a, c, t, g, unknown or other
  misc_feature (521)..(541): n is a, c, g, or t
tcagtgacgtatgtcacgaccggtgctcgatttagtacacacacttagggattgggtgtgggctggatccgtcagccccccggaaaggccctggagtggcttgcactcatttattgggatgatgataagcgctacactccatctctgaagagcaggctcaccatcaccaaggacacctccaaagccaggtgtccttacaatgaccaacatggactctgtggacacagccaacatatttcngtgcaacactaattcggacttaaaacgtacggggatgtcttttgtgtcgtgggaccaaggacatcatcaccgtctctccgcctccacgaaggcccagtccgtccttcccctggccnccctgcctcgacggacnccaccgtccgaagacgccacgacggcccggtcccgtgggcctcggcccgtgggtaaccaaacgggtacccttaaccgttcccaatacgttaccgtcaacgtgggaacggtccgggactcgggacaacgggtcccgactaagtacgncnnnnnnnnnnnnnnnnnnnnn

SEQ ID NO: 28013 - DNA, 457 bp, Homo sapiens
  misc_feature: GYAE6OF01C9MO7.42.59.F04.1.454.CMB.1.raw
  modified_base (241)..(241): a, c, t, g, unknown or other
  misc_feature (241)..(241): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (438)..(438): a, c, t, g, unknown or other
  misc_feature (438)..(438): n is a, c, g, or t
  modified_base (444)..(457): a, c, t, g, unknown or other
  misc_feature (444)..(457): n is a, c, g, or t
tcagtgacgtatgtcacgaccggtgctcgatttagtacacacacttagggattgggtgtgggctggatccgtcagccccccggaaaggccctggagtggcttgcactcatttattgggatgatgataagcgctacactccatctctgaagagcaggctcaccatcaccaaggacacctccaaagaccaggtggtccttacaatgaccaacatggactctgtggacacagccacatatttcngtgcacacaattcggctaaacttacgggagtgcttttgttgtctggggccaagggacaatcatcaccgtctcttccgcctccaccaagggcccatcgtctcccctggcncctnctcaggncacctcgagncacagcgcctgggctgcctggtcaaggactactccacatacgtcactgacgcgggctggcaagggcncatagnnnnnnnnnnnnnn

SEQ ID NO: 28014 - DNA, 470 bp, Homo sapiens
  misc_feature: GYAE6OF01C3DVK.42.59.F04.1.454.CMB.1.raw
  modified_base (241)..(241): a, c, t, g, unknown or other
  misc_feature (241)..(241): n is a, c, g, or t
  modified_base (457)..(457): a, c, t, g, unknown or other
  misc_feature (457)..(457): n is a, c, g, or t
  modified_base (463)..(470): a, c, t, g, unknown or other
  misc_feature (463)..(470): n is a, c, g, or t
tcagtgacgtatgtcacgaccggtgctcgatttagtacacacacttagggattgggtgtgggctggatccgtcagccccccggaaaggccctggagtggcttgcactcatttattgggatgatgataagcgctacactccatctctgaagagcaggctcaccatcaccaaggacacctccaaagaccaggtggtccttacaatgaccaacatggactctgtggacacagccacatatttcngtgcacacaattcggctaaacttacggggagtgcttttgtgtctggggccaagggacaatcatcaccgtctcttccgcctccaccaagggcccatcggtcttccccctggccgccctgcctccaggacgcacctccgagacgcacagcggccctgggctgcctggtcaaggactacttcccactactacgtcactgacggcgggctggcaacggcncatagnnnnnnnn

SEQ ID NO: 28015 - DNA, 532 bp, Homo sapiens
  misc_feature: GYAE6OF01C2XNE.42.59.F04.1.454.CMB.1.raw
  modified_base (514)..(514): a, c, t, g, unknown or other
  misc_feature (514)..(514): n is a, c, g, or t
  modified_base (516)..(532): a, c, t, g, unknown or other
  misc_feature (516)..(532): n is a, c, g, or t
tcagtgacgtatgtcacgaccggtgctcgatttagtacacacacttagggattgggtgtgggctggatccgtcagccccccggaaaggccctggagtggcttgcactcatttattgggatgatgataagcgctacactccatctctgaagagcaggctcaccatcaccaaggacacctccaaagaccaggtggtccttacaatgaccaacatggactctgtggacacagccacattatttctgtgcacacaattcggactaaaacgttaccggggagttgtcttttgttgtcgtggggccaagggacaatcatcaccgtctccttccgcctccacacggcccagtccgtcttccccgtggccgtccctgcctccaggacgccacccgtcgacgacgcacgacggccggccctggggcctcggcccgttgggtaccaacgggtaccttaccgttacccactatacccgtcacgtgacgggccgggtctcgggaccgaagggccgacgtagtacgncnnnnnnnnnnnnnnnnn

SEQ ID NO: 28016 - DNA, 577 bp, Homo sapiens
  misc_feature: GYAE6OF01EE2ZQ.42.59.F04.1.454.CMB.1.raw
  modified_base (221)..(221): a, c, t, g, unknown or other
  misc_feature (221)..(221): n is a, c, g, or t
  modified_base (375)..(375): a, c, t, g, unknown or other
  misc_feature (375)..(375): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (557)..(577): a, c, t, g, unknown or other
  misc_feature (557)..(577): n is a, c, g, or t
tcagtgacgtatgtcacgaccggtgctcgatttagtacacacacttagggattgggtgtgggctggatccgtcagccccccggaaaggccctggagtggcttgcactcatttattgggatgatgataagcgctacactccatctctgaagagcaggctcaccatcaccaaggacacctccaaagaccaggtgtccttacaatgaaccaacatggactctgnggaacacacgccaacattagttttctgtgccaacactaattccggactaaaacgttacggggagttgtctttttgtgtcgtggggaccaagggtacaatcaagtccaccgtctcttccgcctccacgaacggcccagttccggtccttccccgnggcctcccgtcgcctaccgaggacgcccacccgtccgaagcgccacgacggccgggtcccgtggggcctcggccgtagggtaccaaagggtaacccttaccgttacccaactagttaccgtaccaacgttcggaacggcccggggactcgggaccgtaacgggccgacgtaaagtcgngngnnnnnnnnnnnnnnnnnnnnn

SEQ ID NO: 28017 - DNA, 690 bp, Homo sapiens
  misc_feature: GYAE6OF01CSHK4.42.59.F04.1.454.CMB.1.raw
  modified_base (188)..(188): a, c, t, g, unknown or other
  misc_feature (188)..(188): n is a, c, g, or t
  modified_base (522)..(522): a, c, t, g, unknown or other
  misc_feature (522)..(522): n is a, c, g, or t
  modified_base (663)..(663): a, c, t, g, unknown or other
  misc_feature (663)..(663): n is a, c, g, or t
  modified_base (665)..(666): a, c, t, g, unknown or other
  misc_feature (665)..(666): n is a, c, g, or t
  modified_base (668)..(668): a, c, t, g, unknown or other
  misc_feature (668)..(668): n is a, c, g, or t
  modified_base (671)..(674): a, c, t, g, unknown or other
  misc_feature (671)..(674): n is a, c, g, or t
  modified_base (678)..(679): a, c, t, g, unknown or other
  misc_feature (678)..(679): n is a, c, g, or t
  modified_base (681)..(690): a, c, t, g, unknown or other
  misc_feature (681)..(690): n is a, c, g, or t
tcagtgacgtatgtcacgaccggtgctcgatttagtacacacacttagggattgggtgtgggctggatccgtcacgccccccggaaaggccctggagtggcttgcactcatttatgggatgatgataagcgctacactccatctctgaagagcaggctcaccatcaccaagaccacctacaaagccgnggttgtaccttaacaatgaaccaatagtggactcgtgaggacacgagcccaattattattttcgagcgtaccaaacaacgtaacgttaccggtaaccgttaaaacggttaccgggggttagttgtttccgtttttaggttcggttccggtacgggggtaccggaaagggactaaactcgacgtaccgtcccggttaccttcccgttacccgtccctaccggaacccggtaacgggtcccctacggttccccgttacccgtttcccccgcggggacccctccgttccgtcccgttaaccgcggggaatccccgtaaccgtcccgaggacccggtnaccgggaccggccggtacccgtcgggtcctccggccgttagggaccccggtaaacgtccctttaacccgtaccaacgtaaccgttaccgcaacgggtacggccggtcggacggtacggaacggaactcccggtaatggagngnngncgnnnngcgnncnnnnnnnnnn

SEQ ID NO: 28018 - DNA, 457 bp, Homo sapiens
  misc_feature: GYAE6OF01DUL1Q.42.59.F04.1.454.CMB.1.raw
  modified_base (151)..(151): a, c, t, g, unknown or other
  misc_feature (151)..(151): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
  modified_base (395)..(395): a, c, t, g, unknown or other
  misc_feature (395)..(395): n is a, c, g, or t
  modified_base (412)..(412): a, c, t, g, unknown or other
  misc_feature (412)..(412): n is a, c, g, or t
  modified_base (443)..(457): a, c, t, g, unknown or other
  misc_feature (443)..(457): n is a, c, g, or t
tcagtgacgtatgtcacgaccggtgctcgatttagtacacacacttagggattgggtgtgggctggatccgtcagccccccggaaaggccctggagtggcttgcactcatttattgggatgatgataagcgctacactccatctctgaagngcaggctcaccatcaccaaggacacctcaaagaccaggtcggtccttacaatgaaccaacatggactctgtggacacagccacatatttcngtgcacanaattcggctaaacgttacgggatgcttttgtgtcgtggggccaaggggacaagtcatcaccgtctcttccgcctccaccaaggcccatcggtctccccgngccncctnctcagcncacctcgangcacagcgcctggctgcgtgnagctactccactatcgnacgtgacgcggctggacaggtcgcagtacgnnnnnnnnnnnnnnn

SEQ ID NO: 28019 - DNA, 730 bp, Homo sapiens
  misc_feature: GYAE6OF01BJUCQ.42.59.F04.1.454.CMB.1.raw
  modified_base (151)..(151): a, c, t, g, unknown or other
  misc_feature (151)..(151): n is a, c, g, or t
  modified_base (200)..(200): a, c, t, g, unknown or other
  misc_feature (200)..(200): n is a, c, g, or t
  modified_base (490)..(490): a, c, t, g, unknown or other
  misc_feature (490)..(490): n is a, c, g, or t
  modified_base (698)..(698): a, c, t, g, unknown or other
  misc_feature (698)..(698): n is a, c, g, or t
  modified_base (704)..(704): a, c, t, g, unknown or other
  misc_feature (704)..(704): n is a, c, g, or t
  modified_base (707)..(708): a, c, t, g, unknown or other
  misc_feature (707)..(708): n is a, c, g, or t
  modified_base (712)..(713): a, c, t, g, unknown or other
  misc_feature (712)..(713): n is a, c, g, or t
  modified_base (716)..(717): a, c, t, g, unknown or other
  misc_feature (716)..(717): n is a, c, g, or t
  modified_base (723)..(723): a, c, t, g, unknown or other
  misc_feature (723)..(723): n is a, c, g, or t
  modified_base (725)..(727): a, c, t, g, unknown or other
  misc_feature (725)..(727): n is a, c, g, or t
  modified_base (729)..(730): a, c, t, g, unknown or other
  misc_feature (729)..(730): n is a, c, g, or t
tcagtgacgtatgtcacgaccggtgctcgatttagtacacacacttagggattgggtgtgggctggatccgtcagccccccggaaaggccctggagtggcttgcactcatttattgggatgatgataagcgctacactccatctctgaagngcaggctcaccatccaaccaaggacaccctcaaagcaggtgtccttaanatcgaccaacatcgactcgtgtcggacacagacccatattacttttcctagtcgtaccaacaactaaacgttcccggtaaccgttaaaaacgttaccgggggtagttgtcgtttttcgttcggttcggttgggggaccgaaggggactaactcaactccgttacccggtaccttcccgttttaccccgccccttaccccgacccgtaaacccgggtcccctacgtttacccgggttcccctttccccccggtcggcccggtacccccttcggtcctcccggacgggaccncccgtacccgtaccggacgtacggtaccaccggaccggtcccgggtaccccgggtgggtcccgttcccggtcccggttacgggtacgtaaaaccgggttcccttaacccggttaccccaaccgttaacgtaacccgttccgacggtacggtaccgggaccggggttcgtaacgggccgtaacggggcccacgggtaaacgtcgagtcncgtagncgnnctcnnctnncagcgngnnngnn

SEQ ID NO: 28020 - DNA, 456 bp, Homo sapiens
  misc_feature: GYAE6OF02IGYZB.42.59.F04.1.454.CMB.1.raw
  modified_base (450)..(456): a, c, t, g, unknown or other
  misc_feature (450)..(456): n is a, c, g, or t
tcagtgacgtatgtcacgaccggtgctcgatttagtacacacacttagggattgggtgtgggctggatccgtcagcccccggaaaggccctggagtggcttgcactcatttattgggatgatgataagcgctacactccatctctgaagagcaggctcaccatcaccaaggacacctccaaagaccaggtggtccttacaatgaccaacatggactctgtggacacagccacatatttctgtgcacacaattcggctaaacttacggggagtgcttttgttgtctggggccaagggacaatcatcaccgtctcttccgcctccaccaagggcccatcggtctcccctgcgcctgctccaggagcacctccgagagcacagcggccctgggctgcctggtcaaggactacttccacatacgtcactgagcgggctggcaaggcgcgatagnnnnnnn

SEQ ID NO: 28021 - DNA, 508 bp, Homo sapiens
  misc_feature: GYAE6OF02G9TGR.42.59.F04.1.454.CMB.1.raw
  modified_base (241)..(241): a, c, t, g, unknown or other
  misc_feature (241)..(241): n is a, c, g, or t
  modified_base (491)..(508): a, c, t, g, unknown or other
  misc_feature (491)..(508): n is a, c, g, or t
tcagtgacgtatgtcacgaccggtgctcgatttagtacacacacttagggattgggtgtgggctggatccgtcagccccccggaaaggccctggagtggcttgcactcatttattgggatgatgataagcgctacactccatctctgaagagcaggctcaccatcaccaaggacacctccaaagaccaggtggtccttacaatgaccaacatggactctgtggacacagccacatatttcngtgcacacaattcggactaaaacgttacggggagtgtcttttgttgtcgtggggccaagggacaatcatcaccgtctcttccgcctccaccgaacggcccatcggtccttcccctggccgccctgcctccgaggacgccaccctccgagacgccacacgccggcccgtggggcctcggccctgggtaccaagggtacctaccttccactattaccgtcactgacggcgggctggcgaaggccgcagtagnnnnnnnnnnnnnnnnnn

SEQ ID NO: 28022 - DNA, 461 bp, Homo sapiens
  misc_feature: GYAE6OF02F0I6O.42.59.F04.1.454.CMB.1.raw
  modified_base (448)..(461): a, c, t, g, unknown or other
  misc_feature (448)..(461): n is a, c, g, or t
tcagtgacgtatgtcacgaccggtgctcgatttagtacacacacttagggattgggtgtgggctggatccgtcagcccccggaaaggccctggagtggcttgcactcatttattgggatgatgataagcgctacactccatctctgaagagcaggctcaccatcaccaaggacacctccaaagaccaggtggtccttacaatgaccaacatggactctgtggacacagccacatatttctgtgcacacaattcggctaaacttacggggatgctttgttgtctggggccaagggacaatcatcaccgtctcttccgcctccaccaagggcccatcggtcttcccctggcgccctgctccaggacgcacctccgagagcacagcggccctggctgcctggtcaaggactactccacatacgtcactgagcggctggcaaggcgcatagnnnnnnnnnnnnnn

SEQ ID NO: 28023 - DNA, 465 bp, Homo sapiens
  misc_feature: GYAE6OF02ICK97.42.59.F04.1.454.CMB.1.raw
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (399)..(399): a, c, t, g, unknown or other
  misc_feature (399)..(399): n is a, c, g, or t
  modified_base (443)..(465): a, c, t, g, unknown or other
  misc_feature (443)..(465): n is a, c, g, or t
tcagtgacgtatgtcacgaccggtgctcgatttagtacacacacttagggattgggtgtgggctggatccgtcagccccccggaaaggccctggagtggcttgcactcatttattgggatgatgataagcgctacactccatctctgaagagcaggctcaccatcaccaaggacacctccaaagaccaggtggtccttacaatgaccaacatggactctgtggacacagccacatatttctgtgcacacaattcggacttaaacgttacggggagtgcttttgttgtctggggccaagggacaatcatcaccgtctctccgctcacaggccatcgtctcccngcncctgcncngncactcgancgcacngccgcctgggctgcctgcaagctactccanatacgtcaactgacgcgggctcggacaacgggccgacagtacgnnnnnnnnnnnnnnnnnnnnnnn

SEQ ID NO: 28024 - DNA, 490 bp, Homo sapiens
  misc_feature: GYAE6OF02JYQG6.42.59.F04.1.454.CMB.1.raw
  modified_base (240)..(240): a, c, t, g, unknown or other
  misc_feature (240)..(240): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
  modified_base (437)..(437): a, c, t, g, unknown or other
  misc_feature (437)..(437): n is a, c, g, or t
  modified_base (466)..(469): a, c, t, g, unknown or other
  misc_feature (466)..(469): n is a, c, g, or t
  modified_base (472)..(490): a, c, t, g, unknown or other
  misc_feature (472)..(490): n is a, c, g, or t
tcagtgacgtatgtcacgaccggtgctcgatttagtacacacacttagggattgggtgtgggctggatccgtcagccccccggaaaggccctggagtggcttgcactcatttattgggatgatgataagcgctacactccatctctgaagagcaggctcaccatcaccaaggacacctccaaagaccaggtgtccttacaatgaccaacatggactctgtggacacagccacatatttcngtgcacacaattcggctaaacgttacggggatgtcttttgtgtctggggccaagggacaagtcatccacgtctcttccgcctcaccaaggcccagtccggtcctccccgnggccnccctgcctccgaggcnccacctccgagacgccacacgccgggcccgtggctcgcgtcgacgacgtacctacaccacacgtcncagcgcggcgcgtcggagtcggcacgagnnnnacnnnnnnnnnnnnnnnnnnn

SEQ ID NO: 28025 - DNA, 581 bp, Homo sapiens
  misc_feature: GYAE6OF02J2SBA.42.59.F04.1.454.CMB.1.raw
  modified_base (156)..(156): a, c, t, g, unknown or other
  misc_feature (156)..(156): n is a, c, g, or t
  modified_base (245)..(245): a, c, t, g, unknown or other
  misc_feature (245)..(245): n is a, c, g, or t
  modified_base (524)..(524): a, c, t, g, unknown or other
  misc_feature (524)..(524): n is a, c, g, or t
  modified_base (537)..(537): a, c, t, g, unknown or other
  misc_feature (537)..(537): n is a, c, g, or t
  modified_base (568)..(568): a, c, t, g, unknown or other
  misc_feature (568)..(568): n is a, c, g, or t
  modified_base (578)..(578): a, c, t, g, unknown or other
  misc_feature (578)..(578): n is a, c, g, or t
tcagtgacgtatgtcacgaccggtgctcgatttagtacacacacttagggagttgggtgtgggctggatccgtcagcccccggtaaagggccctggagtggcttgccactcatttattgggatggatgataagcgctacactccatctactgaagngcaggctcaccatcaccaaggacacctccaaagaccaggtgtccttacaatgaccaacatggactctgtggacacagccacatatttcngtgcacacaattcggctaaacgttacggggagtgtcttttgttgttctggggcctaagggacaatcattcaccgtctcttcccgcctaccaccaacgggcccatccggtccttccccgtgccgccctgactccgagcgcacctccgagacgcacgagccggcctgggcctcgcccgttcggtacaacgggtcttaccgttcccgactacgtaaccttcaacgttcgaacggcccgggtccgttaggggacctaaggggccgactaacggttacgaccgngtacgagcgacgngacgagctcgtcgcgtacgtacgacgtcgtntcacgtcgtntcg

SEQ ID NO: 28026 - DNA, 609 bp, Homo sapiens
  misc_feature: GYAE6OF02I6J83.42.59.F04.1.454.CMB.1.raw
  modified_base (244)..(244): a, c, t, g, unknown or other
  misc_feature (244)..(244): n is a, c, g, or t
  modified_base (367)..(367): a, c, t, g, unknown or other
  misc_feature (367)..(367): n is a, c, g, or t
  modified_base (574)..(574): a, c, t, g, unknown or other
  misc_feature (574)..(574): n is a, c, g, or t
  modified_base (577)..(577): a, c, t, g, unknown or other
  misc_feature (577)..(577): n is a, c, g, or t
  modified_base (582)..(582): a, c, t, g, unknown or other
  misc_feature (582)..(582): n is a, c, g, or t
  modified_base (587)..(587): a, c, t, g, unknown or other
  misc_feature (587)..(587): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (597)..(597): a, c, t, g, unknown or other
  misc_feature (597)..(597): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
  modified_base (607)..(608): a, c, t, g, unknown or other
  misc_feature (607)..(608): n is a, c, g, or t
tcagtgacgtatgtcacgaccggtgctcgatttagtacacacacttagggattgggtgtgggctggatccgtcagcccccggaaaggccctggagtggcttgcactcatttattgggatgatgataagcgctacactccatctctgaagagcaggctcaccatcaccaaggaccaccctcaaagaccaggtggtccttacaatcgaaccaacatggactctgtggacacagccacattatttcngtcgcacacaattcggacttaaacgttacggggatgtcttttagtgtcgtcggggtccaagggactaatcactcaccgtcttctccgcctaccaccgaacggccctagtccgtccttccccgnggccgtccctcgcctaccgaggacgtccctaccgtaccgagacgacctaaccgacggcccggtcccgtaggggccctacggtcccgtttacgggtaccaaaagggtcccttaaccttcccgaactacgttacccgtctaaacgtggacggtcccgggtctacgggactaaccggggacctccgtaagttacggcacctacgcgtacncgngtgancgacncgcncncgcncacncncncnnc

SEQ ID NO: 28027 - DNA, 564 bp, Homo sapiens
  misc_feature: GYAE6OF02IMQKY.42.59.F04.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (340)..(340): a, c, t, g, unknown or other
  misc_feature (340)..(340): n is a, c, g, or t
  modified_base (360)..(360): a, c, t, g, unknown or other
  misc_feature (360)..(360): n is a, c, g, or t
  modified_base (539)..(539): a, c, t, g, unknown or other
  misc_feature (539)..(539): n is a, c, g, or t
  modified_base (548)..(548): a, c, t, g, unknown or other
  misc_feature (548)..(548): n is a, c, g, or t
  modified_base (556)..(556): a, c, t, g, unknown or other
  misc_feature (556)..(556): n is a, c, g, or t
tcagtgacgtatgtcacgaccggtgctcgatttagtacacacacttagggattgggtgtgggctggatccgtcagccccccggaaaggccctggagtggcttgcactcatttattgggatgatgataagcgctacactccatctctgaagagcaggctacaccatcacaaggcactcaaagcaggtgtctacatgaccanatgactctgtgacncagccactattattctgtcgcacgactaacgttcggactaaacgttacgggatgtcttttgtgtcgtgggaccaggacaagtcagtcaccgtctcgtccgcctcacgaggccagtcgtcctcccgngccgtcctgcctcgacggcnccgtaccgtcgagtacgcagccggacgccgtcggcctcggtcctaggtacgaacggtaccttaccgtcctactacgttaccgtaccacgtacgtacggtccgggacgtcggaccggtaaggcccgtacgtacgtaacgtcgagtcgcgtagccgtagtcgacgtacgtcgagccgttancgtactcgngtcgtacncgtagtcg

SEQ ID NO: 28028 - DNA, 803 bp, Homo sapiens
  misc_feature: GYAE6OF01AYQ4B.41.33.C11.1.454.CMB.1.raw
  modified_base (565)..(565): a, c, t, g, unknown or other
  misc_feature (565)..(565): n is a, c, g, or t
tcagtctatactatcacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcacgcccaccctcgacgccgtccggtccggggacccccgggcggacgggggtccaaccacttccttcgtttgtttcggtagggaaacgggtaacgtacccgtaaattagtacggtactttaccttacttccgttcgtaccgtaaacgttgggttacggtaccggggtacctacccgagggacccgacccccggtacccccccgtaccttaccctttactccttaatccgtaccttaactaacgtcgaccggcccggtaccccgtcggtaccggggttcccctccggtacccgttacttcctcgtcggtcctaccgtagtcgtcggacctacgtacgaccgtcgtaccgtcggccttacttcccgttgtaccttccgtaccgttacggtntacgggagtacgtaggacggtcttaaggtaacttttaccgtaaggtgaccgtaacgaggtccgtaagggttcgggaagttaccggacggacgggtaacccgggtgggtcgggttaggggtcgggttaccgggaacgggggttaaccggtaacgttacgggttacggtacccggtttaacgggcctaacggaaccccggaccggtcccggtacccggtccccgtcccccgggttaccgg

SEQ ID NO: 28029 - DNA, 657 bp, Homo sapiens
  misc_feature: GYAE6OF02G3ZAW.41.33.C11.1.454.CMB.1.raw
  modified_base (361)..(361): a, c, t, g, unknown or other
  misc_feature (361)..(361): n is a, c, g, or t
tcagtctatactatcacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcgacgggggtccaccattccttcttgttctgggaaggaagtccaatagtcggatcttatcctgtcaactggtatccggggactcccgaggccacccggccccccgtactcccttatctatcgactactaatccagccggcctcgacgggtcccncgcccgtattcctcgtcggctaccgtaagtctggcctactacgacgtcctaccgtcggtaccctacttccttgacttccgtacctacgtccgtaggacggtacgtcggtaggtcgttagttactttactacgttcgtacgctacgtactaggtacgggatacggacgacggcccgggaacggtcggttaggggtcggttacgggcgggtaacgggtaccgttaacggttaccggacccggttaccggtaggtccgaaccggcccggtaacggccgttaccccggccccgttaccgg

SEQ ID NO: 28030 - DNA, 753 bp, Homo sapiens
  misc_feature: GYAE6OF02FFTQD.41.33.C11.1.454.CMB.1.raw
tcagtctatactatcacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcacgcccaccctcaggtccgtcgtccggggacccccgggcgacgggggtccacctatccttcttggttctagggaacggtaacgtccaagttacgtcggacttcgttactccttgtctaacgtggtacgtccggggacctccgacggccgtaaccccggccccccgtacttaccgtttatccttaagtcgtacttaactaattcgacggacccggtccccttacggaccggggttccctcggtaccccgtagttcctcggttcggacccttaccgtaacggtccgtacggtaccctaccgtaacggtacggtaccctacccggtacgggtacccttaccgttacccgtttacgtaccctttcccgtacccgtaggttacccggtaggtacgggtacgtaggaccggttacgttaacgttaactttaccgtaggttacgtacgacgtacgtacgtaggttacgggactacgaacggtcggaccgggtacggttcggtacggtcggttaccgggaggacccggtaacgtaggtccgaccgttcgtacggcaccggtcccgaggtccccg

SEQ ID NO: 28031 - DNA, 156 bp, Homo sapiens
  misc_feature: GYAE6OF01E3J5U.48.13.B02.1.454.CMB.1.raw
  modified_base (113)..(113): a, c, t, g, unknown or other
  misc_feature (113)..(113): n is a, c, g, or t
  modified_base (128)..(128): a, c, t, g, unknown or other
  misc_feature (128)..(128): n is a, c, g, or t
  modified_base (134)..(156): a, c, t, g, unknown or other
  misc_feature (134)..(156): n is a, c, g, or t
tcagagtatacatacacgaccggtgctcgatttagtctagcgacttccgcgggtcgacgaccggtgctcgatttagtctagcgactccgccatcctgatatgtatactctgancgggctggcaaggcncatagnnnnnnnnnnnnnnnnnnnnnnn

SEQ ID NO: 28032 - DNA, 584 bp, Homo sapiens
  misc_feature: GYAE6OF01DLHCX.48.13.B02.1.454.CMB.1.raw
  modified_base (208)..(208): a, c, t, g, unknown or other
  misc_feature (208)..(208): n is a, c, g, or t
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
  modified_base (316)..(316): a, c, t, g, unknown or other
  misc_feature (316)..(316): n is a, c, g, or t
  modified_base (406)..(406): a, c, t, g, unknown or other
  misc_feature (406)..(406): n is a, c, g, or t
  modified_base (436)..(436): a, c, t, g, unknown or other
  misc_feature (436)..(436): n is a, c, g, or t
tcagagtatacatacacgaccggtgctcgatttagtctagcgactttgggtttagggggtagggggtctcaggacggcagcgctctcaggacgtcaccaccatgggccctgggctctgcctccgtcctccacctcctcactcagggcaccagggtcctgggcccagtctgccctgactcagcctccctcgcgtccggtctcctggacngtcagtcaccatctcctgcactggaaccagcagtgacgttggtgttanactatgtctctggtaccaacngcacccaggcaaacgaccccaaagtcactagtactttangtaggtacagtaagcgcctagacggggtccctgactcgtcttctctggctccaagtctggcaacacggtcctcctgacctctctggctcnggctgaggatgacgtctgtatttacttcgngactacgtctacatagtgacgaggcctagactaacgtaagttcggtacggtacgttccggggacggacgggtaaccgaaggtaccgttacggacccggttcggtacgggaccacggtacccgaaggtccctccggtcccccgttacgg

SEQ ID NO: 28033 - DNA, 595 bp, Homo sapiens
  misc_feature: GYAE6OF01A95I5.48.13.B02.1.454.CMB.1.raw
  modified_base (246)..(246): a, c, t, g, unknown or other
  misc_feature (246)..(246): n is a, c, g, or t
  modified_base (279)..(279): a, c, t, g, unknown or other
  misc_feature (279)..(279): n is a, c, g, or t
  modified_base (334)..(334): a, c, t, g, unknown or other
  misc_feature (334)..(334): n is a, c, g, or t
  modified_base (367)..(367): a, c, t, g, unknown or other
  misc_feature (367)..(367): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
tcagagtatacatacacgaccggtgctcgattttagtctagcgactttaggggtttaggggggctagggggttctcaggaggacagcgctcgtcgagggacgtcaccacatggcctggtctctgctctctcacctctacactcaggctacgacgggtcgtcgggccgagtctgccctgaactcagcctccgtccgcgtccgggtctctggacagtcagtccaccatctcctgcacgtacggaaccngccaggtcggacggttggtgggttaataacgtntgtactccgtggtaccaacagccaccaggacaaacgccccaaagtcatgatttangaggtcaggtaagccggcctcgacggggtcccngactcgtcttctcgtcggcctacctaaggtctggacaacgaccggccctcctggacccgtctcgtcgggcctcgagctggaggntcggnggctagtatttacgttctcgcagtctacatagtcgacgagggacacgacaactagtggttcggtacgtccgggacgggacgggaaccaggtcgtacgaccggttcgtacggcacggacccgacgtccgcccggtccccg

SEQ ID NO: 28034 - DNA, 132 bp, Homo sapiens
  misc_feature: GYAE6OF01B7T0Q.48.13.B02.1.454.CMB.1.raw
  modified_base (132)..(132): a, c, t, g, unknown or other
  misc_feature (132)..(132): n is a, c, g, or t
tcagagtatacatacacgaccggtgctcgatttagtctagcgacttccgcgggcacgaccggtgctcgatttagtctagcgactcccgccatctgatatgtatactctgagcgggctggcaaggcgcatagn

SEQ ID NO: 28035 - DNA, 131 bp, Homo sapiens
  misc_feature: GYAE6OF02HHQ9F.48.13.B02.1.454.CMB.1.raw
tcagagtatacatacacgaccggtgctcgatttagtctagcgacttccgcgggcacgaccggtgctcgatttagtctagcgactcccgccatctgatatgtatactctgagcgggctggcaaggcgcatag

SEQ ID NO: 28036 - DNA, 132 bp, Homo sapiens; identical to SEQ ID NO: 28034
  misc_feature: GYAE6OF02FZZON.48.13.B02.1.454.CMB.1.raw
  modified_base (132)..(132): a, c, t, g, unknown or other
  misc_feature (132)..(132): n is a, c, g, or t

SEQ ID NO: 28037 - DNA, 595 bp, Homo sapiens
  misc_feature: GYAE6OF01B9HTZ.25.21.B10.1.454.CMB.1.raw
  modified_base (369)..(369): a, c, t, g, unknown or other
  misc_feature (369)..(369): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (487)..(487): a, c, t, g, unknown or other
  misc_feature (487)..(487): n is a, c, g, or t
  modified_base (540)..(540): a, c, t, g, unknown or other
  misc_feature (540)..(540): n is a, c, g, or t
tcagactgtacagtcacgaccggtgctcgatttagtgtcgtcgcaagagagagtagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtggggggaggcctgggtcaaggccgtggggggtccccaagactctcttgtgcagcctctggattcaacttcgaaaggctaacagcatgaactggactccgcaggcgtcggggaaggtctgcagtggtatttcgactcctagttaggtgtactaagcgtagtactaaattttngtcagtacgtcggtagaacggtccggttacaccgatcctccaaggacgacgaacgccgacgtctttctcttctcgactaatcgaacngcctnacgacgccgagacacgtcttagtttnttctgtcgcgagagggtagtacgggacgtaaacgtggtaccgtaggtacgggnggttagtagttcgttcgttttaggtagtttccgggtcggggtaccggtaaacggg

SEQ ID NO: 28038 - DNA, 556 bp, Homo sapiens
  misc_feature: GYAE6OF02IY7VZ.25.21.B10.1.454.CMB.1.raw
  modified_base (355)..(355): a, c, t, g, unknown or other
  misc_feature (355)..(355): n is a, c, g, or t
  modified_base (420)..(420): a, c, t, g, unknown or other
  misc_feature (420)..(420): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
tcagactgtacagtcacgaccggtgctcgatttagtgtcgtcgcaaggagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggagcctggtcaagcctggggggtcccaaggactctcttgtgcagcctctggattcaacttcaaaaggctacagcatgaactggatccgccaggctccggggaaggtctgcagtggatttcatccattgtgtcttaagcgtgaactaattttangcagctcggtgaacggtccggttcaccatcctccaagacacaacgccgacgtactttctctttcngacaaatgaacngcctcgancgccgaggacacggtcttgttttattctgtgcgaggaggagtagggactaaagtggcttacggacgggaggtagtagttcgttcgttttgaagtttccggtagggcccgtaaaggg

SEQ ID NO: 28039 - DNA, 841 bp, Homo sapiens
  misc_feature: GYAE6OF02JGJ7G.25.21.B10.1.454.CMB.1.raw
  modified_base (175)..(175): a, c, t, g, unknown or other
  misc_feature (175)..(175): n is a, c, g, or t
  modified_base (186)..(186): a, c, t, g, unknown or other
  misc_feature (186)..(186): n is a, c, g, or t
  modified_base (801)..(801): a, c, t, g, unknown or other
  misc_feature (801)..(801): n is a, c, g, or t
  modified_base (822)..(822): a, c, t, g, unknown or other
  misc_feature (822)..(822): n is a, c, g, or t
tcagactgtacagtcacgaccggtgctcgatttagtgtcgtcgcaagagagacggagccttagccctggattccaaggcctttccacgttggtgatcgagcactgagcaccgagattcaccatggagtcgggctcgctgggtttcctgtcgctattttgaaggtgtccagttcgngtaggtggtancgtggtggagtcggtggggacgtccgtggtcaacggccggttcggggggtccctaagccgttccgtgttcgcgtcgacggtcctacgtgggtaccttacgtaacctttacgaaacggtccttacgaacgtacgtagtaacggtaaccgttacgggtccgtacccgaccgtacggggtacccggtaaccggggtaagggtccttcggtaccgtaaggtttaccggggttaacctttaccgtaaaacgtttcccgttaaaggttttaaggtttaacgggttaccccgtttaaaaggtcccggttaattaaacccgttaaaagtttttccgaccggtttacgtacgttaacccgggttacggtaaccggggtaacccgttacccgggtttactaacccgttacggttacccggttaccgacgggttaaacgaacccggtaaacggtaccccggtacgtttaaccccgtttcgtttaccgttccgtttaacgaaccgttaacgtaccggtaaccgttacgtaccttacgaacgggaacgtcccggaaccgtaggaccggttacttgttttacgacttgaacggtcgaagtacgcgttagacgagtacgtcagttcgganacgtgttagttccggtttagntcggtacggacgttaacgg

SEQ ID NO: 28040 - DNA, 782 bp, Homo sapiens
  misc_feature: GYAE6OF02FI4P0.25.21.B10.1.454.CMB.1.raw
tcagactgtacagtcacgaccggtgctcgatttagtgtcgtcgcaagggagaagtaggagccttagcccctggattccaaggcctttccacttggtgatcagctactgagtcaccgaggattcaccgatggtaagtgggcctccgctgggtttccttgtcgctatttagaaggtagtccagtgtgaggtggtgctggtggagttctgggggagtcctggtcaagccgttaggggggtcccaaggactctcgttggtgccacgtcctcgtgggacttcaactttcgaaaggctacagctatgtaacctggactccgccaggtccgtaccgggggaagggtcctggactaggtcggtaatttcgaacgtcctagtttacggttaggttactttaaaggccgttaggtaaacttaaactttttagcggtactaaggttaccgttcgggtaacggtaaccgggtccccggtttcaaccgtactccgttaccgaagtacgaaccgaaccgtccccggtaacggttacccttttaccgttcctttaccgtagtaaaccgtaaagtcgtaaaccgtaccggtacccttacggaacggtaccggtacccgggaacgggtaaccgtaccgggtaccgttttaacggtttttaccttttggtacggttcggacggtaggtagggtaccgggttacgggaccgttaaacggtcggtaaccgttaccggtaaccggggtaggttacgtagtcgtttcgtttagtacggttttcgggtacgggtacgttaacggg

SEQ ID NO: 28041 - DNA, 628 bp, Homo sapiens
  misc_feature: GYAE6OF02GFLKV.25.21.B10.1.454.CMB.1.raw
  modified_base (335)..(335): a, c, t, g, unknown or other
  misc_feature (335)..(335): n is a, c, g, or t
  modified_base (353)..(353): a, c, t, g, unknown or other
  misc_feature (353)..(353): n is a, c, g, or t
tcagactgtacagtcacgaccggtgctcgatttagtgtcgtcgcaagagaggaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggagcctggtcaagccgtggggggtcccaagactcgtcttgtgcagcctctggattcaacttcaaaggctacagcatgaactggactccgccaggctccggggaaggtctgcagtgattcatccattagtgtnttaagctagactaatttntgacagacgtcggtaggaaccggtccggttacaccgatctccagacaccgaacgccgacgtactttcctctttcagacctaaatcgaactacgaccttacgaacgtacgcccggaaggaccgaccgggtacttagttttacgtttcgtagtcgacgtaggtagggtaggtacgggacgtaaacggtcggtacgtaccggttaacggggaacggtttaggacgtttagttaccgttttaggtacggttttcccggtagggggtaccccgtaagggg

SEQ ID NO: 28042 - DNA, 782 bp, Homo sapiens
  misc_feature: GYAE6OF02IE6D6.25.21.B10.1.454.CMB.1.raw
  modified_base (163)..(163): a, c, t, g, unknown or other
  misc_feature (163)..(163): n is a, c, g, or t
tcagactgtacagtcacgaccggtgctcgatttagtgtcgtcgcaagaggagaggagccttagccctggattccaaggcctttcacttggtgatcagcactgagcaccgaggacttcaccatggagtggggctcgctgggtttcctgtcgctatttagaggtntccagtcgtgaggtggtgctggtggtagtcgtgggggagcctggtcaaggccgtggggggtaccccaaggtactctcgttgtcactagtcctcgtaggtattccaacgttacgtaaacggacttacgacgtacgtatacggtaaccgtgggaacctcccggaccgtaacgggttacccgggaacccggggggtaaacgggttccgtacggtaccgtaaggggtacggtacttttacgacgtaccttagttacggttgtaacgttaacggtacgtcgtaaacttagttttagacgtactacgtcgtacgggtcgtaaaccggtccggttacaccgtactccgtcgaacgtacgtaaccgtaccgaccggtaccgttaaccgtttcttacgttttcgacgtaaccgtaagtaacgtaacgtaccggttccacggttaccggtaacgaccggtacgggacccgtaacggggttccttacgggttttaccttcggtcgttacgtaccggtaaacggtgggtaacgtttacggggaccggtaacggtccggtaacgtcggtaaggtccgtaggtacttcggttcgttaccggttacggtttcggaccggggtaattacccgggg

SEQ ID NO: 28043 - DNA, 126 bp, Homo sapiens
  misc_feature: GYAE6OF01ETDKX.47.78.H01.1.454.CMB.1.raw
  modified_base (126)..(126): a, c, t, g, unknown or other
  misc_feature (126)..(126): n is a, c, g, or t
tcagagctcacgtacacgaccggtgctcgatttagtgtgagtagttggttggcacagcggccctgggctgcctggtcaaggactacttcctacgtgagctctgagcgggctggcaaggcgcatagn

SEQ ID NO: 28044 - DNA, 269 bp, Homo sapiens
  misc_feature: GYAE6OF01BFE39.47.78.H01.1.454.CMB.1.raw
  modified_base (256)..(269): a, c, t, g, unknown or other
  misc_feature (256)..(269): n is a, c, g, or t
tcagagctcacgtacacgaccggtgctcgatttagtgtgagtagtttgggtttggggtggatcactactactactactacatggacgtctgggcaaagggaccacggtcaccgtctcctcagcttccaccaagggcccatcggtcttcccctggcgccctgctccaggagcacctctggggcacagcggccctgggctgcctggtcaaggactacttcctacgtgagctctgagcgggctaggcaaggcgcatagnnnnnnnnnnnnnn

SEQ ID NO: 28045 - DNA, 173 bp, Homo sapiens
  misc_feature: GYAE6OF01DEVXM.47.78.H01.1.454.CMB.1.raw
  modified_base (172)..(173): a, c, t, g, unknown or other
  misc_feature (172)..(173): n is a, c, g, or t
tcagagctcacgtacacgaccggtgctcgatttagtgtgagtagtttgggtttggggaagaggaagactgacggtccccacggagttcaggtgctgggcacagcggccctgggctgcctggtcaaggactacttcctacgtgagctctgagcgggctggcaaggcgcatagnn

SEQ ID NO: 28046 - DNA, 164 bp, Homo sapiens
  misc_feature: GYAE6OF01A79PJ.47.78.H01.1.454.CMB.1.raw
  modified_base (163)..(164): a, c, t, g, unknown or other
  misc_feature (163)..(164): n is a, c, g, or t
tcagagctcacgtacacgaccggtgctcgatttagtgtgagtagtttgggtttgggcggagggaccaaactgaccgtcctaggtcagcccaaggctgcccctcggtcactctgttcccaccctcctctacgtgagctctgagcgggctggcaaggcgcatagnn

SEQ ID NO: 28047 - DNA, 264 bp, Homo sapiens
  misc_feature: GYAE6OF01BSAZ4.47.78.H01.1.454.CMB.1.raw
  modified_base (257)..(264): a, c, t, g, unknown or other
  misc_feature (257)..(264): n is a, c, g, or t
tcagagctcacgtacacgaccggtgctcgatttagtgtgagtagtttgggtttggggtggatcactactactactactacatggacgtctgggcaaagggaccacggtcaccgtctcctcagcttccaccaagggcccatcggtcttcccctggcgccctgctccaggagcacctctgggggcacagcggccctgggctgcctggtcaaggactacttcctacgtgagctctgagcgggctggcaaaggcgcatagnnnnnnnn

SEQ ID NO: 28048 - DNA, 130 bp, Homo sapiens
  misc_feature: GYAE6OF01EOWGA.47.78.H01.1.454.CMB.1.raw
  modified_base (129)..(130): a, c, t, g, unknown or other
  misc_feature (129)..(130): n is a, c, g, or t
tcagagctcacgtacacgaccggtgctcgatttagtgtgagtagttgggtttgggcacagcggccctgggctgcctggtcaaggactacttcctatgtatactctgagcgggctggcaaggcgcatagnn

SEQ ID NO: 28049 - DNA, 170 bp, Homo sapiens
  misc_feature: GYAE6OF01CWBCQ.47.78.H01.1.454.CMB.1.raw
  modified_base (170)..(170): a, c, t, g, unknown or other
  misc_feature (170)..(170): n is a, c, g, or t
tcagagctcacgtacacgaccggtgctcgatttagtgtgagtagtttgggtttgggaagaggaagactgacggtccccaggagttcaggtgctgggcacagcggccctgggctgcctggtcaaggactacttcctacgtgagctctgagcgggctggcaaggcgcatagn

SEQ ID NO: 28050 - DNA, 130 bp, Homo sapiens
  misc_feature: GYAE6OF01C9ZHC.47.78.H01.1.454.CMB.1.raw
  modified_base (130)..(130): a, c, t, g, unknown or other
  misc_feature (130)..(130): n is a, c, g, or t
tcagagctcacgtacacgaccggtgctcgatttagtgtgagtagtttgggtttgggcacagcggccctgggctgcctggtcaaggactacttcctatgtatactctgagcgggctggcaaggcgcatagn

SEQ ID NO: 28051 - DNA, 129 bp, Homo sapiens
  misc_feature: GYAE6OF01B1EWR.47.78.H01.1.454.CMB.1.raw
  modified_base (128)..(129): a, c, t, g, unknown or other
  misc_feature (128)..(129): n is a, c, g, or t
tcagagctcacgtacacgaccggtgctcgatttagtgtgagtagtttgggtttggcacagcggccctggctgcctggtcaaggactacttcctacgtgagctctgagcgggctggcaaggcgcatagnn

SEQ ID NO: 28052 - DNA, 255 bp, Homo sapiens
  misc_feature: GYAE6OF01CVA8I.47.78.H01.1.454.CMB.1.raw
  modified_base (254)..(255): a, c, t, g, unknown or other
  misc_feature (254)..(255): n is a, c, g, or t
tcagagctcacgtacacgaccggtgctcgatttagtgtgagtagtttgggtttgggtgatcactactactactactacatggacgtctggggcaaagggaccacggtcaccgtctcctcagcttccaccaagggcccatcggtcttcccctggcgccctgctccaggagcacctctggggcacagcggccctgggctgcctggtcaaggactacttcctacgtgagctctgagcgggctggcaaggcgcatagnn

SEQ ID NO: 28053 - DNA, 130 bp, Homo sapiens
  misc_feature: GYAE6OF01A8ZUA.47.78.H01.1.454.CMB.1.raw
  modified_base (129)..(130): a, c, t, g, unknown or other
  misc_feature (129)..(130): n is a, c, g, or t
tcagagctcacgtacacgaccggtgctcgatttagtgtgagtagtttgggttgggcacagcggccctgggctgcctggtcaaggactacttcctacgtgagctctgagcgggctggcaaggcgcatagnn

SEQ ID NO: 28054 - DNA, 164 bp, Homo sapiens
  misc_feature: GYAE6OF01BEL1C.47.78.H01.1.454.CMB.1.raw
  modified_base (163)..(164): a, c, t, g, unknown or other
  misc_feature (163)..(164): n is a, c, g, or t
tcagagctcacgtacacgaccggtgctcgatttagtgtgagtagtttgggtttgggcggagggaccaaactgaccgtcctaggtcagcccaaggctgcccctcggtcactctgttcccgccctcctctacgtgagctctgagcgggctggcaaggcgcatagnn

SEQ ID NO: 28055 - DNA, 262 bp, Homo sapiens
  misc_feature: GYAE6OF01BANHJ.47.78.H01.1.454.CMB.1.raw
  modified_base (258)..(262): a, c, t, g, unknown or other
  misc_feature (258)..(262): n is a, c, g, or t
tcagagctcacgtacacgaccggtgctcgatttagtgtgagtagtttgggtttggggttgatcactactactactactacatggacgtctggggcaaagggaccacggtcaccgtctcctcagcttccaccaagggcccatcggtcttccccctggcgccctgctccaggagcacctctgggggcacagcggccctgggctgcctggtcaaggactacttcctacgtgagctctgagcgggctggcaaggcgcatagnnnnn

SEQ ID NO: 28056 - DNA, 173 bp, Homo sapiens
  misc_feature: GYAE6OF01CAG8P.47.78.H01.1.454.CMB.1.raw
  modified_base (173)..(173): a, c, t, g, unknown or other
  misc_feature (173)..(173): n is a, c, g, or t
tcagagctcacgtacacgaccggtgctcgatttagtgtgagtagtttgggtttgggggaagaggaagactgacggtcccccaggagttcaggtgctgggcacagcggccctgggctgcctggtcaaggactacttcctatgtatactctgagcgggctggcaaggcgcatagn

SEQ ID NO: 28057 - DNA, 139 bp, Homo sapiens
  misc_feature: GYAE6OF01B3AUT.47.78.H01.1.454.CMB.1.raw
  modified_base (130)..(139): a, c, t, g, unknown or other
  misc_feature (130)..(139): n is a, c, g, or t
tcagagctcacgtacacgaccggtgctcgatttagtgtgagtagtttgggtttgggcacagcggccctgggctgcctggtcaaggactacttcctatgtatactctgagcgggctggcaaggcgcatagnnnnnnnnnn

SEQ ID NO: 28058 - DNA, 164 bp, Homo sapiens; identical to SEQ ID NO: 28054
  misc_feature: GYAE6OF01AL6ON.47.78.H01.1.454.CMB.1.raw
  modified_base (163)..(164): a, c, t, g, unknown or other
  misc_feature (163)..(164): n is a, c, g, or t

SEQ ID NO: 28059 - DNA, 259 bp, Homo sapiens
  misc_feature: GYAE6OF01AX797.47.78.H01.1.454.CMB.1.raw
  modified_base (257)..(259): a, c, t, g, unknown or other
  misc_feature (257)..(259): n is a, c, g, or t
tcagagctcacgtacacgaccggtgctcgatttagtgtgagtagtttgggtttggggtgatcactactactactactacatggacgtctggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnn

SEQ ID NO: 28060 - DNA, 173 bp, Homo sapiens
  misc_feature: GYAE6OF01BGLLJ.47.78.H01.1.454.CMB.1.raw
  modified_base (173)..(173): a, c, t, g, unknown or other
  misc_feature (173)..(173): n is a, c, g, or t
tcagagctcacgtacacgaccggtgctcgatttagtgtgagtagtttgggtttgggggaagaggaagactgacggtcccccaggagttcaggtgctgggcacagcggccctgggctgcctggtcaaggactacttcctacgtgagctctgagcgggctggcaaggcgcatagn

SEQ ID NO: 28061 - DNA, 271 bp, Homo sapiens
  misc_feature: GYAE6OF01CNBOJ.47.78.H01.1.454.CMB.1.raw
  modified_base (263)..(271): a, c, t, g, unknown or other
  misc_feature (263)..(271): n is a, c, g, or t
tcagagctcacgtacacgaccggtgctcgatttagtgtgagtagtttgggtttgggggtaggatcgactactactactactacatggacgtctggggcaaagggaccacggtcaccgtctcctcagccttccaccaagggcccatcggtcttccccctggcgccctgctccaggagcacctctgggggcacagcggccctgggcctgcctggtcaaggacctacttcctacgtgagctctgagcggctggcaaggcgcatagnnnnnnnnn

SEQ ID NO: 28062 - DNA, 186 bp, Homo sapiens
  misc_feature: GYAE6OF01B996L.47.78.H01.1.454.CMB.1.raw
  modified_base (138)..(139): a, c, t, g, unknown or other
  misc_feature (138)..(139): n is a, c, g, or t
  modified_base (141)..(186): a, c, t, g, unknown or other
  misc_feature (141)..(186): n is a, c, g, or t
tcagagctcacgtacacgaccggtgctcgatttagtgtgagtagttgggttggcacagcgggccctgggctgccctggtcaagggactacttcctatgtataccctgagcgggcgtggcgaaggacggcctataggtnncnnnnnnnnnnnnnnnnnnnnnnnnnnnnnnnnnnnnnnnnnnnnnn

SEQ ID NO: 28063 - DNA, 232 bp, Homo sapiens
  misc_feature: GYAE6OF01CZW72.47.78.H01.1.454.CMB.1.raw
  modified_base (184)..(232): a, c, t, g, unknown or other
  misc_feature (184)..(232): n is a, c, g, or t
tcagagctcacgtacacgaccggtgctcgatttagtgtgagtagtttggggttgggggaaggggaggaagacgtggaccggtcccccaggagttcagggtgctcgggcacaggccggcccgtggctgcctggtcaagactactccacgtgaggctctggagcgggcctggcaaggccgcatagnnnnnnnnnnnnnnnnnnnnnnnnnnnnnnnnnnnnnnnnnnnnnnnnn

SEQ ID NO: 28064 - DNA, 256 bp, Homo sapiens
  misc_feature: GYAE6OF01BJ0AA.47.78.H01.1.454.CMB.1.raw
  modified_base (231)..(256): a, c, t, g, unknown or other
  misc_feature (231)..(256): n is a, c, g, or t
tcagagctcacgtacacgaccggtgctcgatttagtgtgagtagtttgggtttgggcgggagggaccaaactgaccgtcctaggccgcagtctgggtctctcacccttgttctggtctggcctcctcagtctgggttcttgtcggaacaggtcagcccaaggctgccccctggtcactctgttcccacctcctctacgtgagctctgagcgggctgggcaaggcgcatagnnnnnnnnnnnnnnnnnnnnnnnnnn

SEQ ID NO: 28065 - DNA, 164 bp, Homo sapiens; identical to SEQ ID NO: 28054
  misc_feature: GYAE6OF01DSHQZ.47.78.H01.1.454.CMB.1.raw
  modified_base (163)..(164): a, c, t, g, unknown or other
  misc_feature (163)..(164): n is a, c, g, or t

SEQ ID NO: 28066 - DNA, 130 bp, Homo sapiens; identical to SEQ ID NO: 28050
  misc_feature: GYAE6OF01C5MX1.47.78.H01.1.454.CMB.1.raw
  modified_base (130)..(130): a, c, t, g, unknown or other
  misc_feature (130)..(130): n is a, c, g, or t

SEQ ID NO: 28067 - DNA, 130 bp, Homo sapiens
  misc_feature: GYAE6OF01D84MJ.47.78.H01.1.454.CMB.1.raw
  modified_base (130)..(130): a, c, t, g, unknown or other
  misc_feature (130)..(130): n is a, c, g, or t
tcagagctcacgtacacgaccggtgctcgatttagtgtgagtagtttgggtttgggcacagcggccctgggctgcctggtcaaggactacttcctacgtgagctctgagcgggctggcaaggcgcatagn

SEQ ID NO: 28068 - DNA, 130 bp, Homo sapiens; identical to SEQ ID NO: 28067
  misc_feature: GYAE6OF01D1S08.47.78.H01.1.454.CMB.1.raw
  modified_base (130)..(130): a, c, t, g, unknown or other
  misc_feature (130)..(130): n is a, c, g, or t

SEQ ID NO: 28069 - DNA, 132 bp, Homo sapiens
  misc_feature: GYAE6OF01CPR30.47.78.H01.1.454.CMB.1.raw
  modified_base (130)..(132): a, c, t, g, unknown or other
  misc_feature (130)..(132): n is a, c, g, or t
tcagagctcacgtacacgaccggtgctcgatttagtgtgagtagtttgggtttgggcacagcggccctgggctgcctggtcaaggactacttcctacgtgagctctgagcgggctggcaaggcgcatagnnn

SEQ ID NO: 28070 - DNA, 164 bp, Homo sapiens
  misc_feature: GYAE6OF01CC0XZ.47.78.H01.1.454.CMB.1.raw
  modified_base (164)..(164): a, c, t, g, unknown or other
  misc_feature (164)..(164): n is a, c, g, or t
tcagagctcacgtacacgaccggtgctcgatttagtgtgagtagtttgggtttgggcggagggaccaaactgaccgtcctaggtcagcccaaggctgccccctcggtcactctgttcccgccctcctctacgtgagctctgagcgggctggcaaggcgcatagn

SEQ ID NO: 28071 - DNA, 133 bp, Homo sapiens
  misc_feature: GYAE6OF01CVKQE.47.78.H01.1.454.CMB.1.raw
  modified_base (130)..(133): a, c, t, g, unknown or other
  misc_feature (130)..(133): n is a, c, g, or t
tcagagctcacgtacacgaccggtgctcgatttagtgtgagtagtttgggtttgggcacagcggccctgggctgcctggtcaaggactacttcctacgtgagctctgagcgggctggcaaggcgcatagnnnn

SEQ ID NO: 28072 - DNA, 269 bp, Homo sapiens
  misc_feature: GYAE6OF01BO5R8.47.78.H01.1.454.CMB.1.raw
  modified_base (258)..(269): a, c, t, g, unknown or other
  misc_feature (258)..(269): n is a, c, g, or t
tcagagctcacgtacacgaccggtgctcgatttagtgtgagtagtttgggtttgggggtgatcactactactactactacatggacgtctggggcaaagggaccacggtcaccgtctcctcagcttccaccaagggcccatcggtcttccccctggcgccctgctccaggagcacctctgggggcacagtggccctgggctgcctggtcaaggactacttcctacgtgagctctgagcgggctggcaaggcgcatagnnnnnnnnnnnn

SEQ ID NO: 28073 - DNA, 163 bp, Homo sapiens
  misc_feature: GYAE6OF01C4E40.47.78.H01.1.454.CMB.1.raw
  modified_base (163)..(163): a, c, t, g, unknown or other
  misc_feature (163)..(163): n is a, c, g, or t
tcagagctcacgtacacgaccggtgctcgatttagtgtgagtagtttgggtttgggcggagggaccaaactgaccgtcctaggtcagcccaaggctgcccctcggtcactctgttcccaccctcctctacgtgagctctgagcgggctggcaaggcgcatagn

SEQ ID NO: 28074 - DNA, 285 bp, Homo sapiens
  misc_feature: GYAE6OF01A0QTJ.47.78.H01.1.454.CMB.1.raw
  modified_base (233)..(285): a, c, t, g, unknown or other
  misc_feature (233)..(285): n is a, c, g, or t
tcagagctcacgtacacgaccggtgctcgatttagtgtgagtagtttgggtttggggcgggagggaccaaactggaccgtcctaggcgcagtctgggtctctcacccttgttctggtctggcctcctcagtctgggttctgtcggaacaggtcagcccaaggctgccccctcggtcactctcgttcccaccctcctctacgtgagctctgagcgggctggcaaggcgcatagnnnnnnnnnnnnnnnnnnnnnnnnnnnnnnnnnnnnnnnnnnnnnnnnnnnnn

SEQ ID NO: 28075 - DNA, 533 bp, Homo sapiens
  misc_feature: GYAE6OF01CT8L5.47.78.H01.1.454.CMB.1.raw
  modified_base (298)..(298): a, c, t, g, unknown or other
  misc_feature (298)..(298): n is a, c, g, or t
  modified_base (341)..(341): a, c, t, g, unknown or other
  misc_feature (341)..(341): n is a, c, g, or t
tcagagctcacgtacacgaccggtgctcgatttagtgtgagtagtttgggtttgggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttccttcagtcaagtctggataagctgggtccnccaggctccagggatgggcctggagtgggtggccgtgtcaagngcagaactgatggtgcgacatctgaatacgctgcacccgtgaaaggcagatcacatctccagagatgattacaaataatatgtcatatctaacaatgatagacctagaaatcgaagatactaggtgtttaattactcgttaccacgtagggtaatggcggttctcgtggggccgaagggacaagtggtctag

SEQ ID NO: 28076 - DNA, 131 bp, Homo sapiens
  misc_feature: GYAE6OF01AF8SJ.47.78.H01.1.454.CMB.1.raw
  modified_base (130)..(131): a, c, t, g, unknown or other
  misc_feature (130)..(131): n is a, c, g, or t
tcagagctcacgtacacgaccggtgctcgatttagtgtgagtagtttgggtttgggcacagcggccctgggctgcctggtcaaggactacttcctatgtatactctgagcgggctggcaaggcgcatagnn

SEQ ID NO: 28077 - DNA, 249 bp, Homo sapiens
  misc_feature: GYAE6OF01ARCME.47.78.H01.1.454.CMB.1.raw
  modified_base (231)..(249): a, c, t, g, unknown or other
  misc_feature (231)..(249): n is a, c, g, or t
tcagagctcacgtacacgaccggtgctcgatttagtgtgagtagtttgggtttgggcggagggaccaaactgaccgtcctaggcgcagtctgggtctctcacccttgttctggtctggcctcctcagtctgggttcttgtcggaacaggtcagcccaaggctgccccctcggtcactctgttcccgccctcctctaccgtgagctctgagcgggctggcaaggcgcatagnnnnnnnnnnnnnnnnnnn

SEQ ID NO: 28078 - DNA, 174 bp, Homo sapiens
  misc_feature: GYAE6OF01BSMGV.47.78.H01.1.454.CMB.1.raw
  modified_base (173)..(174): a, c, t, g, unknown or other
  misc_feature (173)..(174): n is a, c, g, or t
tcagagctcacgtacacgaccggtgctcgatttagtgtgagtagtttgggtttgggggaagaggaagactgacggtcccccaggagttcaggtgctgggcacagcggccctgggctgcctggtcaaggactacttcctatgtatactctgagcgggctggcaaggcgcatagnn

SEQ ID NO: 28079 - DNA, 163 bp, Homo sapiens
  misc_feature: GYAE6OF01C0GFT.47.78.H01.1.454.CMB.1.raw
  modified_base (163)..(163): a, c, t, g, unknown or other
  misc_feature (163)..(163): n is a, c, g, or t
tcagagctcacgtacacgaccggtgctcgatttagtgtgagtagtttgggtttgggcggagggaccaaactgaccgtcctaggtcagcccaaggctgcccctcggtcactctgttcccgccctcctctacgtgagctctgagcgggctggcaaggcgcatagn

SEQ ID NO: 28080 - DNA, 131 bp, Homo sapiens
  misc_feature: GYAE6OF01DUN7R.47.78.H01.1.454.CMB.1.raw
  modified_base (130)..(131): a, c, t, g, unknown or other
  misc_feature (130)..(131): n is a, c, g, or t
tcagagctcacgtacacgaccggtgctcgatttagtgtgagtagtttgggtttgggcacagcggccctgggctgcctggtcaaggactacttcctacgtgagctctgagcgggctggcaaggcgcatagnn

SEQ ID NO: 28081 - DNA, 490 bp, Homo sapiens
  misc_feature: GYAE6OF01BQ79T.47.78.H01.1.454.CMB.1.raw
  modified_base (206)..(206): a, c, t, g, unknown or other
  misc_feature (206)..(206): n is a, c, g, or t
  modified_base (262)..(262): a, c, t, g, unknown or other
  misc_feature (262)..(262): n is a, c, g, or t
  modified_base (299)..(299): a, c, t, g, unknown or other
  misc_feature (299)..(299): n is a, c, g, or t
  modified_base (324)..(324): a, c, t, g, unknown or other
  misc_feature (324)..(324): n is a, c, g, or t
  modified_base (367)..(367): a, c, t, g, unknown or other
  misc_feature (367)..(367): n is a, c, g, or t
  modified_base (391)..(391): a, c, t, g, unknown or other
  misc_feature (391)..(391): n is a, c, g, or t
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
  modified_base (450)..(451): a, c, t, g, unknown or other
  misc_feature (450)..(451): n is a, c, g, or t
  modified_base (454)..(455): a, c, t, g, unknown or other
  misc_feature (454)..(455): n is a, c, g, or t
  modified_base (457)..(458): a, c, t, g, unknown or other
  misc_feature (457)..(458): n is a, c, g, or t
  modified_base (460)..(461): a, c, t, g, unknown or other
  misc_feature (460)..(461): n is a, c, g, or t
  modified_base (463)..(465): a, c, t, g, unknown or other
  misc_feature (463)..(465): n is a, c, g, or t
  modified_base (467)..(467): a, c, t, g, unknown or other
  misc_feature (467)..(467): n is a, c, g, or t
  modified_base (469)..(472): a, c, t, g, unknown or other
  misc_feature (469)..(472): n is a, c, g, or t
  modified_base (474)..(480): a, c, t, g, unknown or other
  misc_feature (474)..(480): n is a, c, g, or t
  modified_base (482)..(484): a, c, t, g, unknown or other
  misc_feature (482)..(484): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
tcagagctcacgtacacgaccggtgctcgatttagtgtgagtagtttgggtttgggaccccgggcagagggtcgtcatactcttgctctggaagcagctcaacatcggaaggatgatgtgtactggtgcagcaactcccggaacgccccaaactcctcatctatacgaataatcagcggtcctcgaggggtccctgaccgtattcnctggctccaagtctggcgctcagccacctggccatcagtcgggctccggccgaggntgaggctggattagttactggtgtaggttggactcgnagctgactcgcttacgtcttcggancgtgggaccaggtcacgtctaggcacgaccaacggccaacccntcgtcactctcgttcccgcctctntacgtcgactctccgtgacggccggtctgggactaagggccacgtaanaggcacgngcnngtnntnntnntnnngngnnnngnnnnnnncnnncngngn

SEQ ID NO: 28082 - DNA, 129 bp, Homo sapiens
  misc_feature: GYAE6OF01E41Q5.47.78.H01.1.454.CMB.1.raw
tcagagctcacgtacacgaccggtgctcgatttagtgtgagtagtttgggtttgggcacagcggccctgggctgcctggtcaaggactacttcctacgtgagctctgagcgggctggcaaggcgcatag

SEQ ID NO: 28083 - DNA, 131 bp, Homo sapiens; identical to SEQ ID NO: 28080
  misc_feature: GYAE6OF01D9NT3.47.78.H01.1.454.CMB.1.raw
  modified_base (130)..(131): a, c, t, g, unknown or other
  misc_feature (130)..(131): n is a, c, g, or t

SEQ ID NO: 28084 - DNA, 170 bp, Homo sapiens
  misc_feature: GYAE6OF01ASAU7.47.78.H01.1.454.CMB.1.raw
  modified_base (165)..(170): a, c, t, g, unknown or other
  misc_feature (165)..(170): n is a, c, g, or t
tcagagctcacgtacacgaccggtgctcgatttagtgtgagtagtttgggtttgggtcggtagggaccgaaacgtgaccgtcctaggtcagccaaggctgcccctcggtcactctgttcccgcctcctctacgtgagctctgagcgggctggcaaggcgcatagnnnnnn

SEQ ID NO: 28085 - DNA, 165 bp, Homo sapiens
  misc_feature: GYAE6OF01CVTAP.47.78.H01.1.454.CMB.1.raw
  modified_base (164)..(165): a, c, t, g, unknown or other
  misc_feature (164)..(165): n is a, c, g, or t
tcagagctcacgtacacgaccggtgctcgatttagtgtgagtagtttgggtttgggcggagggaccaaactgaccgtcctaggtcagcccaaggctgcccctcggtcactctgttcccgccctcctctacgtgagctctgagcgggctgggcaaggcgcatagnn

SEQ ID NO: 28086 - DNA, 166 bp, Homo sapiens
  misc_feature: GYAE6OF01BWJ9Q.47.78.H01.1.454.CMB.1.raw
  modified_base (164)..(166): a, c, t, g, unknown or other
  misc_feature (164)..(166): n is a, c, g, or t
tcagagctcacgtacacgaccggtgctcgatttagtgtgagtagtttgggtttgggcggagggaccaaactgaccgtcctaggtcagcccaaggctgccccctcggtcactctgttcccgccctcctctacgtgagctctgagcgggctggcaaggcgcatagnnn

SEQ ID NO: 28087 - DNA, 231 bp, Homo sapiens
  misc_feature: GYAE6OF01DLB6W.47.78.H01.1.454.CMB.1.raw
  modified_base (229)..(231): a, c, t, g, unknown or other
  misc_feature (229)..(231): n is a, c, g, or t
tcagagctcacgtacacgaccggtgctcgatttagtgtgagtagtttgggtttgggcggagggaccaaactgaccgtcctaggcgcagtctgggtctctcacccttgttctggtctggcctcctcagtctgggttcttgtcggaacaggtcagcccaaggctgccccctggtcactctgttcccaccctcctctacgtgagctctgagcgggctggcaaggcgcatagnnn

SEQ ID NO: 28088 - DNA, 436 bp, Homo sapiens
  misc_feature: GYAE6OF01DZ702.47.78.H01.1.454.CMB.1.raw
  modified_base (426)..(426): a, c, t, g, unknown or other
  misc_feature (426)..(426): n is a, c, g, or t
  modified_base (432)..(436): a, c, t, g, unknown or other
  misc_feature (432)..(436): n is a, c, g, or t
tcagagctcacgtacacgaccggtgctcgatttagtgtgagtagtttgggtttggggacccccgggcagagggtcgtcatctcttgctctggaagcagctccaacatcggaaggaatgatgtgtactggttgcagcaactccccggaacggccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagccaaggctgccccctggtcactctcgttcccgccctcctctacgtgagctctgagcgggctggcaaggcncatagnnnnn

SEQ ID NO: 28089 - DNA, 130 bp, Homo sapiens; identical to SEQ ID NO: 28067
  misc_feature: GYAE6OF01AJWZ4.47.78.H01.1.454.CMB.1.raw
  modified_base (130)..(130): a, c, t, g, unknown or other
  misc_feature (130)..(130): n is a, c, g, or t

SEQ ID NO: 28090 - DNA, 183 bp, Homo sapiens
  misc_feature: GYAE6OF01BR16Z.47.78.H01.1.454.CMB.1.raw
  modified_base (165)..(183): a, c, t, g, unknown or other
  misc_feature (165)..(183): n is a, c, g, or t
tcagagctcacgtacacgaccggtgctcgatttagtgtgagtagtttgggtttgggcgggagggaccaaactgaccgtcctaggtcagcccaaggctgccccctcggtcactctgttcccaccctcctctacgtgagctctgagcgggctggcaaggcgcatagnnnnnnnnnnnnnnnnnnn

SEQ ID NO: 28091 - DNA, 453 bp, Homo sapiens
  misc_feature: GYAE6OF01EOFMU.47.78.H01.1.454.CMB.1.raw
  modified_base (441)..(453): a, c, t, g, unknown or other
  misc_feature (441)..(453): n is a, c, g, or t
tcagagctcacgtacacgaccggtgctcgatttagtgtgagtagtttgggtttggggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattactgtgtaggttgggatcgcagcctgactgcttacgtcttcggagctgggaccaaggtcaccgtctaggtcagcccaaggcccaacccatgtcactctcgttccccgccctcctctacgtgacgtctcgtgacggcgggctgggcaagggcgcatagnnnnnnnnnnnnn

SEQ ID NO: 28092 - DNA, 132 bp, Homo sapiens; identical to SEQ ID NO: 28069
  misc_feature: GYAE6OF01BLO7F.47.78.H01.1.454.CMB.1.raw
  modified_base (130)..(132): a, c, t, g, unknown or other
  misc_feature (130)..(132): n is a, c, g, or t

SEQ ID NO: 28093 - DNA, 262 bp, Homo sapiens
  misc_feature: GYAE6OF01AL4HP.47.78.H01.1.454.CMB.1.raw
  modified_base (257)..(262): a, c, t, g, unknown or other
  misc_feature (257)..(262): n is a, c, g, or t
tcagagctcacgtacacgaccggtgctcgatttagtgtgagtagtttgggtttgggggtgatcactactactaatactacatggacgtctggggcaaagggaccacggtcaccgtctccacagcctccaccaagggcccatcggtcttcccctggcgccctgctccaggagcacctccgagagcacagcggccctgggctgcctggtcaaggactacttcctacgtgagctctgagcgggctggcaaggcgcatagnnnnnn

SEQ ID NO: 28094 - DNA, 130 bp, Homo sapiens; identical to SEQ ID NO: 28067
  misc_feature: GYAE6OF01CRM6K.47.78.H01.1.454.CMB.1.raw
  modified_base (130)..(130): a, c, t, g, unknown or other
  misc_feature (130)..(130): n is a, c, g, or t

SEQ ID NO: 28095 - DNA, 198 bp, Homo sapiens
  misc_feature: GYAE6OF01C82O8.47.78.H01.1.454.CMB.1.raw
  modified_base (168)..(198): a, c, t, g, unknown or other
  misc_feature (168)..(198): n is a, c, g, or t
tcagagctcacgtacacgaccggtgctcgatttagtgtgagtagtttgggtttgggcggagggaccaactgaccgtcctaggtcagcccaaggctgccccctcggtcactcgtcgttcccgccctcctctacgtggagctctgagcgggctgggccaaggcgcatagnnnnnnnnnnnnnnnnnnnnnnnnnnnnnnn

SEQ ID NO: 28096 - DNA, 168 bp, Homo sapiens
  misc_feature: GYAE6OF01BX9RW.47.78.H01.1.454.CMB.1.raw
  modified_base (164)..(168): a, c, t, g, unknown or other
  misc_feature (164)..(168): n is a, c, g, or t
tcagagctcacgtacacgaccggtgctcgatttagtgtgagtagtttgggtttgggcggagggaccaaactgaccgtcctaggtcagcccaaggctgccccctcggtcactctgttcccgccctcctctacgtgagctctgagcgggctggcaaggcgcatagnnnnn

SEQ ID NO: 28097 - DNA, 174 bp, Homo sapiens
  misc_feature: GYAE6OF01C48IK.47.78.H01.1.454.CMB.1.raw
  modified_base (173)..(174): a, c, t, g, unknown or other
  misc_feature (173)..(174): n is a, c, g, or t
tcagagctcacgtacacgaccggtgctcgatttagtgtgagtagtttgggtttgggggaagaggaagactgacggtcccccaggagttcaggtgctgggcacagcggccctgggctgcctggtcaaggactacttcctacgtgagctctgagcgggctggcaaggcgcatagnn

SEQ ID NO: 28098 - DNA, 173 bp, Homo sapiens
  misc_feature: GYAE6OF01CGX54.47.78.H01.1.454.CMB.1.raw
  modified_base (172)..(173): a, c, t, g, unknown or other
  misc_feature (172)..(173): n is a, c, g, or t
tcagagctcacgtacacgaccggtgctcgatttagtgtgagtagtttgggtttggggaagaggaagactgacggtcccccaggagttcaggtgctgggcacagcggccctgggctgcctggtcaaggactacttcctacgtgagctctgagcgggctggcaaggcgcatagnn

SEQ ID NO: 28099 - DNA, 172 bp, Homo sapiens
  misc_feature: GYAE6OF01CVCLH.47.78.H01.1.454.CMB.1.raw
  modified_base (171)..(172): a, c, t, g, unknown or other
  misc_feature (171)..(172): n is a, c, g, or t
tcagagctcacgtacacgaccggtgctcgatttagtgtgagtagtttgggttggggaagaggaagactgaccggtcccccaggagttcaggtgctgggcacagcggccctgggctgcctggtcaaggactacttcctacgtgactctgagcgggctggcaaggcgcatagnn

SEQ ID NO: 28100 - DNA, 262 bp, Homo sapiens
  misc_feature: GYAE6OF01C05YN.47.78.H01.1.454.CMB.1.raw
  modified_base (257)..(262): a, c, t, g, unknown or other
  misc_feature (257)..(262): n is a, c, g, or t
tcagagctcacgtacacgaccggtgctcgatttagtgtgagtagtttgggtttggggtgatcactactactactactacatggacgtctggggcaaagggaccacggtcaccgtctcctcagcttccaccaagggcccatcggtcttccccctggcgccctgctccaggagcacctctgggggcacagcggccctgggctgcctggtcaaggactacttcctacgtgagctctgagcgggctggcaaggcgcatagnnnnnn

SEQ ID NO: 28101 - DNA, 285 bp, Homo sapiens
  misc_feature: GYAE6OF01C97M9.47.78.H01.1.454.CMB.1.raw
  modified_base (271)..(271): a, c, t, g, unknown or other
  misc_feature (271)..(271): n is a, c, g, or t
  modified_base (277)..(285): a, c, t, g, unknown or other
  misc_feature (277)..(285): n is a, c, g, or t
tcagagctcacgtacacgaccggtgctcgatttagtgtgagtagtttgggtttgggcagttttctctgaatcaaaaccccgagaccgccgcggacagcctcggcccctgggcccagaaaccctggtcaccgtctcctcagcttccaccaagggcccatcggtcttccccctggccgccctgctccaggagcacctcgtgggggcacagcggccctgggctgcctggtcaaggactacttcctatgtatactctgagcgggctggcaaggcncatagnnnnnnnnn

SEQ ID NO: 28102 - DNA, 164 bp, Homo sapiens; identical to SEQ ID NO: 28070
  misc_feature: GYAE6OF01BU814.47.78.H01.1.454.CMB.1.raw
  modified_base (164)..(164): a, c, t, g, unknown or other
  misc_feature (164)..(164): n is a, c, g, or t

SEQ ID NO: 28103 - DNA, 164 bp, Homo sapiens
  misc_feature: GYAE6OF01BF2G6.47.78.H01.1.454.CMB.1.raw
  modified_base (164)..(164): a, c, t, g, unknown or other
  misc_feature (164)..(164): n is a, c, g, or t
tcagagctcacgtacacgaccggtgctcgatttagtgtgagtagtttgggtttgggcggagggaccaaactgaccgtcctaggtcagcccaaggctgccccctcggtcactctgttcccaccctcctctacgtgagctctgagcgggctggcaaggcgcatagn

SEQ ID NO: 28104 - DNA, 166 bp, Homo sapiens; identical to SEQ ID NO: 28086
  misc_feature: GYAE6OF01BLF5U.47.78.H01.1.454.CMB.1.raw
  modified_base (164)..(166): a, c, t, g, unknown or other
  misc_feature (164)..(166): n is a, c, g, or t

SEQ ID NO: 28105 - DNA, 272 bp, Homo sapiens
  misc_feature: GYAE6OF01CFYJC.47.78.H01.1.454.CMB.1.raw
  modified_base (258)..(272): a, c, t, g, unknown or other
  misc_feature (258)..(272): n is a, c, g, or t
tcagagctcacgtacacgaccggtgctcgatttagtgtgagtagtttgggtttgggggtgatcactactactactactacatggacgtctggggcaaagggaccacggtcaccgtctcctcagcttccaccaagggcccatcggtcttccccctggcgccctgctccaggagcacctctgggggcacagtggccctgggctgcctggtcaaggactacttcctacgtgagctctgagcgggctggcaaggcgcatagnnnnnnnnnnnnnnn

SEQ ID NO: 28106 - DNA, 175 bp, Homo sapiens
  misc_feature: GYAE6OF01EZE2O.47.78.H01.1.454.CMB.1.raw
  modified_base (164)..(175): a, c, t, g, unknown or other
  misc_feature (164)..(175): n is a, c, g, or t
tcagagctcacgtacacgaccggtgctcgatttagtgtgagtagtttgggtttgggcggagggaccaaactgaccgtcctaggtcagcccaaggctgccccctcggtcactctgttcccgccctcctctacgtgagctctgagcgggctggcaaggcgcatagnnnnnnnnnnnn

SEQ ID NO: 28107 - DNA, 173 bp, Homo sapiens; identical to SEQ ID NO: 28060
  misc_feature: GYAE6OF01D4FKB.47.78.H01.1.454.CMB.1.raw
  modified_base (173)..(173): a, c, t, g, unknown or other
  misc_feature (173)..(173): n is a, c, g, or t

SEQ ID NO: 28108 - DNA, 170 bp, Homo sapiens
  misc_feature: GYAE6OF01EG7HO.47.78.H01.1.454.CMB.1.raw
  modified_base (164)..(170): a, c, t, g, unknown or other
  misc_feature (164)..(170): n is a, c, g, or t
tcagagctcacgtacacgaccggtgctcgatttagtgtgagtagtttgggtttgggcggagggaccaaactgaccgtcctaggtcagcccaaggctgccccctcggtcactctgttcccaccctcctctacgtgagctctgagcgggctggcaaggcgcatagnnnnnnn

SEQ ID NO: 28109 - DNA, 229 bp, Homo sapiens
  misc_feature: GYAE6OF01A65IK.47.78.H01.1.454.CMB.1.raw
  modified_base (229)..(229): a, c, t, g, unknown or other
  misc_feature (229)..(229): n is a, c, g, or t
tcagagctcacgtacacgaccggtgctcgatttagtgtgagtagtttgggtttgggcggagggaccaaactgaccgtcctaggcgcagtctgggtctctcacccttgttctggtctggcctcctcagtctgggttcttgtcggaacaggtcagcccaaggctgccccctggtcactctgttcccgccctcctctacgtgagctctgagcgggctggcaaggcgcatagn

SEQ ID NO: 28110 - DNA, 261 bp, Homo sapiens
  misc_feature: GYAE6OF01B96ND.47.78.H01.1.454.CMB.1.raw
  modified_base (258)..(261): a, c, t, g, unknown or other
  misc_feature (258)..(261): n is a, c, g, or t
tcagagctcacgtacacgaccggtgctcgatttagtgtgagtagtttgggtttgggggtgatcactactactactactacatggacgtctggggcaaagggaccacggtcaccgtctcctcagcttccaccaagggcccatcggtcttccccctggcgccctgctccaggagcacctctgggggcacagcggccctgggctgcctggtcaaggactacttcctatgtatactctgagcgggctggcaaggcgcatagnnnn

SEQ ID NO: 28111 - DNA, 263 bp, Homo sapiens
  misc_feature: GYAE6OF01A0KNE.47.78.H01.1.454.CMB.1.raw
  modified_base (257)..(263): a, c, t, g, unknown or other
  misc_feature (257)..(263): n is a, c, g, or t
tcagagctcacgtacacgaccggtgctcgatttagtgtgagtagtttgggtttgggggtgatcactactactactactacatggacgtctggggcaaagggaccacggtcaccgtctcctcagcttccaccaagggcccatcggtcttcccctggcgccctgctccaggagcacctctgggggcacagcggccctgggctgcctggtcaaggactacttcctacgtgagctctgagcgggctggcaaggcgcatagnnnnnnn

SEQ ID NO: 28112 - DNA, 278 bp, Homo sapiens
  misc_feature: GYAE6OF01ASOR5.47.78.H01.1.454.CMB.1.raw
  modified_base (276)..(278): a, c, t, g, unknown or other
  misc_feature (276)..(278): n is a, c, g, or t
tcagagctcacgtacacgaccggtgctcgatttagtgtgagtagtttgggtttgggcagttttctctgaatcaaaaccccgagaccgccgcggacagcctcggcccctggggcccagaaaccctggtcaccgtctcctcagcttccaccaagggcccatcggtcttccccctggcgccctgctccaggagcacctctgggggcacagcggccctgggctgcctggtcaaggactacttcctacgtgagctctgagcgggctggcaaggcgcatagnnn

SEQ ID NO: 28113 - DNA, 174 bp, Homo sapiens; identical to SEQ ID NO: 28097
  misc_feature: GYAE6OF01C7W56.47.78.H01.1.454.CMB.1.raw
  modified_base (173)..(174): a, c, t, g, unknown or other
  misc_feature (173)..(174): n is a, c, g, or t

SEQ ID NO: 28114 - DNA, 598 bp, Homo sapiens
  misc_feature: GYAE6OF01CPAQP.47.78.H01.1.454.CMB.1.raw
  modified_base (301)..(301): a, c, t, g, unknown or other
  misc_feature (301)..(301): n is a, c, g, or t
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtcgtgggggaggcctcataaaggccggggggtcccttaaactctcctgcgcagcgtctggatttccttcagtcaagtctggataagctgggtccnccaggctccagggatgggcctggagttgggtgccgtgtcaagagcagaactgatggtgcgacatctagaatacgctgcacccgtgaaaggcagtatcaccatctcagagatgtattacaaataaatatagtacaatactactaactaaagtagtaataacgaccttaaggaaaactcggtaaagtaattaacgtaggttactttaatttaccgtagtttacccaacggtaagggtaattcggtcggtttccgtcggttacgggggacccggtaagggaacgtaagtggtacgttacg

SEQ ID NO: 28115 - DNA, 163 bp, Homo sapiens
  misc_feature: GYAE6OF01BOTLM.47.78.H01.1.454.CMB.1.raw
  modified_base (163)..(163): a, c, t, g, unknown or other
  misc_feature (163)..(163): n is a, c, g, or t
tcagagctcacgtacacgaccggtgctcgatttagtgtgagtagtttgggtttgggcggagggaccaaactgaccgtcctaggtcagcccaaggctgccccctcggtcactctgttcccgccctcctctacgtagctctgagcgggctggcaaggcgcatagn

SEQ ID NO: 28116 - DNA, 579 bp, Homo sapiens
  misc_feature: GYAE6OF01COML2.47.78.H01.1.454.CMB.1.raw
tcagagctcacgtacacgaccggtgctcgatttagtgtgagtagtttgggtttggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaaccaacagaagccaggccaggcccctgtcctggtcatctaataaggataacaaaccggccctcgtgggactccctagaacgatttctctggcctaccaattcggaacaacacggcccacctgaccatcagcagacgcccaagtcggagatgagctagacttatttctagtactaagtttggactagtcctcgtctcgtcggttacgttcggcgcgacgggaccaagcctacggacccgtaccgtaagtccacgcccgaacggcctccgcccccgtcggtacctaccgttccgttccgttcccccgcccttccctccgtcggtcg

SEQ ID NO: 28117 - DNA, 174 bp, Homo sapiens; identical to SEQ ID NO: 28097
  misc_feature: GYAE6OF01CIBF9.47.78.H01.1.454.CMB.1.raw
  modified_base (173)..(174): a, c, t, g, unknown or other
  misc_feature (173)..(174): n is a, c, g, or t

SEQ ID NO: 28118 - DNA, 564 bp, Homo sapiens
  misc_feature: GYAE6OF01A8A15.47.78.H01.1.454.CMB.1.raw
  modified_base (527)..(527): a, c, t, g, unknown or other
  misc_feature (527)..(527): n is a, c, g, or t
  modified_base (543)..(543): a, c, t, g, unknown or other
  misc_feature (543)..(543): n is a, c, g, or t
  modified_base (554)..(554): a, c, t, g, unknown or other
  misc_feature (554)..(554): n is a, c, g, or t
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtcgtgggggaggcctcataaaggccgggggggtcccttaaactctcctgcgcagcgtctggtatttcctttcagtcaagtctggataagctgggtccgccaggctccgagggatgggcctgggaggtggggttggccgtgtcaagagcagaactgagtggtgcgacatctagaactacgctcgccacccgtgaaacggcagactcaccatcctaccagagactgtaactacaaattaaatatagtactaatatactaactaaatcggtaataacgacttagaaattcggaagtatacgaggttgttattactgttacacgngggtatgcgttctcgngggccgagganacgtgtctag

SEQ ID NO: 28119 - DNA, 643 bp, Homo sapiens
  misc_feature: GYAE6OF01EQVUJ.47.78.H01.1.454.CMB.1.raw
  modified_base (304)..(304): a, c, t, g, unknown or other
  misc_feature (304)..(304): n is a, c, g, or t
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtcgtgggggaggcctcagtaaacggccgggggggtcccttaaactctcctgcgcagcgtctggatttccttcagtcaagtctggataagctgggtccncaggctccgagggatgggcctgggagtggggttggccgtgtcaagagcagaactgatggtgcgacatctagaactacgctcgcacccggtagaaacggcagtacttccacctactcctaccagagactgaacttacaaataaatagtgtactaatactactaaacaaagttaggaactacgtaccgtaagaaacgtacggtaaggtactaacgtagggtttatttaacgtttacgttacgttaacccgtaacggtaagggtaagttcgggttaccgggtttacgtcgggttacgggggacccgggtaagggtaacgtaaacggttcggtacgttaacgg

SEQ ID NO: 28120 - DNA, 537 bp, Homo sapiens
  misc_feature: GYAE6OF01C4T3C.47.78.H01.1.454.CMB.1.raw
  modified_base (222)..(222): a, c, t, g, unknown or other
  misc_feature (222)..(222): n is a, c, g, or t
  modified_base (407)..(407): a, c, t, g, unknown or other
  misc_feature (407)..(407): n is a, c, g, or t
  modified_base (439)..(439): a, c, t, g, unknown or other
  misc_feature (439)..(439): n is a, c, g, or t
  modified_base (449)..(449): a, c, t, g, unknown or other
  misc_feature (449)..(449): n is a, c, g, or t
  modified_base (534)..(534): a, c, t, g, unknown or other
  misc_feature (534)..(534): n is a, c, g, or t
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtcgtgggggaggcctnagtaaaggccggggggtcccttaaactctcctgcgcagcgtctggtatttccttcagtcaagtctggataagctgggtccgccaggctccgagggatggggcctggagtggggttggccgtggtcaagagcagaactgatggtgcgacatctgaatacgctgccaccgtgaaaggcagactcacntctccagagatgtaattacaaataatatgtanatatactaanaatgatagctagaaatcgagatagaggttattattatcgttacaggtaggatggtcgttctcgtaggggccgaggaccagtggtntag

SEQ ID NO: 28121 - DNA, 261 bp, Homo sapiens
  misc_feature: GYAE6OF01DA90P.47.78.H01.1.454.CMB.1.raw
  modified_base (258)..(261): a, c, t, g, unknown or other
  misc_feature (258)..(261): n is a, c, g, or t
tcagagctcacgtacacgaccggtgctcgatttagtgtgagtagtttgggtttgggggtgatcactactactactactacatggacgtctggggcaaagggaccacggtcaccgtctcctcagcttccaccaagggcccatcggtcttccccctggcgccctgctccaggagcacctctgggggcacagcggccctgggctgcctggtcaaggactacttcctacgtgagctctgagcgggctggcaaggcgcatagnnnn

SEQ ID NO: 28122 - DNA, 693 bp, Homo sapiens
  misc_feature: GYAE6OF01EOE7M.47.78.H01.1.454.CMB.1.raw
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtcgtgggggaggcctcagtaaacggccgggggggtacccttaaactctcctgcgcagcgtctggtactttcctttcagtcaagtctggataagcgtgggtccgcgaggctccgagggagtggggcctgggaggtggggttcggccgtgtcaaggagcgaagaactgagtggtgcgacatctagaataccgctcgccgaaccggtagaaacggcaagtacttaccgaactctacctaccaagacgattacgtattaactaaattaaagtattacgtaactaattaacgtacttaaacgtaaagttgggtaaacttacggtaccctaaagtaaaacgtacggaaaggtaacttaacggtaagggttttagttttaaacttaccgttaggtttaacccaacgggttaagggaaacgtttcgggtaaccgggttttccgtacggggtacgggggtacccggaagggtaacgtaggttcgggtcttaaccgg

SEQ ID NO: 28123 - DNA, 258 bp, Homo sapiens
  misc_feature: GYAE6OF01CX4XP.47.78.H01.1.454.CMB.1.raw
  modified_base (257)..(258): a, c, t, g, unknown or other
  misc_feature (257)..(258): n is a, c, g, or t
tcagagctcacgtacacgaccggtgctcgatttagtgtgagtagtttgggtttgggggtgatcactactactactactacatggacgtctggggcaaagggaccacggtcaccgtctcctcagcttccaccaagggcccatcggtcttccccctggcgccctgctccaggagcacctctgggggcacagcggccctgggctgcctggtcaaggctacttcctacgtgagctctgagcgggctggcaaggcgcatagnn

SEQ ID NO: 28124 - DNA, 230 bp, Homo sapiens
  misc_feature: GYAE6OF01CWW8C.47.78.H01.1.454.CMB.1.raw
  modified_base (230)..(230): a, c, t, g, unknown or other
  misc_feature (230)..(230): n is a, c, g, or t
tcagagctcacgtacacgaccggtgctcgatttagtgtgagtagtttgggtttgggcggagggaccaaactgaccgtcctaggcgcagtctgggtctctcacccttgttctggtctggcctcctcagtctgggttcttgtcggaacaggtcagcccaaggctgccccctcggtcactctgttcccaccctcctctacgtgagctctgagcgggctggcaaggcgcatagn

SEQ ID NO: 28125 - DNA, 602 bp, Homo sapiens
  misc_feature: GYAE6OF01C0E48.47.78.H01.1.454.CMB.1.raw
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttccttcagtcaagtctggataagctgggtccgccaggctccgagggatgggcctggagtgggttggccgtgtacgaagagcagaactgaagtggtgacgacatctagaaatacgctgcacccgtgaaaaggcagattcaccatcctaccagagatagattacaaataatatagtacaatatactaacaaataggatacgacctaagaaagtcgaagtaataacgtaggttagtttaattacgttacgttaccgaacgtaagggtaattacgggtccggtttaccgttcgggtacggggtaccggaagggtaacgaacgttgggttacgttaacg

SEQ ID NO: 28126 - DNA, 236 bp, Homo sapiens
  misc_feature: GYAE6OF01C4D3W.47.78.H01.1.454.CMB.1.raw
  modified_base (232)..(236): a, c, t, g, unknown or other
  misc_feature (232)..(236): n is a, c, g, or t
tcagagctcacgtacacgaccggtgctcgatttagtgtgagtagtttgggtttgggcggagggaccaaactgaccgtcctaggcgcagtctgggtctctcacccttgttctggtctggcctcctcagtctgggttcttgtcggaacaggtcagcccaaggctgcccccctggtcactctcgttcccaccctcctctacgtgagctctgagcgggctggcaaggcgcaatagnnnnn

SEQ ID NO: 28127 - DNA, 542 bp, Homo sapiens
  misc_feature: GYAE6OF01BCPTR.47.78.H01.1.454.CMB.1.raw
  modified_base (476)..(476): a, c, t, g, unknown or other
  misc_feature (476)..(476): n is a, c, g, or t
  modified_base (538)..(538): a, c, t, g, unknown or other
  misc_feature (538)..(538): n is a, c, g, or t
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttccttcagtcaagtctggataagctgggtccgccaggctccagggatggggcctggagtgggttggccgtgtcaagagcagaactgatggtgcgacatctagaatacgctgcacccgtgaaaggcagattcaccatctccagagatgattcaaataaatatgtcatatctaacaatgatacgacctagaaatcgagtatacgaggttntttattactgttaccacgaggtaatggtcggttctcgtcggggtaccgagggaacagtggtntacg

SEQ ID NO: 28128 - DNA, 132 bp, Homo sapiens
  misc_feature: GYAE6OF01BDJEK.47.78.H01.1.454.CMB.1.raw
  modified_base (129)..(132): a, c, t, g, unknown or other
  misc_feature (129)..(132): n is a, c, g, or t
tcagagctcacgtacacgaccggtgctcgatttagtgtgagtagtttgggtttggcacagcggccctgggctgcctggtcaaggactacttcctacgtgagctctgagcgggctggcaaggcgcatagnnnn

SEQ ID NO: 28129 - DNA, 143 bp, Homo sapiens
  misc_feature: GYAE6OF01ARFHI.47.78.H01.1.454.CMB.1.raw
  modified_base (131)..(143): a, c, t, g, unknown or other
  misc_feature (131)..(143): n is a, c, g, or t
tcagagctcacgtacacgaccggtgctcgatttagtgtgagtagtttgggtttgggcgacagcggccctgggctgcctggtcaaggactacttcctacgtgagctctgagcgggctggcaaggcgcatagnnnnnnnnnnnnn

SEQ ID NO: 28130 - DNA, 166 bp, Homo sapiens
  misc_feature: GYAE6OF01ER99O.47.78.H01.1.454.CMB.1.raw
  modified_base (134)..(166): a, c, t, g, unknown or other
  misc_feature (134)..(166): n is a, c, g, or t
tcagagctcacgtacacgaccggtgctcgatttagtgtgagtagtttgggtttgggcacagcggccctgggctgccgtggtcaaggactacttccgtatgtatactctggagcgggcttggcaaggcgcatagnnnnnnnnnnnnnnnnnnnnnnnnnnnnnnnnn

SEQ ID NO: 28131 - DNA, 606 bp, Homo sapiens
  misc_feature: GYAE6OF01AKWDH.47.78.H01.1.454.CMB.1.raw
  modified_base (276)..(276): a, c, t, g, unknown or other
  misc_feature (276)..(276): n is a, c, g, or t
  modified_base (345)..(345): a, c, t, g, unknown or other
  misc_feature (345)..(345): n is a, c, g, or t
  modified_base (414)..(414): a, c, t, g, unknown or other
  misc_feature (414)..(414): n is a, c, g, or t
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtcgtgggggaggcctcataaagccgggggggtcccttaaactctcctgcgcagcgtctggatttccttcngtcaagtctggataagctgggtccgccaggctccagggatgggcctggagtgggttggccgtgtcaagngcagactgatggtgcgacatctgaatacgctgcacccgtagaaaggcagattcaccatctccagagatnaattcaaataatatgtactatatactaacaatggaatacgtacctagaaaactcggaagtagtaaccgtagggtttagtttaacttacgttacgttacccgaacggtaacggggtaattcgggtccgggtttaccgtccgggttacgggggtaccccggtaggggaacctaacggttcgggttcgttaacgg

SEQ ID NO: 28132 - DNA, 240 bp, Homo sapiens
  misc_feature: GYAE6OF01B5CPS.47.78.H01.1.454.CMB.1.raw
  modified_base (231)..(240): a, c, t, g, unknown or other
  misc_feature (231)..(240): n is a, c, g, or t
tcagagctcacgtacacgaccggtgctcgatttagtgtgagtagtttgggtttgggcggagggaccaaactgaccgtcctaggcgcagtctgggtctctcacccttgttctggtctggcctcctcagtctgggttcttgtcggaacaggtcagcccaaggctgccccctggtcactctgttccccaccctcctctacgtgagctctggagcgggctggcaaggcgcatagnnnnnnnnnn

SEQ ID NO: 28133 - DNA, 686 bp, Homo sapiens
  misc_feature: GYAE6OF01DDEWA.47.78.H01.1.454.CMB.1.raw
  modified_base (309)..(309): a, c, t, g, unknown or other
  misc_feature (309)..(309): n is a, c, g, or t
  modified_base (356)..(356): a, c, t, g, unknown or other
  misc_feature (356)..(356): n is a, c, g, or t
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtcgtgggggaggcctcagtaaaaggcccgggggggtacccttaaactctcctgcgcagcgtctggtatttcctttcagtcaagtctaggataagctgggtccnccaggcctcgagggatggggcctggagtgggttggccgtgtcaaggngcagaactgagtggtgacgacattctagaactacgctcggccaacccggtaggaaaggcaaggtacttaccaccaactcctaccgaagagatagtattaacgaaaattaatagttagttacctaattacttaaccttaaacaaagttaggaacttaacggaccttaaaggtaaaacgtcggaaggtaacttaacgtagggtttagttttaacgttaccgttacggtttaccgaacggtaaacgggtaagttacgggttccgggtttaccgttccgggtacggggggtacccggaaaggggtaaccgtaaaggttcgggtacgtttaacgg

SEQ ID NO: 28134 - DNA, 176 bp, Homo sapiens
  misc_feature: GYAE6OF01C7J1G.47.78.H01.1.454.CMB.1.raw
  modified_base (164)..(176): a, c, t, g, unknown or other
  misc_feature (164)..(176): n is a, c, g, or t
tcagagctcacgtacacgaccggtgctcgatttagtgtgagtagtttgggtttgggcggagggaccaaactgaccgtcctaggtcagcccaaggctgccccctggtcactctgttcccaccctcctctacgtgagctctgagcgggctggcaaggcgcattagnnnnnnnnnnnnn

SEQ ID NO: 28135 - DNA, 701 bp, Homo sapiens
  misc_feature: GYAE6OF01B3AI8.47.78.H01.1.454.CMB.1.raw
  modified_base (283)..(283): a, c, t, g, unknown or other
  misc_feature (283)..(283): n is a, c, g, or t
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggtattttcctcggtgcttacttttaaaaggtgtcagtggtggggtgcactgatggagtcgtgggggagcctacaagtaaacgggccggggggtacccttaaactctcctgcgcagcgtctggtatttccttnagtcaagtcgtaggtataagtcgtcgggtcccgccgaggcctaccggaggggagtcggggtccgtaggggtagggttggggttacgggtccggttggtaccgaaaggcgacgaagaaaccgtggtaacgtgggtacggaccgactacgtctaaggaaactacgccgtcgaccgaacccggtaggaaaacgggcaagtactccaactactccaaccgaggagtaattacgtaattaactaaaagttaaatattagtaactaattaacttaacctaaagtaaagtgggtaatacgtaactaaagtaaacgtacggaagtaataggttagttacgtttaattacgttcgtaaccgtaggtaacggtattccgggtcgttacgaccggggtcgggtacgggaagtaacaggttgtgttacgg

SEQ ID NO: 28136 - DNA, 278 bp, Homo sapiens
  misc_feature: GYAE6OF01BP744.47.78.H01.1.454.CMB.1.raw
  modified_base (232)..(235): a, c, t, g, unknown or other
  misc_feature (232)..(235): n is a, c, g, or t
  modified_base (237)..(278): a, c, t, g, unknown or other
  misc_feature (237)..(278): n is a, c, g, or t
tcagagctcacgtacacgaccggtgctcgatttagtgtgagtagtttgggtttgggcgggagggaccaaactgaccgtcctaggcgcagtctgggtctctcacccttgttctggtctggcctcctcagtctgggttcttgtcggaacaggtcagcccaaggctgccccctggtcactcgtgttccccaccctcctctacgtgagctctgagcgggctggcaaggcgcatagnnnngnnnnnnnnnnnnnnnnnnnnnnnnnnnnnnnnnnnnnnnnnn

SEQ ID NO: 28137 - DNA, 561 bp, Homo sapiens
  misc_feature: GYAE6OF01DYI5D.47.78.H01.1.454.CMB.1.raw
  modified_base (527)..(528): a, c, t, g, unknown or other
  misc_feature (527)..(528): n is a, c, g, or t
  modified_base (530)..(561): a, c, t, g, unknown or other
  misc_feature (530)..(561): n is a, c, g, or t
tcagagctcacgtacacgaccggtgctcgatttagtgtgagtagtttggggtttggggacccccgggcagagggtcgtcatctcttgctctggaagcagctccaacatcggaaggaatgatgtgtactggtgcagcaactccccggaacggcccccaaactcctcatctataacgaataatcagcggtcctcgacggggtccctgaccgattctctggctccaagtctggcgcctcacgccaccctggccatcaggtcgggctccgggccgaggatggaggtctgtaattattactggtgttagggtggatcgcacgctagactgcttacgtcgtcggagtcgtacgggaaccaagtccaccgttctaggtaccacgtaccccaaaggccccaaacccctgttcgtacctaccttccgttccgtttacccccacccctttccgtacccgttaacggtcgaagttccctcgtcgggacgggtcccggggtacctacggggacgaaacggggcccgtaataaggtagcnncnnnnnnnnnnnnnnnnnnnnnnnnnnnnnnnn

SEQ ID NO: 28138 - DNA, 824 bp, Homo sapiens
  misc_feature: GYAE6OF01BYXVH.47.78.H01.1.454.CMB.1.raw
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtcgtgggggaggcctcagtaaaggcccggggggtacccttaaactctcctgcgcagcgtctggtacttttccttcagtcaagtctaggataagcgtgggtcccgccgaggcctccgagggacgtcggggccgtgggtaggttggggttcggccggttgtacgaagagcaggaactgagtggtggacgtacagtactagaacgtaccgctcgaccgacccggtagaaaacggcgtaacggactttacccaaccctactaccttacccgaaggtagtaagttacggtaaactttaacgtaaaactttaaaattaacgttacgttaactaaactttaacttaaccttaaaccgtaaaattacgggtaacttaacggtaacccgttaaaggtaaaaccgttacggaaacgggttaaacgttaaccggttaagggttttaccgtttttaaacgtttaaacccgttttacgggtttaacccgtaaccggggtaaacggggttaaacggtttcgggtttaacccggggttttcccgggttacccgggggttaccggggggtaaccccggggtaaacgggggtaaaccccgttaagggtttacccgggtttaacccgtttaacggg

SEQ ID NO: 28139 - DNA, 481 bp, Homo sapiens
  misc_feature: GYAE6OF01C8T52.47.78.H01.1.454.CMB.1.raw
  modified_base (396)..(396): a, c, t, g, unknown or other
  misc_feature (396)..(396): n is a, c, g, or t
  modified_base (462)..(462): a, c, t, g, unknown or other
  misc_feature (462)..(462): n is a, c, g, or t
  modified_base (464)..(481): a, c, t, g, unknown or other
  misc_feature (464)..(481): n is a, c, g, or t
tcagagctcacgtacacgaccggtgctcgatttagtgtgagtagtttgggtttggggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcacgcctcctgccatcagtcgggctccggtccgagatgaggctgtattatttatgtgacaacagtggatagtagcctgagtagtgtgggtttcggcggagggaccaaacgtcgaccgtctaggtcacgcccaaggcctcgccccgtcgtcactctcgttacccncccctcctcgtacgtcgacgtcctcgtcggacggccgggtcgtcggacgagggccgacgagtacgngnnnnnnnnnnnnnnnnnn

SEQ ID NO: 28140 - DNA, 172 bp, Homo sapiens
  misc_feature: GYAE6OF01BIV7E.47.78.H01.1.454.CMB.1.raw
  modified_base (165)..(172): a, c, t, g, unknown or other
  misc_feature (165)..(172): n is a, c, g, or t
tcagagctcacgtacacgaccggtgctcgatttagtgtgagtagtttgggtttgggcggagggaccaaactgaccgtcctaggtcagcccaaggctgccccctggtcactctgttccccgccctcctctacgtgagctctgagcggggctggcaaggcgcatagnnnnnnnn

SEQ ID NO: 28141 - DNA, 174 bp, Homo sapiens
  misc_feature: GYAE6OF01EKN9V.47.78.H01.1.454.CMB.1.raw
  modified_base (163)..(174): a, c, t, g, unknown or other
  misc_feature (163)..(174): n is a, c, g, or t
tcagagctcacgtacacgaccggtgctcgatttagtgtgagtagtttgggtttgggcggagggaccaaactgaccgtcctaggtcagcccaaggctgccccctggtcactctgttcccaccctcctctacgtgagctctgagcgggctggcaaggcgcatagnnnnnnnnnnnn

SEQ ID NO: 28142 - DNA, 575 bp, Homo sapiens
  misc_feature: GYAE6OF01CLGXB.47.78.H01.1.454.CMB.1.raw
  modified_base (216)..(216): a, c, t, g, unknown or other
  misc_feature (216)..(216): n is a, c, g, or t
  modified_base (295)..(295): a, c, t, g, unknown or other
  misc_feature (295)..(295): n is a, c, g, or t
  modified_base (362)..(362): a, c, t, g, unknown or other
  misc_feature (362)..(362): n is a, c, g, or t
  modified_base (429)..(429): a, c, t, g, unknown or other
  misc_feature (429)..(429): n is a, c, g, or t
  modified_base (544)..(549): a, c, t, g, unknown or other
  misc_feature (544)..(549): n is a, c, g, or t
  modified_base (551)..(575): a, c, t, g, unknown or other
  misc_feature (551)..(575): n is a, c, g, or t
tcagagctcacgtacacgaccggtgctcgatttagtgtgagtagtttgggtttggggacccccgggcagagggtcgtcatctcttgctctggaagcagctccaacatcggaaggaatgatgtgtactggttgcagcaacctcccccggaaccggacccccaaactccctcatctataacgaataatcagccgtcctcgacggggtccctgaccgtnttcctcgtggcctaccaagtcgtcggccgtccctcacgccccacccgtggcccatcgaggtcgggcctccggccgaggntgaggctgtaattattacgtgtggtagggttggatccgcacgccgtagctgtccttacgtcgttggngtcgtcgggaactagggtcccacccgttacgtacggtcaccgtacccgaaaggaccccctaaccctntcgtaccctaccgttccttacccgttccccccgcccttacccgtaccgttacgtcggacgtccttcgacgggccgggtcgggtcgtcgggaaccgaacggccgtactagtcgagnnnnnncnnnnnnnnnnnnnnnnnnnnnnnnn

SEQ ID NO: 28143 - DNA, 233 bp, Homo sapiens
  misc_feature: GYAE6OF01AXQ7J.47.78.H01.1.454.CMB.1.raw
  modified_base (230)..(233): a, c, t, g, unknown or other
  misc_feature (230)..(233): n is a, c, g, or t
tcagagctcacgtacacgaccggtgctcgatttagtgtgagtagtttgggtttgggcggagggaccaaactgaccgtcctaggcgcagtctgggtctctcacccttgttctggtctggcctcctcagtctgggttcttgtcggaacaggtcagcccaaggctgccccctggtcactctgttccccgccctcctctacgtgagctctgagcgggctggcaaggcgcatagnnnn

SEQ ID NO: 28144 - DNA, 1061 bp, Homo sapiens
  misc_feature: GYAE6OF01DJ696.47.78.H01.1.454.CMB.1.raw
tcagagctcacgtacacgaccggtgctcgatttagtgtgagtagtttgggtttgggggggagaggagccccagccttgggattcccaagttgttttcattcagtgatcaggactgaacacagaggactcaccagtggtaggtttgggctggagtcgtggtattttccgtcggttgtcttacgttttaaaaggtgttcgagttggtgggtgcacctgagtggagtcggtaggggacgcctacgtaagtaaccggggtcccgggggttacccttaaacgtccgtaccgtcgccggacgtacggtcgttcggttacggttacttttccgtttacgacgttacgtaagttacgtaggtaacgtaggtcggtcgggtacccgaccgacggtaccgtaccgggaaggggtcgtccggggtccggtagggtacgggtttcgggggttaccgtccggttacggtaacgaaggaccgtacgtaaacggtagttaggtacgttacgggtacgtaaccgtaacgttaacggttacggttaacgtaaaacggtacccggtccgttaaaccgggacccgttaaacccgggggtaaaacgggaaaacccgggtaacgttaaaccggttaaacctttaccccgaaaacccgtttaccggtttaaccctaaccgggaaagggtaaccgttaagggtttaaaacctttaaacgtttaaaaaccggttaaaaatttttaaaacgtttaccgggttaacgttaaaccgtttaaattaacccgttaaaacgttaaacggttaaaaggttaccggttaaaacgttaccgggttaaaccgtaaaaggtttaaaccgggtaaacgggttacgttttaaacggtaaccggttttaagggttttaaacccgttttacgttttaaccgggttccgttaaaaccggaacgggttaaacggggtttaccggttaccgggtttacccgggttacgggtttttaaccccgggggacggggggttaaaacccggtaaccggggtttaaaacccggtacgggggtttttaaccggtaacccctttttaacggg

SEQ ID NO: 28145 - DNA, 598 bp, Homo sapiens
  misc_feature: GYAE6OF01A3BM3.47.78.H01.1.454.CMB.1.raw
tcagagctcacgtacacgaccggtgctcgatttagtgtgagtagtttggggtttgggggggggaagctcagcttcagctgtggtagagaagacaggattcaggacaatctccagcatggccggcttccctctcctcctcaccctcctcactcactgtgcagggtcttgggcccagtctgtgctgactcagcccaccctcagcgtcgtcggggaccccccgggcaggacggtcaccatcctcttgttctggaagcagctacaatatcggaaatgataatgtatactggtacagcaacgtcccacgaaccggccccccaaactccctacatctaataaccaatgatcgagcggcccctcgacgggtccctggcccgtattcgtctcggcctaccaagttccgtaggccgccctcgacgcccacccgtggccagtcgaggttcgggcctcccgggacccgaggactggagctgtaatttcttacgtgttaggtagggttggatcgcgaggtcctgtactggtcttaccggtcgttacgggacgtcggtcgggacccaaggtcctacccggtcgtacggtccacgcccgaacggtacccccc

SEQ ID NO: 28146 - DNA, 318 bp, Homo sapiens
  misc_feature: GYAE6OF01C44KU.47.78.H01.1.454.CMB.1.raw
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
  modified_base (293)..(318): a, c, t, g, unknown or other
  misc_feature (293)..(318): n is a, c, g, or t
tcagagctcacgtacacgaccggtgctcgatttagtgtgagtagtttgggtttgggcagttttctctgaatcaaaaaccccgagaccgccgcggacagcctcggcccctggggcccagaaaccctggtcaccgtctcctcagcttccaccaaggcccatcggtcttcccctggccgccctgcctcgaggacgcacctgnggggcacgaggccggccgtgggctgccgtggtacaaggactacttctatgttatactgtaggaggtccggcgtggacgaagggccganagtagnnnnnnnnnnnnnnnnnnnnnnnnnn

SEQ ID NO: 28147 - DNA, 165 bp, Homo sapiens
  misc_feature: GYAE6OF01AZ8UZ.47.78.H01.1.454.CMB.1.raw
  modified_base (164)..(165): a, c, t, g, unknown or other
  misc_feature (164)..(165): n is a, c, g, or t
tcagagctcacgtacacgaccggtgctcgatttagtgtgagtagtttgggtttgggcggagggaccaaactgaccgtcctaggtcagcccaaggctgccccctcggtcactctgttcccaccctcctctacgtgagctctgagcgggctggcaaggcgcatagnn

SEQ ID NO: 28148 - DNA, 240 bp, Homo sapiens
  misc_feature: GYAE6OF01D890C.47.78.H01.1.454.CMB.1.raw
  modified_base (234)..(240): a, c, t, g, unknown or other
  misc_feature (234)..(240): n is a, c, g, or t
tcagagctcacgtacacgaccggtgctcgatttagtgtgagtagtttgggtttgggcggagggaccaaactgaccgtcctaggcgcagtctgggtctctcacccttgttctggtctggcctcctcagtctgggttcttgtcggaacaggtcagcccaaggctcgccccctcggtcactctgttccccgccctcctctacgtgagctctgaggcgggctgggcaaggcgcatagnnnnnnn

SEQ ID NO: 28149 - DNA, 272 bp, Homo sapiens
  misc_feature: GYAE6OF01B28C7.47.78.H01.1.454.CMB.1.raw
  modified_base (261)..(272): a, c, t, g, unknown or other
  misc_feature (261)..(272): n is a, c, g, or t
tcagagctcacgtacacgaccggtgctcgatttagtgtgagtagtttgggtttgggggtgatcactactactactactacatggacgtctggggcaaagggaccacggtcaccgtctcctcagcttccaccaagggcccatcggtcttccccctggcgccctgctccaggagcacctcgtgggggcacagcggccctgggctgcctggtcaaggactacttccgtacgtgagctctgagcgggctggacaaggcgcatagnnnnnnnnnnnn

SEQ ID NO: 28150 - DNA, 174 bp, Homo sapiens
  misc_feature: GYAE6OF01AF8HJ.47.78.H01.1.454.CMB.1.raw
  modified_base (174)..(174): a, c, t, g, unknown or other
  misc_feature (174)..(174): n is a, c, g, or t
tcagagctcacgtacacgaccggtgctcgatttagtgtgagtagtttgggtttgggggaagaggaagactgacggtccccccaggagttcaggtgctgggcacagcggccctgggctgcctggtcaaggactacttcctacgtgagctctgagcgggctggcaaggcgcatagn

SEQ ID NO: 28151 - DNA, 301 bp, Homo sapiens
  misc_feature: GYAE6OF01C4NC3.47.78.H01.1.454.CMB.1.raw
  modified_base (279)..(301): a, c, t, g, unknown or other
  misc_feature (279)..(301): n is a, c, g, or t
tcagagctcacgtacacgaccggtgctcgatttagtgtgagtagtttgggtttgggcagttttctctgaatcaaaaccccgagaccgccgcggacagcctcggcccctggggcccagaaaccctggtcaccgtctcctcagcttccaccaagggcccatcggtcttcccctggcgccctgctccaggagcacctcgtgggggcacagccggccctgggctgcctggtcaaggactacttcctacgtgagctctgacggcgggctggcaaggcgcatagnnnnnnnnnnnnnnnnnnnnnnn

SEQ ID NO: 28152 - DNA, 743 bp, Homo sapiens
  misc_feature: GYAE6OF01B60FG.47.78.H01.1.454.CMB.1.raw
tcagagctcacgtacacgaccggtgctcgatttagtgtgagtagtttgggtttgggggggagaggagccccagccttgggattcccaagtgttttcattcagtgatcaggactgaacacagagactcaccatggagtttgggctgagctggattttcctcggtgcttcttttaaaaggtgtccagtgtgggtgcactgatggagtcgtggggaggcctcgaagtaaacggccggggggttaccccttaaactcctccgtgccgcgagcgtcgtggtactttccttcagtcaagtctgataagcgtacgggtccgaccgaggtcctccgagggtagtcgggccgtgggtaggttcggggttcggtccggtggtaccgaaagacggacgaacgtaacgtagtagtgggtacgacgactagtctagaacgtacgcgtacgccgaacccggtaggaaaacggcaagtacttaccaccgtactacctaccgaaggtacgagttagtacttaaactaaaattaaattatacgttaactaagttaacttaactaaacgtaaagtaggtaactacgtaaccgtaaagtaaaacgttacggtaaagtaacgtttaacggtacggtttttaagtttacgtttaaccgtttacgttaacccgttaacggtaagggtaacgttccggttaccggtttccggtacgggtaccggggtacggtaacggtaacggtaaggttcggttacgtttaacgg

SEQ ID NO: 28153 - DNA, 400 bp, Homo sapiens
  misc_feature: GYAE6OF01DJ1OL.47.78.H01.1.454.CMB.1.raw
  modified_base (338)..(338): a, c, t, g, unknown or other
  misc_feature (338)..(338): n is a, c, g, or t
  modified_base (340)..(400): a, c, t, g, unknown or other
  misc_feature (340)..(400): n is a, c, g, or t
tcagagctcacgtacacgaccggtgctcgatttagtgtgagtagtttgggtttgggcagttttctctgaatcaaaaaccccgagaccgccgcggacagccctccggcccctggggcccaagaaacccctggtccaccgtctcctcagccttccaccaacgggcccatccggttccttccccctggccgccctgcctccgaggacgccaccgtcggtgggggccacgacggccggcccgtgggcctcgcccgtaggtacaacggtaccttaccttcccgtagtcgacgtccttcgtagggacggccgggtcgtagggaccaaacgggcgtcaagtaggnannnnnnnnnnnnnnnnnnnnnnnnnnnnnnnnnnnnnnnnnnnnnnnnnnnnnnnnnnnnn

SEQ ID NO: 28154 - DNA, 233 bp, Homo sapiens
  misc_feature: GYAE6OF01C1MJR.47.78.H01.1.454.CMB.1.raw
  modified_base (175)..(175): a, c, t, g, unknown or other
  misc_feature (175)..(175): n is a, c, g, or t
  modified_base (182)..(183): a, c, t, g, unknown or other
  misc_feature (182)..(183): n is a, c, g, or t
  modified_base (185)..(233): a, c, t, g, unknown or other
  misc_feature (185)..(233): n is a, c, g, or t
tcagagctcacgtacacgaccggtgctcgatttagtgtgagtagtttgggtttggggcgggacgggaacccaaactcgacccgttccgtaggtcacgcccaaggcctgccccctcggtcactctgttccccacctcctcgtacgtgagtcttctggagcgggctgggacaaggcncatacgnngnnnnnnnnnnnnnnnnnnnnnnnnnnnnnnnnnnnnnnnnnnnnnnnnn

SEQ ID NO: 28155 - DNA, 671 bp, Homo sapiens
  misc_feature: GYAE6OF01D8AFX.47.78.H01.1.454.CMB.1.raw
  modified_base (516)..(516): a, c, t, g, unknown or other
  misc_feature (516)..(516): n is a, c, g, or t
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggtattttcctcggtgcttcttttaaaaggtgtccagtgtggggtgcacctgagtggagtcgtgggggagcctcgaagtaaacgggccggggggtacccttaaactcctcctgcgcagcgtctggtacttttcctttcagtactaagttcgtaggtaataacgtcgtcgggtcccgcgacggcctccgagggtacgtcggggaccgtggggtaggttcgggggttcgggcccggttggtaccgaaggagacgaaggaaactggaacgtggtgaccggactactcgtagtaacgtacgtctcgaccgtaccggtagaaacggcacgtactcacactctaccgaagagattactataactaaataatntagtactagtatactaataacgtagtataccgagtaacgaacgtacgaagttacttaacgtaggtttgtttaacttacgttacgtaacgaacggtagggtagttccggtcgttcgtacgggtcgggacggtacggaacgttaggtggtattaccg

SEQ ID NO: 28156 - DNA, 748 bp, Homo sapiens
  misc_feature: GYAE6OF01CD2XD.47.78.H01.1.454.CMB.1.raw
  modified_base (179)..(179): a, c, t, g, unknown or other
  misc_feature (179)..(179): n is a, c, g, or t
  modified_base (209)..(209): a, c, t, g, unknown or other
  misc_feature (209)..(209): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
  modified_base (419)..(419): a, c, t, g, unknown or other
  misc_feature (419)..(419): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
tcagagctcacgtacacgaccggtgctcgatttagtgtgagtagtttgggtttggggagagaagacaggattcaggacaatctccagcatggccggcttccctctcctcctcaccctctcactcactgtcgcgaggtcgtcgggccctacgtctgtggtagacctcacgccacccgttnacgtcgttccgtaccggggaccccccgggnaacggtaggggttcctacgacttcctcgttacgctacgtggaacncgactcctaccgaaacngtaacgggaagtagtgtagtgtacggttagtggtacgctacgaccaaccggtccccggaacccgacccccaagttcccactatactaacgtaacgtaaatacgtcgacgccggttaccgcggtccgggtactcgaacttcttcgtccngtaccctacgtagtctaccgaccctntaacccnccgttcccgtaccgcgtaaccctgtcggcgggttaccgtcccggtaccggtagggtaacgcggtagggtacgtacttaggttcttaaagttcttagacgtaacgtaaggttcggagggttataaccgggttgacggttagtaggttcgttgggtttaccgggtcggaacgggttacgtaaacccgttgtaccggaacgttaccgacggtaccgaaccggtaaccgtccggtcgacccccgtccggttacctacacccgttccgtcccccttaaccgtcccttaccgtacccggtcg

SEQ ID NO: 28157 - DNA, 684 bp, Homo sapiens
  misc_feature: GYAE6OF01DNDPM.47.78.H01.1.454.CMB.1.raw
  modified_base (636)..(636): a, c, t, g, unknown or other
  misc_feature (636)..(636): n is a, c, g, or t
  modified_base (640)..(641): a, c, t, g, unknown or other
  misc_feature (640)..(641): n is a, c, g, or t
  modified_base (646)..(646): a, c, t, g, unknown or other
  misc_feature (646)..(646): n is a, c, g, or t
  modified_base (654)..(655): a, c, t, g, unknown or other
  misc_feature (654)..(655): n is a, c, g, or t
  modified_base (658)..(658): a, c, t, g, unknown or other
  misc_feature (658)..(658): n is a, c, g, or t
  modified_base (660)..(661): a, c, t, g, unknown or other
  misc_feature (660)..(661): n is a, c, g, or t
  modified_base (663)..(663): a, c, t, g, unknown or other
  misc_feature (663)..(663): n is a, c, g, or t
  modified_base (668)..(668): a, c, t, g, unknown or other
  misc_feature (668)..(668): n is a, c, g, or t
  modified_base (670)..(670): a, c, t, g, unknown or other
  misc_feature (670)..(670): n is a, c, g, or t
  modified_base (672)..(676): a, c, t, g, unknown or other
  misc_feature (672)..(676): n is a, c, g, or t
  modified_base (678)..(684): a, c, t, g, unknown or other
  misc_feature (678)..(684): n is a, c, g, or t
tcagagctcacgtacacgaccggtgctcgatttagtgtgagtagtttgggtttggggacccccgggcagagggtcgtcatctcttgctctggaagcagctccaacatcggaaggaatgatgtgtactggtgcagcaactccccggaacgccccaaactcctcatctaataacaatgatcagccggccctgacgggggtccctgggtccgtacttcctcgtcggtccttaccgaagttcctggccgtacctcgaacgtccctaccccgtggccctaagtcggtaagggtccggggtcccttacccggggcccggaagggtactacgggtacggtaccttaggttaaacttttacgttacgttaggggttacggttaaggggttgggaactcggacgtacggcccgtaggacttcgtaccgtttacggttcgtaacgggctacggtacggaaccgtaacggtcctaccggttacctaggacccaaacgtacccgaaaccggacccctaaaccctcgttcgtcccgtaactttccccgttaccggttacccccccgtttaaccttcgtaacggtccgacgttccgtcggtaacggcggttccggtaccgtagaacccgaggcccggaatttaaacccgngctnncgacnagtcatcnngcncnncntcgangngnnnnncnnnnnnn

SEQ ID NO: 28158 - DNA, 188 bp, Homo sapiens
  misc_feature: GYAE6OF01ENNDG.47.78.H01.1.454.CMB.1.raw
  modified_base (176)..(188): a, c, t, g, unknown or other
  misc_feature (176)..(188): n is a, c, g, or t
tcagagctcacgtacacgaccggtgctcgatttagtgtgagtagtttgggtttgggggaagaggaagactgaccggtcccccaggagttcaggtgctgggcacagcggccctgggctgcctggtcaaggactacttcctacgtgagctctgagcggggctggcaaggcgcaatagnnnnnnnnnnnnn

SEQ ID NO: 28159 - DNA, 709 bp, Homo sapiens
  misc_feature: GYAE6OF01BJ0HL.47.78.H01.1.454.CMB.1.raw
  modified_base (495)..(495): a, c, t, g, unknown or other
  misc_feature (495)..(495): n is a, c, g, or t
tcagagctcacgtacacgaccggtgctcgatttagtgtgagtagtttgggtttgggggggagaggagccccagcccttgggattcccaagtgttttcattcagtgatcaggactgaacacagaggactcaccatggagtttgggctgagctggattttcctcggtgcttctttaaaaggtgtccagtgtggggtgcacctgatgggagtcgtgggggacggcctcagtaaacgggcccgggggggttaccccttaaaacgtcctcctgccgtcagcgtcgtcggtattttccttctagtcaagtctaggataacgcgtcgggtaccgccgagtcctccggagggagtcggggccgtagggtggttggggttcggccgtggtaccaaggacgacgagaacgtgagtggtcgacaatcgtacgtagaacgtaccgcgtcgacccgtacccggtaagaaccggtactacgtacttaccactatccgtaccagtaagtntagtacttaacaaagttaatatacgtactatacttaacctaagtaatacggtacgtaacgtacgtaaaggaaacgtacggtaagttaacgttaactacgggtttaagtttaccgttacgtaccggttaccgaaaggacggggttaagttaccggttcccggttggtcccgggacgggggtaccgaacgggtaacgtagggtcgtacggtttcgg

SEQ ID NO: 28160 - DNA, 184 bp, Homo sapiens
  misc_feature: GYAE6OF01AYWVX.47.78.H01.1.454.CMB.1.raw
  modified_base (175)..(184): a, c, t, g, unknown or other
  misc_feature (175)..(184): n is a, c, g, or t
tcagagctcacgtacacgaccggtgctcgatttagtgtgagtagtttgggtttgggggaagaggaagactgaccggtccccccaggagttcaggtgctgggcacagcggccctgggctgcctggtcaaggactacttcctacgtgagctctgagcgggctggcaaggcgcatagnnnnnnnnnn

SEQ ID NO: 28161 - DNA, 819 bp, Homo sapiens
  misc_feature: GYAE6OF01C9VK4.47.78.H01.1.454.CMB.1.raw
  modified_base (204)..(204): a, c, t, g, unknown or other
  misc_feature (204)..(204): n is a, c, g, or t
  modified_base (770)..(770): a, c, t, g, unknown or other
  misc_feature (770)..(770): n is a, c, g, or t
tcagagctcacgtacacgaccggtgctcgatttagtgtgagtagtttggggtttgggggggagaggagccccagccttgggattcccaagtgttttcattcagtgatcaggactgaacacagagacctcaccatggtagtttgggctgagctggtattttcctcggtgtcttacgttttaaaaggtgtcctagtggtggggtcncacctgagtgggagtcggtgggggacgcctacgaacggtaaccggggtcccggggggttaacccttaaacctccgtccgtgaccgcagctactcgttaggttacttttccttacgaagtactacgtcgtaggaattacgtccggtcggtacccgcgacggtccgtacggaggggtacgtcgggccgtgggtacggttcggggtcggtacccggtgtacgaaggacgtacgaagtaacgtacggagttacgggacggtacgaactacgtacgtaacgtaacgtacgcgtaccggacccgtaaccggggtagaaacggtacgtaacggtaccttacctaaccgtacttacccgtaacgaagtacggtaaatttcgtaaactaaagtaaacttaagttacgtacgttaatacttaacgtaactaaacgtaagttacggtaaagttaccctaacgtaaagtaacgtacggtaaacgttaagttaccgggttaagttttaaccgtttacgtaccgttaccggttaacgaaccgggttaaggttaccgttacgggttccggtttacccgggngggtaaaccgggggtaccgtagggtaaacgtacggttccgtttaaacgg

SEQ ID NO: 28162 - DNA, 618 bp, Homo sapiens
  misc_feature: GYAE6OF01A7MAI.47.78.H01.1.454.CMB.1.raw
  modified_base (433)..(433): a, c, t, g, unknown or other
  misc_feature (433)..(433): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
  modified_base (455)..(455): a, c, t, g, unknown or other
  misc_feature (455)..(455): n is a, c, g, or t
  modified_base (468)..(468): a, c, t, g, unknown or other
  misc_feature (468)..(468): n is a, c, g, or t
  modified_base (474)..(474): a, c, t, g, unknown or other
  misc_feature (474)..(474): n is a, c, g, or t
  modified_base (496)..(496): a, c, t, g, unknown or other
  misc_feature (496)..(496): n is a, c, g, or t
  modified_base (611)..(611): a, c, t, g, unknown or other
  misc_feature (611)..(611): n is a, c, g, or t
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtcgtgggggagcctcataaacggccggggggtaccccttaaactcctcctgcgcagcgtcgtggtactttccttcagtacaagtctggaataagcgtagggtcccgcgacgcgtaccgagggatcgggccgtggaggttggggttcggccgtggtacaaggagcgaagtaacgtgagtgggtcgacgactagtctaagaactcgctacgccaaccggtagaaacggnagtctacactctcnccagnatntaatacaataatntcgtanacttatacctaactaatgtaanacgtaccgttaagaaactcgtaagtactaacggtagtttaattattaacgttctaaccgagtaggtacgttggtacccggttgtccgggtacgggtcggaacgggatagcggttntaaccgg

SEQ ID NO: 28163 - DNA, 723 bp, Homo sapiens
  misc_feature: GYAE6OF01AL76J.47.78.H01.1.454.CMB.1.raw
  modified_base (294)..(294): a, c, t, g, unknown or other
  misc_feature (294)..(294): n is a, c, g, or t
  modified_base (635)..(635): a, c, t, g, unknown or other
  misc_feature (635)..(635): n is a, c, g, or t
  modified_base (639)..(639): a, c, t, g, unknown or other
  misc_feature (639)..(639): n is a, c, g, or t
  modified_base (686)..(686): a, c, t, g, unknown or other
  misc_feature (686)..(686): n is a, c, g, or t
  modified_base (713)..(714): a, c, t, g, unknown or other
  misc_feature (713)..(714): n is a, c, g, or t
tcagagctcacgtacacgaccggtgctcgatttagtgtgagtagtttgggttttggggtacccccggggccgagagggtcggtcatctcttgctctggaagcagctccaacatcggaaggaatgatgtgtactggttgcagcaactcccggaacggccccaaactcctcatctatacgaataatcagcggtcctcgacggggtcctgaccgtattctctcggctccaagtctagacctacctcacgcccttccgtagccatcgagtcgggccgttccgggtccgaggagtcggnggtactgtactttagttattggtcgacaactaggtggtactcggtagtccgtagtagtaggttcggtttacggggttttcgggacgggacgggtaaaaccctaaggtacccggtaccgttccggttaccgggaacgtaccgggtaaccccaagggtcccttcccgggtacccccgttccgggttaccctaccgtttcccggtacccggtttttcccccccgcccctttacccgtttacccggtaccggtttacgcggttcccggtttacggtccgggtaaccggggtccgggtacccggtcgggtaaccgtaacggggacccgttcggaaaggttcggacncgtntcgacgtcgagcgcgtacgcgtgcgtcgacgtcgtcgtcgtcgtcgngtcgtcgtgtctcgcgctcgtacgtanncgcgtgtcg

SEQ ID NO: 28164 - DNA, 156 bp, Homo sapiens
  misc_feature: GYAE6OF02FZWXD.47.78.H01.1.454.CMB.1.raw
  modified_base (128)..(156): a, c, t, g, unknown or other
  misc_feature (128)..(156): n is a, c, g, or t
tcagagctcacgtacacgaccggtgctcgatttagtgtgagtagttggttgggcacagcggccctgggctgcctggtcaaggactacttcctacgtgagatctgagcgggctggctaaggcgcatagnnnnnnnnnnnnnnnnnnnnnnnnnnnnn

SEQ ID NO: 28165 - DNA, 123 bp, Homo sapiens
  misc_feature: GYAE6OF02HGFNR.47.78.H01.1.454.CMB.1.raw
  modified_base (123)..(123): a, c, t, g, unknown or other
  misc_feature (123)..(123): n is a, c, g, or t
tcagagctcacgtacacgaccggtgctcgatttagtgtgagtagttggttggcacagcggcctggctgcctggtcaaggactacttcctacgtgagctctgagcggctggcaaggcgcatagn

SEQ ID NO: 28166 - DNA, 126 bp, Homo sapiens
  misc_feature: GYAE6OF02FRNB4.47.78.H01.1.454.CMB.1.raw
  modified_base (126)..(126): a, c, t, g, unknown or other
  misc_feature (126)..(126): n is a, c, g, or t
tcagagctcacgtacacgaccggtgctcgatttagtgtgagtagttggttggcacagcggccctgggctgcctggtcaaggactacttcctatgtatactctgagcgggctggcaaggcgcatagn

SEQ ID NO: 28167 - DNA, 127 bp, Homo sapiens
  misc_feature: GYAE6OF02I81PD.47.78.H01.1.454.CMB.1.raw
tcagagctcacgtacacgaccggtgctcgatttagtgtgagtagtttgggttgggcacagcggccctgggctgcctggtcaaggactacttcctagtgagctctgagcgggctggcaaggcgcatag

SEQ ID NO: 28168 - DNA, 173 bp, Homo sapiens; identical to SEQ ID NO: 28060
  misc_feature: GYAE6OF02III93.47.78.H01.1.454.CMB.1.raw
  modified_base (173)..(173): a, c, t, g, unknown or other
  misc_feature (173)..(173): n is a, c, g, or t

SEQ ID NO: 28169 - DNA, 163 bp, Homo sapiens; identical to SEQ ID NO: 28079
  misc_feature: GYAE6OF02IDV11.47.78.H01.1.454.CMB.1.raw
  modified_base (163)..(163): a, c, t, g, unknown or other
  misc_feature (163)..(163): n is a, c, g, or t

SEQ ID NO: 28170 - DNA, 216 bp, Homo sapiens
  misc_feature: GYAE6OF02F5QGZ.47.78.H01.1.454.CMB.1.raw
  modified_base (165)..(166): a, c, t, g, unknown or other
  misc_feature (165)..(166): n is a, c, g, or t
  modified_base (168)..(168): a, c, t, g, unknown or other
  misc_feature (168)..(168): n is a, c, g, or t
  modified_base (170)..(216): a, c, t, g, unknown or other
  misc_feature (170)..(216): n is a, c, g, or t
tcagagctcacgtacacgaccggtgctcgatttagtgtgagtagtttgggtttgggcggagggaccaaactgaccgtcctcggtcagcccaaggtctgccccctggtcactctgttcccgcccttcctctacgtgagctctgagcgggctggcaaggcgcatagnntngnnnnnnnnnnnnnnnnnnnnnnnnnnnnnnnnnnnnnnnnnnnnnnn

SEQ ID NO: 28171 - DNA, 163 bp, Homo sapiens; identical to SEQ ID NO: 28073
  misc_feature: GYAE6OF02FO6B0.47.78.H01.1.454.CMB.1.raw
  modified_base (163)..(163): a, c, t, g, unknown or other
  misc_feature (163)..(163): n is a, c, g, or t

SEQ ID NO: 28172 - DNA, 131 bp, Homo sapiens; identical to SEQ ID NO: 28080
  misc_feature: GYAE6OF02HJYNB.47.78.H01.1.454.CMB.1.raw
  modified_base (130)..(131): a, c, t, g, unknown or other
  misc_feature (130)..(131): n is a, c, g, or t

SEQ ID NO: 28173 - DNA, 181 bp, Homo sapiens
  misc_feature: GYAE6OF02IH1HF.47.78.H01.1.454.CMB.1.raw
  modified_base (164)..(181): a, c, t, g, unknown or other
  misc_feature (164)..(181): n is a, c, g, or t
tcagagctcacgtacacgaccggtgctcgatttagtgtgagtagtttgggtttggggcggagggaccaaactgaccgtcctaggtcagcccaaggctgccccctggtcactctgttcccaccctcctctacgtgagctctgagcgggctggcaaggcgcatagnnnnnnnnnnnnnnnnnn

SEQ ID NO: 28174 - DNA, 289 bp, Homo sapiens
  misc_feature: GYAE6OF02HY7WX.47.78.H01.1.454.CMB.1.raw
  modified_base (261)..(289): a, c, t, g, unknown or other
  misc_feature (261)..(289): n is a, c, g, or t
tcagagctcacgtacacgaccggtgctcgatttagtgtgagtagtttgggtttgggggtaggagtcactactactactaactacagtggacgtctgggcaaagggaccacggtcaccgtctcctcacgcttccaccaaggcccatcggtcttcccctggcgccctgctccaggagcacctctgggggcacagcggccctgggctgcctggtcaaggactacttcctacgtgagctctgagcgggctggcaaggcgcatagnnnnnnnnnnnnnnnnnnnnnnnnnnnnn

SEQ ID NO: 28175 - DNA, 169 bp, Homo sapiens
  misc_feature: GYAE6OF02GG9N3.47.78.H01.1.454.CMB.1.raw
  modified_base (163)..(169): a, c, t, g, unknown or other
  misc_feature (163)..(169): n is a, c, g, or t
tcagagctcacgtacacgaccggtgctcgatttagtgtgagtagtttgggtttgggcggagggaccaaactgaccgtcctaggtcagcccaaggctgcccctcggtcactctgttcccaccctcctctacgtgagctctgagcgggctggcaaggcgcatagnnnnnnn

SEQ ID NO: 28176 - DNA, 463 bp, Homo sapiens
  misc_feature: GYAE6OF02FZTFY.47.78.H01.1.454.CMB.1.raw
  modified_base (227)..(227): a, c, t, g, unknown or other
  misc_feature (227)..(227): n is a, c, g, or t
  modified_base (429)..(463): a, c, t, g, unknown or other
  misc_feature (429)..(463): n is a, c, g, or t
tcagagctcacgtacacgaccggtgctcgatttagtgtgagtagtttgggtttggggaccccgggcagagggtcgtcatctcttgctctggaagcagctccaacatcggaaggatgatgtgtactggttgcagcaactccccggaacggcccccaaactcctcatctatacgaataatcagcggtcctcaggggtccctgaccgattctctggctccaagtctggcncctcagccaccctggccatcagtgggctccggcccgaggatgaggctggattattactgtgtaggttgggatcgcagcctgactgcttacgcttcggagctgggaccaaaggtcaccgtcctaggtcagccaaggccaacccatgtcactctgttcccgcctcctctacgtgacgctctgagcggctggcaaggcgcatagnnnnnnnnnnnnnnnnnnnnnnnnnnnnnnnnnnn

SEQ ID NO: 28177 - DNA, 130 bp, Homo sapiens
  misc_feature: GYAE6OF02GSC5J.47.78.H01.1.454.CMB.1.raw
  modified_base (130)..(130): a, c, t, g, unknown or other
  misc_feature (130)..(130): n is a, c, g, or t
tcagagctcacgtacacgaccggtgctcgatttagtgtgagtagtttgggtttggacacagcggccctgggctgcctggtcaaggactacttcctacgtgagctctgagcgggctggcaaggcgcatagn

SEQ ID NO: 28178 - DNA, 173 bp, Homo sapiens; identical to SEQ ID NO: 28060
  misc_feature: GYAE6OF02H7JJ9.47.78.H01.1.454.CMB.1.raw
  modified_base (173)..(173): a, c, t, g, unknown or other
  misc_feature (173)..(173): n is a, c, g, or t

SEQ ID NO: 28179 - DNA, 131 bp, Homo sapiens; identical to SEQ ID NO: 28080
  misc_feature: GYAE6OF02HUOCM.47.78.H01.1.454.CMB.1.raw
  modified_base (130)..(131): a, c, t, g, unknown or other
  misc_feature (130)..(131): n is a, c, g, or t

SEQ ID NO: 28180 - DNA, 164 bp, Homo sapiens; identical to SEQ ID NO: 28046
  misc_feature: GYAE6OF02G4YUP.47.78.H01.1.454.CMB.1.raw
  modified_base (163)..(164): a, c, t, g, unknown or other
  misc_feature (163)..(164): n is a, c, g, or t

SEQ ID NO: 28181 - DNA, 173 bp, Homo sapiens
  misc_feature: GYAE6OF02FUK1C.47.78.H01.1.454.CMB.1.raw
  modified_base (132)..(133): a, c, t, g, unknown or other
  misc_feature (132)..(133): n is a, c, g, or t
  modified_base (135)..(173): a, c, t, g, unknown or other
  misc_feature (135)..(173): n is a, c, g, or t
tcagagctcacgtacacgaccggtgctcgatttagtgtgagtagtttgggtttgggcacagcggccctggctgcctggtcaaggacctacttcctacgtgagctctgagcgggctggcaagggccgcatagnntnnnnnnnnnnnnnnnnnnnnnnnnnnnnnnnnnnnnnnn

SEQ ID NO: 28182 - DNA, 163 bp, Homo sapiens; identical to SEQ ID NO: 28079
  misc_feature: GYAE6OF02GHISW.47.78.H01.1.454.CMB.1.raw
  modified_base (163)..(163): a, c, t, g, unknown or other
  misc_feature (163)..(163): n is a, c, g, or t

SEQ ID NO: 28183 - DNA, 259 bp, Homo sapiens
  misc_feature: GYAE6OF02FI6QF.47.78.H01.1.454.CMB.1.raw
  modified_base (257)..(259): a, c, t, g, unknown or other
  misc_feature (257)..(259): n is a, c, g, or t
tcagagctcacgtacacgaccggtgctcgatttagtgtgagtagtttgggtttggggtgatcactactactactactacatggacgtctggggcaaagggaccacggtcaccgtctcctcagcttccaccaagggcccatcggtcttccccctggcgccctgctccaggagcacctctgggggcacagcggccctgggctgcctggtcaaggactacttcctacgtgagctctgagcgggctggcaaggcgcatagnnn

SEQ ID NO: 28184 - DNA, 166 bp, Homo sapiens
  misc_feature: GYAE6OF02IMB2J.47.78.H01.1.454.CMB.1.raw
  modified_base (163)..(166): a, c, t, g, unknown or other
  misc_feature (163)..(166): n is a, c, g, or t
tcagagctcacgtacacgaccggtgctcgatttagtgtgagtagtttgggtttgggcggagggaccaaactgaccgtcctaggtcagcccaaggctgccccctcggtcactctgttcccgcctcctctacgtgagctctgagcgggctggcaaggcgcatagnnnn

SEQ ID NO: 28185 - DNA, 259 bp, Homo sapiens; identical to SEQ ID NO: 28183
  misc_feature: GYAE6OF02ISWR8.47.78.H01.1.454.CMB.1.raw
  modified_base (257)..(259): a, c, t, g, unknown or other
  misc_feature (257)..(259): n is a, c, g, or t

SEQ ID NO: 28186 - DNA, 163 bp, Homo sapiens; identical to SEQ ID NO: 28073
  misc_feature: GYAE6OF02F1FFW.47.78.H01.1.454.CMB.1.raw
  modified_base (163)..(163): a, c, t, g, unknown or other
  misc_feature (163)..(163): n is a, c, g, or t

SEQ ID NO: 28187 - DNA, 231 bp, Homo sapiens
  misc_feature: GYAE6OF02IZR2H.47.78.H01.1.454.CMB.1.raw
  modified_base (230)..(231): a, c, t, g, unknown or other
  misc_feature (230)..(231): n is a, c, g, or t
tcagagctcacgtacacgaccggtgctcgatttagtgtgagtagtttgggtttgggcggagggaccaaactgaccgtcctaggcgcagtctgggtctctcacccttgttctggtctggcctcctcagtctgggttcttgtcggaacaggtcagcccaaggctgccccctcggtcactctgttcccaccctcctctacgtgagctctgagcgggctggcaaggcgcatagnn

SEQ ID NO: 28188 - DNA, 164 bp, Homo sapiens; identical to SEQ ID NO: 28103
  misc_feature: GYAE6OF02IWHUY.47.78.H01.1.454.CMB.1.raw
  modified_base (164)..(164): a, c, t, g, unknown or other
  misc_feature (164)..(164): n is a, c, g, or t

SEQ ID NO: 28189 - DNA, 260 bp, Homo sapiens
  misc_feature: GYAE6OF02GGB5O.47.78.H01.1.454.CMB.1.raw
  modified_base (257)..(260): a, c, t, g, unknown or other
  misc_feature (257)..(260): n is a, c, g, or t
tcagagctcacgtacacgaccggtgctcgatttagtgtgagtagtttgggtttggggtgatcactactactactactacatggacgtctggggcaaagggaccacggtcaccgtctcctcagcttccaccaagggcccatcggtcttccccctggcgccctgctccaggagcacctctgggggcacagcggccctgggctgcctggtcaaggactacttcctacgtgagctctgagcgggctggcaaggcgcatagnnnn

SEQ ID NO: 28190 - DNA, 184 bp, Homo sapiens
  misc_feature: GYAE6OF02IZTBL.47.78.H01.1.454.CMB.1.raw
  modified_base (174)..(184): a, c, t, g, unknown or other
  misc_feature (174)..(184): n is a, c, g, or t
tcagagctcacgtacacgaccggtgctcgatttagtgtgagtagtttgggtttgggggaagaggaagactgaccggtcccccaggagttcaggtgctgggcacagcggccctgggctgcctggtcaaggactacttcctacgtgagctctgagcgggctggcaaggcgcatagnnnnnnnnnnn

SEQ ID NO: 28191 - DNA, 257 bp, Homo sapiens
  misc_feature: GYAE6OF02HLVZC.47.78.H01.1.454.CMB.1.raw
  modified_base (257)..(257): a, c, t, g, unknown or other
  misc_feature (257)..(257): n is a, c, g, or t
tcagagctcacgtacacgaccggtgctcgatttagtgtgagtagtttgggtttggggtgatcactactactactactacatggacgtctggggcaaagggaccacggtcaccgtctcctcagcttccaccaagggcccatcggtcttccccctggcgccctgctccaggagcacctctgggggcacagcggccctgggctgcctggtcaaggactacttcctacgtgagctctgagcgggctggcaaggcgcatagn

SEQ ID NO: 28192 - DNA, 232 bp, Homo sapiens
  misc_feature: GYAE6OF02H2SUN.47.78.H01.1.454.CMB.1.raw
  modified_base (230)..(232): a, c, t, g, unknown or other
  misc_feature (230)..(232): n is a, c, g, or t
tcagagctcacgtacacgaccggtgctcgatttagtgtgagtagtttgggtttgggcggagggaccaaactgaccgtcctaggcgcagtctgggtctctcacccttgttctggtctggcctcctcagtctgggttcttgtcggaacaggtcagcccaaggctgccccctcggtcactctgttcccgccctcctctacgtgagctctgagcgggctggcaaggcgcatagnnn

SEQ ID NO: 28193 - DNA, 164 bp, Homo sapiens; identical to SEQ ID NO: 28046
  misc_feature: GYAE6OF02GR8GC.47.78.H01.1.454.CMB.1.raw
  modified_base (163)..(164): a, c, t, g, unknown or other
  misc_feature (163)..(164): n is a, c, g, or t

SEQ ID NO: 28194 - DNA, 164 bp, Homo sapiens; identical to SEQ ID NO: 28054
  misc_feature: GYAE6OF02FXDA6.47.78.H01.1.454.CMB.1.raw
  modified_base (163)..(164): a, c, t, g, unknown or other
  misc_feature (163)..(164): n is a, c, g, or t

SEQ ID NO: 28195 - DNA, 164 bp, Homo sapiens; identical to SEQ ID NO: 28103
  misc_feature: GYAE6OF02IBSCV.47.78.H01.1.454.CMB.1.raw
  modified_base (164)..(164): a, c, t, g, unknown or other
  misc_feature (164)..(164): n is a, c, g, or t

SEQ ID NO: 28196 - DNA, 261 bp, Homo sapiens
  misc_feature: GYAE6OF02F6GFY.47.78.H01.1.454.CMB.1.raw
  modified_base (231)..(261): a, c, t, g, unknown or other
  misc_feature (231)..(261): n is a, c, g, or t
tcagagctcacgtacacgaccggtgctcgatttagtgtgagtagtttgggtttgggcgggagggaccaaactgaccgtcctaggcgcagtctgggtctctcacccttgttctggtctggcctcctcagtctgggttcttgtcggaacaggtcagcccaaggctgccccctggtcactctgttcccacccttcctctacgtgagctctgagcgggctggcaaggcgcatagnnnnnnnnnnnnnnnnnnnnnnnnnnnnnnn

SEQ ID NO: 28197 - DNA, 260 bp, Homo sapiens; identical to SEQ ID NO: 28189
  misc_feature: GYAE6OF02IPMFV.47.78.H01.1.454.CMB.1.raw
  modified_base (257)..(260): a, c, t, g, unknown or other
  misc_feature (257)..(260): n is a, c, g, or t

SEQ ID NO: 28198 - DNA, 166 bp, Homo sapiens
  misc_feature: GYAE6OF02ILRL4.47.78.H01.1.454.CMB.1.raw
  modified_base (164)..(166): a, c, t, g, unknown or other
  misc_feature (164)..(166): n is a, c, g, or t
tcagagctcacgtacacgaccggtgctcgatttagtgtgagtagtttgggtttgggcggagggaccaaactgaccgtcctaggtcagcccaaggctgccccctcggtcactctgttcccaccctcctctacgtgagctctgagcgggctggcaaggcgcatagnnn

SEQ ID NO: 28199 - DNA, 158 bp, Homo sapiens
  misc_feature: GYAE6OF02G4VK2.47.78.H01.1.454.CMB.1.raw
  modified_base (130)..(158): a, c, t, g, unknown or other
  misc_feature (130)..(158): n is a, c, g, or t
tcagagctcacgtacacgaccggtgctcgatttagtgtgagtagtttgggtttgggcacagcggccctgggctgcctggtcaaggactacttcctacgtgagctctgagcgggctggcaaggcgcatagnnnnnnnnnnnnnnnnnnnnnnnnnnnnn

SEQ ID NO: 28200 - DNA, 129 bp, Homo sapiens; identical to SEQ ID NO: 28082
  misc_feature: GYAE6OF02I1PLK.47.78.H01.1.454.CMB.1.raw

SEQ ID NO: 28201 - DNA, 173 bp, Homo sapiens; identical to SEQ ID NO: 28060
  misc_feature: GYAE6OF02HJXIP.47.78.H01.1.454.CMB.1.raw
  modified_base (173)..(173): a, c, t, g, unknown or other
  misc_feature (173)..(173): n is a, c, g, or t

SEQ ID NO: 28202 - DNA, 259 bp, Homo sapiens; identical to SEQ ID NO: 28183
  misc_feature: GYAE6OF02GULKH.47.78.H01.1.454.CMB.1.raw
  modified_base (257)..(259): a, c, t, g, unknown or other
  misc_feature (257)..(259): n is a, c, g, or t

SEQ ID NO: 28203 - DNA, 173 bp, Homo sapiens; identical to SEQ ID NO: 28060
  misc_feature: GYAE6OF02JCZKR.47.78.H01.1.454.CMB.1.raw
  modified_base (173)..(173): a, c, t, g, unknown or other
  misc_feature (173)..(173): n is a, c, g, or t

SEQ ID NO: 28204 - DNA, 173 bp, Homo sapiens; identical to SEQ ID NO: 28060
  misc_feature: GYAE6OF02HZHA9.47.78.H01.1.454.CMB.1.raw
  modified_base (173)..(173): a, c, t, g, unknown or other
  misc_feature (173)..(173): n is a, c, g, or t

SEQ ID NO: 28205 - DNA, 656 bp, Homo sapiens
  misc_feature: GYAE6OF02JMFZ7.47.78.H01.1.454.CMB.1.raw
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
  modified_base (325)..(327): a, c, t, g, unknown or other
  misc_feature (325)..(327): n is a, c, g, or t
  modified_base (329)..(329): a, c, t, g, unknown or other
  misc_feature (329)..(329): n is a, c, g, or t
  modified_base (334)..(335): a, c, t, g, unknown or other
  misc_feature (334)..(335): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (341)..(341): a, c, t, g, unknown or other
  misc_feature (341)..(341): n is a, c, g, or t
  modified_base (343)..(344): a, c, t, g, unknown or other
  misc_feature (343)..(344): n is a, c, g, or t
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
  modified_base (356)..(356): a, c, t, g, unknown or other
  misc_feature (356)..(356): n is a, c, g, or t
  modified_base (358)..(358): a, c, t, g, unknown or other
  misc_feature (358)..(358): n is a, c, g, or t
tcagagctcacgtacacgaccggtgctcgatttagtgtgagtagttttggggttttgggggggtagagtacactactacgtactactacatggacgtcctgggggcctaaagggaccacggggtctaccggtcctcctcagcctttccaaccgaagggcccagtccggtcttccccctgggcgacccctgctccacggagcacctctcgggggcacacgtcggcccttggggtctgcctggtccaaggactacttccgtacggttggacgtcgtctcggagccggggcccgtagggccgaagggcgctagtacgncatntggatnnnanacacnncncncncnngngacgcgcncncncacgacgacacacaacgacgtacgacacacacacacacgacgacacgacgacgacgacgacacactactacgtacgtacgacgacgacggtacggtacggtacggtcggtacggtacggtacgtacggtacgggtacggtacggtacggtacggtacgtccgtaccgtaccgtccgtacgtacgtaccgtaccgaccggaccgtaccgtacgtccgtccgtcccgtccggtccgtccgtcgtcgtacgtacgaccggaccgtaccgtaccggaccgacgaccgaccgtaccggtaccg

SEQ ID NO: 28206 - DNA, 196 bp, Homo sapiens
  misc_feature: GYAE6OF02IPZM6.47.78.H01.1.454.CMB.1.raw
  modified_base (165)..(167): a, c, t, g, unknown or other
  misc_feature (165)..(167): n is a, c, g, or t
  modified_base (169)..(196): a, c, t, g, unknown or other
  misc_feature (169)..(196): n is a, c, g, or t
tcagagctcacgtacacgaccggtgctcgatttagtgtgagtagtttgggtttgggcggagggaccaaactgaccgtcctaggtcagcccaaggctgccccctcggtccactctgttcccgccctcctctacgtgagctctgagcgggctggcaaggcgcatagnnngnnnnnnnnnnnnnnnnnnnnnnnnnnnn

SEQ ID NO: 28207 - DNA, 175 bp, Homo sapiens
  misc_feature: GYAE6OF02H6U57.47.78.H01.1.454.CMB.1.raw
  modified_base (173)..(175): a, c, t, g, unknown or other
  misc_feature (173)..(175): n is a, c, g, or t
tcagagctcacgtacacgaccggtgctcgatttagtgtgagtagtttgggtttgggggaagaggaagactgacggtcccccaggagttcaggtgctgggcacagcggccctgggctgcctggtcaaggactacttcctacgtgagctctgagcgggctggcaaggcgcatagnnn

SEQ ID NO: 28208 - DNA, 137 bp, Homo sapiens
  misc_feature: GYAE6OF02HJKMM.47.78.H01.1.454.CMB.1.raw
  modified_base (130)..(137): a, c, t, g, unknown or other
  misc_feature (130)..(137): n is a, c, g, or t
tcagagctcacgtacacgaccggtgctcgatttagtgtgagtagtttgggtttgggcacagcggccctgggctgcctggtcaaggactacttcctacgtgagctctgagcgggctggcaaggcgcatagnnnnnnnn

SEQ ID NO: 28209 - DNA, 536 bp, Homo sapiens
  misc_feature: GYAE6OF02G3RLT.47.78.H01.1.454.CMB.1.raw
  modified_base (343)..(343): a, c, t, g, unknown or other
  misc_feature (343)..(343): n is a, c, g, or t
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttccttcagtcaagtctggataagctgggtccgccaggctccagggatgggcctggagtgggttggcgtgtcaagngcagactgatggtgcgacatctgaatacgctgcaccgtgaaaggcagattcaccatctccagagatgattacaataaatatgtctatatactaacaaatggatagacctagaaatcgagatacaggttagttattactgttccagaggtatggtacggttctcgtcggggccgagggactaagtggtactacg

SEQ ID NO: 28210 - DNA, 170 bp, Homo sapiens
  misc_feature: GYAE6OF02FSJ91.47.78.H01.1.454.CMB.1.raw
  modified_base (165)..(170): a, c, t, g, unknown or other
  misc_feature (165)..(170): n is a, c, g, or t
tcagagctcacgtacacgaccggtgctcgatttagtgtgagtagtttgggtttgggcggagggaccaaactgaccgtcctaggtcagcccaaggctcgccccctcggtcactctgttcccaccctcctctacgtgagctctgagcgggctggcaaggcgcatagnnnnnn

SEQ ID NO: 28211 - DNA, 278 bp, Homo sapiens
  misc_feature: GYAE6OF02GG5C2.47.78.H01.1.454.CMB.1.raw
  modified_base (275)..(278): a, c, t, g, unknown or other
  misc_feature (275)..(278): n is a, c, g, or t
tcagagctcacgtacacgaccggtgctcgatttagtgtgagtagtttgggtttgggcagttttctctgaatcaaaaccccgagaccgccgcggacagcctcggcccctggggcccagaaaccctggtcaccgtctcctcagcttccaccaagggcccatcggtcttcccctggcgccctgctccaggagcacctctgggggcacagcggccctgggctgcctggtcaaggactacttcctacgtgagctctgagcgggctggcaaggcgcatagnnnn

SEQ ID NO: 28212 - DNA, 174 bp, Homo sapiens; identical to SEQ ID NO: 28097
  misc_feature: GYAE6OF02JF1YK.47.78.H01.1.454.CMB.1.raw
  modified_base (173)..(174): a, c, t, g, unknown or other
  misc_feature (173)..(174): n is a, c, g, or t

SEQ ID NO: 28213 - DNA, 524 bp, Homo sapiens
  misc_feature: GYAE6OF02FKRDB.47.78.H01.1.454.CMB.1.raw
  modified_base (191)..(191): a, c, t, g, unknown or other
  misc_feature (191)..(191): n is a, c, g, or t
tcagagctcacgtacacgaccggtgctcgatttagtgtgagtagtttgggtttggggagagaagacaggattcaggacaatctccagcatggccggcttccctctcctcctcaccctcctcactcactgtgcagggtcctgggcccactctgtggtgactcagccaccctcagcgtctgggacccccgggnagagggtctcatctcttgctctggaagcagctccaacatcggaagaatgatgtgtactggttgcagcaactccccggaacggccccccaaactcctcatctatacgaataatcagcggtcctcaggggtccctgaccgattctctggctccaagtctgacacctcagcctccctggccatcagtggctccggtccgaggatgaggctgattattattgtgcaacatgggatagtagcctgagttagtgttggttttcggcggagggaccaaactgacgtctagtcagccaaggcctcgcccctgtccactctcgttcccaccctcctctaccg

SEQ ID NO: 28214 - DNA, 259 bp, Homo sapiens
  misc_feature: GYAE6OF02IXTY2.47.78.H01.1.454.CMB.1.raw
  modified_base (258)..(259): a, c, t, g, unknown or other
  misc_feature (258)..(259): n is a, c, g, or t
tcagagctcacgtacacgaccggtgctcgatttagtgtgagtagtttgggtttgggggtgatcactactactactactacatggacgtctggggcaaagggaccacggtcaccgtctcctcagcttccaccaagggcccatcggtcttccccctggcgccctgctccaggagcacctctgggggcacagcggccctgggctgcctggtcaaggactacttcctatgtatactctgagcgggctggcaaggcgcatagnn

SEQ ID NO: 28215 - DNA, 228 bp, Homo sapiens
  misc_feature: GYAE6OF02F6M9P.47.78.H01.1.454.CMB.1.raw
  modified_base (181)..(228): a, c, t, g, unknown or other
  misc_feature (181)..(228): n is a, c, g, or t
tcagagctcacgtacacgaccggtgctcgatttagtgtgagtagtttgggtttggggggtaagaggaagactgacgggtccccccaggagttcaggtgctggggccacacgcggccctgggctgcctggtcaaggcctacttcctacgtgagctctgacgcgggctggcaaggcgcatagnnnnnnnnnnnnnnnnnnnnnnnnnnnnnnnnnnnnnnnnnnnnnnnn

SEQ ID NO: 28216 - DNA, 133 bp, Homo sapiens; identical to SEQ ID NO: 28071
  misc_feature: GYAE6OF02JICOL.47.78.H01.1.454.CMB.1.raw
  modified_base (130)..(133): a, c, t, g, unknown or other
  misc_feature (130)..(133): n is a, c, g, or t

SEQ ID NO: 28217 - DNA, 543 bp, Homo sapiens
  misc_feature: GYAE6OF02IGDLD.47.78.H01.1.454.CMB.1.raw
  modified_base (344)..(344): a, c, t, g, unknown or other
  misc_feature (344)..(344): n is a, c, g, or t
tcagagctcacgtacacgaccggtgctcgatttagtgtgagtagtttgggtttggggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccggggggtcccttaaactctcctgcgcagcgtctggatttccttcagtcaagtctggataagctgggtccgccaggctccagggatgggcctggagtgggttggccgtgtcaagngcagaactgatggtgcgacatctgaatacgctgcaccgtgaaaggcagattcaccatctccagagatgattacaaataaatatagtacatatactaacaaataggatagacctagaaaatcgaagataacgaggttagtttattactgttaccacgaggtaatgtcgttctcgtcggggcgagggacaagtggtactag

SEQ ID NO: 28218 - DNA, 183 bp, Homo sapiens
  misc_feature: GYAE6OF02FT5Q1.47.78.H01.1.454.CMB.1.raw
  modified_base (174)..(183): a, c, t, g, unknown or other
  misc_feature (174)..(183): n is a, c, g, or t
tcagagctcacgtacacgaccggtgctcgatttagtgtgagtagtttgggtttgggggaagaggaagactgacggtccccccaggagttcaggtgctgggcacagcggccctgggctgcctggtcaaggactacttcctacgtgagctctgagcgggctggcaaggcgcatagnnnnnnnnnn

SEQ ID NO: 28219 - DNA, 581 bp, Homo sapiens
  misc_feature: GYAE6OF02ISIWU.47.78.H01.1.454.CMB.1.raw
  modified_base (191)..(191): a, c, t, g, unknown or other
  misc_feature (191)..(191): n is a, c, g, or t
tcagagctcacgtacacgaccggtgctcgatttagtgtgagtagtttgggtttggggagagaagacaggattcaggacaatctccagcatggccggcttccctctcctcctcaccctcctcactcactgtgcagggtcctgggcccactctgtggtgactcagccaccctcagcgtctgggacccccgggnagagggtcgtcatctcttgctctggaagcagctccaacatcggaagaatgatgtgtactggttgcagcaacgtccccggaacgcccccaaactcctcatctatacgaatatcagcggtcctcgacggggtccctgaccgtattcctctggcctccaagtctgaccacctcacgccctcccgtggcctagtccacggtcgggccttcccgggtaccgaggtagtcggacggctgtatttattattgtgacaactagtagggatagtacgtcctaggtagttagttggttgggtttcggcgggtacggaccgtaacgtcgtaccgttcgtaggtcacgcccgaaggcctccgcccctcggtcctccgtctccgttcccgcccttcctctccg

SEQ ID NO: 28220 - DNA, 628 bp, Homo sapiens
  misc_feature: GYAE6OF02IWACJ.47.78.H01.1.454.CMB.1.raw
  modified_base (171)..(171): a, c, t, g, unknown or other
  misc_feature (171)..(171): n is a, c, g, or t
  modified_base (193)..(193): a, c, t, g, unknown or other
  misc_feature (193)..(193): n is a, c, g, or t
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (480)..(480): a, c, t, g, unknown or other
  misc_feature (480)..(480): n is a, c, g, or t
tcagagctcacgtacacgaccggtgctcgatttagtgtgagtagtttgggtttggggagagaagacaggattcaggacaatctccagcatggccggcttccctctcctcctcaccctcctcactcactgtgcagggtcttgggcccagtctgtgctgactcagccaccctnagcgtcgtcgggacccccgggnaggacggtcaccatcctcttgttctggaancagctcaatntcggaaatgataatgtatactggtaccagcaagtcccacgaacggacccccaaactcctcatctataacaatgatcagcggccctcgacgggtccctaggccgaattcctctcgggccttccaaagttctggccgcctacacgtcccacctcggccctatccaggtcggcgtcccggcccggaagactggacggctgtactttacgttactaggtcgttaagggttcgggaattcggcacgggtccncggtacgtgtccgttaggtccttacgggaacgtccgtacgggacccaagggtccacccggtccgtaaggtccaaccggtaccccaacgggcccctaaaccccgacgttcgtaccgtacttcccgtacgttcccccgaccccttacccg

SEQ ID NO: 28221 - DNA, 169 bp, Homo sapiens
  misc_feature: GYAE6OF02HINUE.47.78.H01.1.454.CMB.1.raw
  modified_base (164)..(169): a, c, t, g, unknown or other
  misc_feature (164)..(169): n is a, c, g, or t
tcagagctcacgtacacgaccggtgctcgatttagtgtgagtagtttgggtttgggcggagggaccaaactgaccgtcctaggtcagcccaaggctgccccctcggtcactctgttcccaccctcctctacgtgagctctgagcgggctggcaaggcgcatagnnnnnn

SEQ ID NO: 28222 - DNA, 515 bp, Homo sapiens
  misc_feature: GYAE6OF02HTT00.47.78.H01.1.454.CMB.1.raw
  modified_base (277)..(277): a, c, t, g, unknown or other
  misc_feature (277)..(277): n is a, c, g, or t
  modified_base (337)..(337): a, c, t, g, unknown or other
  misc_feature (337)..(337): n is a, c, g, or t
  modified_base (484)..(515): a, c, t, g, unknown or other
  misc_feature (484)..(515): n is a, c, g, or t
tcagagctcacgtacacgaccggtgctcgatttagtgtgagtagtttgggtttggggtacccccgggccgagagggtcgtcatctcttgctctggaagcagctccaacatcggaaggaatgatgtgtactggttgcagcaactccccggaacggcccccaaactcctcatctatacgaataatcagccggtcctcaggggtcccctgaccgattctctggctccaagtctgacacctcagccctcctggccatcaggtggggctcccggtccgaggntggaggctgatttatactgtgtaggttgggatcgcagctgaatgcttacgtcttcggagngtcgggaaccaaggtccaccggtcctaggtccagccccaaacgggcccaaaccccctatcgtccacttcttccgttaccccaccccttctaccgtagtgacgcttcgtggacggcggggctcggggacaacgggccacaacgtagcnnnnnnnnnnnnnnnnnnnnnnnnnnnnnnnn

SEQ ID NO: 28223 - DNA, 163 bp, Homo sapiens
  misc_feature: GYAE6OF02FF1ZK.47.78.H01.1.454.CMB.1.raw
tcagagctcacgtacacgaccggtgctcgatttagtgtgagtagtttgggtttgggcggagggaccaaactgaccgtcctaggtcagcccaaggctgccccctcggtcactctgttcccgccctcctctacgtgagctctgagcgggctggcaaggcgcatag

SEQ ID NO: 28224 - DNA, 526 bp, Homo sapiens
  misc_feature: GYAE6OF02F2CC7.47.78.H01.1.454.CMB.1.raw
tcagagctcacgtacacgaccggtgctcgatttagtgtgagtagtttgggtttgggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgattcaaataaatatgtcatatctacaaatggatagcctagaaaatcgagatacaggtgttattactgttccacgaggaatgcggttctcgtgggccgagggacaagtggtctag

SEQ ID NO: 28225 - DNA, 259 bp, Homo sapiens
  misc_feature: GYAE6OF02IG1IZ.47.78.H01.1.454.CMB.1.raw
  modified_base (258)..(259): a, c, t, g, unknown or other
  misc_feature (258)..(259): n is a, c, g, or t
tcagagctcacgtacacgaccggtgctcgatttagtgtgagtagtttgggtttgggggtgatcactactactactactacatggacgtctggggcaaagggaccacggtcaccgtctcctcagcttccaccaagggcccatcggtcttccccctggcgccctgctccaggagcacctctgggggcacagcggccctgggctgcctggtcaaggactacttcctacgtgagctctgagcgggctggcaaggcgcatagnn

SEQ ID NO: 28226 - DNA, 172 bp, Homo sapiens
  misc_feature: GYAE6OF02HFKR2.47.78.H01.1.454.CMB.1.raw
tcagagctcacgtacacgaccggtgctcgatttagtgtgagtagtttgggtttgggggaagaggaagactgacggtcccccaggagttcaggtgctgggcacagcggccctgggctgcctggtcaaggactacttcctacgtgagctctgagcgggctggcaaggcgcatag

SEQ ID NO: 28227 - DNA, 554 bp, Homo sapiens
  misc_feature: GYAE6OF02GOTFU.47.78.H01.1.454.CMB.1.raw
  modified_base (347)..(347): a, c, t, g, unknown or other
  misc_feature (347)..(347): n is a, c, g, or t
tcagagctcacgtacacgaccggtgctcgatttagtgtgagtagtttgggtttggggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtgggttggccggtgtcaagngcagaactgatggtgcgacatctgaatacgctgccaccgtgaaacggcagattcaccatctccagagatgattcaaataaatatgtacatatactaacaaatggatagacctagaaatcgaaggtatacgtaggttgtttattacttgttaccacgagggtaatcggtcggtttctcggtcggggccgagggacaagtcggtatacg

SEQ ID NO: 28228 - DNA, 166 bp, Homo sapiens; identical to SEQ ID NO: 28198
  misc_feature: GYAE6OF02F9IL0.47.78.H01.1.454.CMB.1.raw
  modified_base (164)..(166): a, c, t, g, unknown or other
  misc_feature (164)..(166): n is a, c, g, or t

SEQ ID NO: 28229 - DNA, 165 bp, Homo sapiens; identical to SEQ ID NO: 28147
  misc_feature: GYAE6OF02GUILK.47.78.H01.1.454.CMB.1.raw
  modified_base (164)..(165): a, c, t, g, unknown or other
  misc_feature (164)..(165): n is a, c, g, or t

SEQ ID NO: 28230 - DNA, 211 bp, Homo sapiens
  misc_feature: GYAE6OF02G783X.47.78.H01.1.454.CMB.1.raw
  modified_base (172)..(211): a, c, t, g, unknown or other
  misc_feature (172)..(211): n is a, c, g, or t
tcagagctcacgtacacgaccggtgctcgatttagtgtgagtagtttgggtttggggtcgggagggaccaaactcgaccgtcctaggtcagcccaaggctgccccctcggtcgacctctgttcccaccctcctctacggtgagctctgagcggggctggcaaggcgcatagnnnnnnnnnnnnnnnnnnnnnnnnnnnnnnnnnnnnnnnn

SEQ ID NO: 28231 - DNA, 609 bp, Homo sapiens
  misc_feature: GYAE6OF02G4X9B.47.78.H01.1.454.CMB.1.raw
  modified_base (193)..(193): a, c, t, g, unknown or other
  misc_feature (193)..(193): n is a, c, g, or t
tcagagctcacgtacacgaccggtgctcgatttagtgtgagtagtttgggtttggggagagaagacaggattcaggacaatctccagcatggccggcttccctctcctcctcaccctcctcactcactgtgcagggtcttgggcccagtctgtgctgactcagcccaccctcagcgtctcggggacccccggnagacggtcaccatctcttgttctggaagcagctccaatatcggaaatgataatgtatactggtaccagacaagtcccaacgaaccggacccccaaactccctcactctaataacaatgatcgacggccggccctcgacggggtccctggccgtattcctcgtggcctaccaaggttctgggccaccttcgaacgtcccaccctggaccctaatcgaggtcgggcctcccgggcccgaggactggacggcgtagtattattacgtgtggttagggttgggatcgcagcctgactgtctttacgtcttcggagtcgtcgggaccgtaaggtccaccgtccgtaggtaccgacggacccgaacggaccctaaccccgtattccgtaccgaccttccgttaccgttcccctacccctccg

SEQ ID NO: 28232 - DNA, 233 bp, Homo sapiens
  misc_feature: GYAE6OF02FF3IR.47.78.H01.1.454.CMB.1.raw
  modified_base (231)..(233): a, c, t, g, unknown or other
  misc_feature (231)..(233): n is a, c, g, or t
tcagagctcacgtacacgaccggtgctcgatttagtgtgagtagtttgggtttgggcggagggaccaaactgaccgtcctaggcgcagtctgggtctctcacccttgttctggtctggcctcctcagtctgggttcttgtcggaacaggtcagcccaaggctgccccctcggtcactctgttccccaccctcctctacgtgagctctgagcgggctggcaaggcgcatagnnn

SEQ ID NO: 28233 - DNA, 168 bp, Homo sapiens
  misc_feature: GYAE6OF02IVHYV.47.78.H01.1.454.CMB.1.raw
  modified_base (163)..(168): a, c, t, g, unknown or other
  misc_feature (163)..(168): n is a, c, g, or t
tcagagctcacgtacacgaccggtgctcgatttagtgtgagtagtttgggtttgggcggagggaccaaactgaccgtcctaggtcagcccaaggctgcccctcggtcactctgttcccaccctcctctacgtgagctctgagcgggctggcaaggcgcatagnnnnnn

SEQ ID NO: 28234 - DNA, 641 bp, Homo sapiens
  misc_feature: GYAE6OF02GEB0E.47.78.H01.1.454.CMB.1.raw
  modified_base (370)..(370): a, c, t, g, unknown or other
  misc_feature (370)..(370): n is a, c, g, or t
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtcgtgggggaggcctcagtaaaggccggggggtcccttaaactctcctgcgcagcgtctggatttccttcagtcaagtctggataagctgggtccgccaggctccgagggatgggcctggaggtgggttggccgtgtacgaagagcagaactgagtggtgcganatctagaatacgctgccacccggtagaaacggcaagactttaccgacctactcctaccaagagatgaattacgaaattaaatatgttactaataattactaaactaaagtaggtaactaacgtacctaaggaaaacgttacggaaggtaactaacgtaggtttagtttaagttgtacgttacgttacccgtaaggtaagggaacgttcggtaccggtttacgtacgggtacgggggtacccggtaagggtaaccgtaggttgggttaaccg

SEQ ID NO: 28235 - DNA, 279 bp, Homo sapiens
  misc_feature: GYAE6OF02GJ03D.47.78.H01.1.454.CMB.1.raw
  modified_base (275)..(279): a, c, t, g, unknown or other
  misc_feature (275)..(279): n is a, c, g, or t
tcagagctcacgtacacgaccggtgctcgatttagtgtgagtagtttgggtttgggcagttttctctgaatcaaaaccccgagaccgccgcggacagcctcggcccctggggcccagaaaccctggtcaccgtctcctcagcttccaccaagggcccatcggtcttcccctggcgccctgctccaggagcacctctgggggcacagcggccctgggctgcctggtcaaggactacttcctacgtgagctctgagcgggctggcaaggcgcatagnnnnn

SEQ ID NO: 28236 - DNA, 233 bp, Homo sapiens
  misc_feature: GYAE6OF02G2294.47.78.H01.1.454.CMB.1.raw
  modified_base (229)..(233): a, c, t, g, unknown or other
  misc_feature (229)..(233): n is a, c, g, or t
tcagagctcacgtacacgaccggtgctcgatttagtgtgagtagtttgggtttgggcggagggaccaaactgaccgtcctaggcgcagtctgggtctctcacccttgttctggtctggcctcctcagtctgggttcttgtcggaacaggtcagcccaaggctgccccctggtcactctgttcccgccctcctctacgtgagctctgagcgggctggcaaggcgcatagnnnnn

SEQ ID NO: 28237 - DNA, 659 bp, Homo sapiens
  misc_feature: GYAE6OF02HUWXI.47.78.H01.1.454.CMB.1.raw
  modified_base (191)..(191): a, c, t, g, unknown or other
  misc_feature (191)..(191): n is a, c, g, or t
  modified_base (360)..(360): a, c, t, g, unknown or other
  misc_feature (360)..(360): n is a, c, g, or t
tcagagctcacgtacacgaccggtgctcgatttagtgtgagtagtttgggtttggggagagaagacaggattcaggacaatctccagcatggccggcttccctctcctcctcaccctcctcactcactgtgcagggtcctgggcccactctgtggtgactcagccaccctcagcgtctgggacccccgggnagacggtcaccatctcttgttctggaagcagctccaatatcggaaatgaataatgtatactggtaccagcaagtcccaacgaaccgacccccaatcctcatctaataacaatgatcacgccggccctcgacggggtccctggcctattctcgtgcctcaagtctggccncctcacgcccaccgtggaccctatccgaggtcggggacctcccgggacccgaggctaggacggctagtatttaatttacgtggttgggttagggttgggacttccggacgtacgtcctacggtacttcggtaccgtttacggtcgttacgggacgtccggttacgggaaccgtaacggtaccgtacccggtaccgttacgggtaccaaccggaccccgtaacggacccctaaaccccgtccgttacgtaccctaccgttcccgtttacccggttaccccctaccccgttccttacccgg

SEQ ID NO: 28238 - DNA, 173 bp, Homo sapiens
  misc_feature: GYAE6OF02FU6XO.47.78.H01.1.454.CMB.1.raw
  modified_base (164)..(173): a, c, t, g, unknown or other
  misc_feature (164)..(173): n is a, c, g, or t
tcagagctcacgtacacgaccggtgctcgatttagtgtgagtagtttgggtttgggcggagggaccaaactgaccgtcctaggtcagcccaaggctgccccctcggtcactctgttcccgccctcctctacgtgagctctgagcgggctggcaaggcgcatagnnnnnnnnnn

SEQ ID NO: 28239 - DNA, 131 bp, Homo sapiens; identical to SEQ ID NO: 28080
  misc_feature: GYAE6OF02HQCO1.47.78.H01.1.454.CMB.1.raw
  modified_base (130)..(131): a, c, t, g, unknown or other
  misc_feature (130)..(131): n is a, c, g, or t

SEQ ID NO: 28240 - DNA, 684 bp, Homo sapiens
  misc_feature: GYAE6OF02HN4JS.47.78.H01.1.454.CMB.1.raw
  modified_base (559)..(559): a, c, t, g, unknown or other
  misc_feature (559)..(559): n is a, c, g, or t
tcagagctcacgtacacgaccggtgctcgatttagtgtgagtagttgggtttgggggggaggaggagcccagccttgggattcccaagtgttttcattcagtgatcaggactgaacacagaggactcaccatggagtttgggctgagctggattttcctcggtgctctttaaaaggtgtccagtgtggggtgcacctgatggagtcgtgggggaggcctcataaaggcccgggggggtccttaaacgtctcctgcgcagcgtctggtactttcctttcagtcaagtctggataagcgtgggtccgccgaggcctccgagggagtcgggccgtgggaggttcggggttgggcccgttggtccgaaaggcgaccgaaggaaccgtggaagtggggtcggcgaacatcttaggaactaccgcgtcggacctaccccggtaggaaaacggcaaggtactttccgaacctactctacccgaagagatgtaatacaaagttaaaatagtcgtactaatactacctaaacaagtagaatacgtacctaaagaaacgtagaaggtanaacgtaaggttagttttaactacttacgttacctaacggaagggtaattcgggaccggttttaccgtcgggttacgggggaaccccggtaaggggaaacccgttaggttacgggtcgtttaacgg

SEQ ID NO: 28241 - DNA, 451 bp, Homo sapiens
  misc_feature: GYAE6OF02HROA5.47.78.H01.1.454.CMB.1.raw
  modified_base (440)..(440): a, c, t, g, unknown or other
  misc_feature (440)..(440): n is a, c, g, or t
  modified_base (445)..(451): a, c, t, g, unknown or other
  misc_feature (445)..(451): n is a, c, g, or t
tcagagctcacgtacacgaccggtgctcgatttagtgtgagtagtttgggtttggggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgatttattattgtgcaacatgggatagtagcctgagtagtgtggttttcggcggagggaccaaacgtgaccgtccgtaggtcacgcccgaaggcctcggccccctcggtcactctcgttccccaccctcctctacgtgagctctgacgcgggctggacagggcncatgnnnnnnn

SEQ ID NO: 28242 - DNA, 259 bp, Homo sapiens
  misc_feature: GYAE6OF02H4P6A.47.78.H01.1.454.CMB.1.raw
  modified_base (254)..(259): a, c, t, g, unknown or other
  misc_feature (254)..(259): n is a, c, g, or t
tcagagctcacgtacacgaccggtgctcgatttagtgtgagtagtttgggtttggggtgataactactactactactacatggacgtctggggcaaagggaccacggtcaccgtctcctcagcttccaccaaggcccatcggtcttcccctggcgccctgctccaggagcacctctgggggcacagcggccctgggctgcctggtcaaggactacttcctacggagctctgagcgggctggcaaggcgcatagnnnnnn

SEQ ID NO: 28243 - DNA, 662 bp, Homo sapiens
  misc_feature: GYAE6OF02JICVT.47.78.H01.1.454.CMB.1.raw
  modified_base (457)..(457): a, c, t, g, unknown or other
  misc_feature (457)..(457): n is a, c, g, or t
tcagagctcacgtacacgaccggtgctcgatttagtgtgagtagtttgggtttgggggggagaggagccccagccttgggattcccaagtgttttcattcagtgatcaggactgaacacagaggactcaccatggagttgggctcgagctggattttcctcggtgctcttttaaaaggtgtccagtgtggggtgcacctgatggagtcgtggggaggcctcataaaggccggggggtcccttaaactctccgtgcgcagcgtctggtatttcctttcagtcaagttctggataagctcgggtccgccgaggctccgagggatcgggcctgggagttgggttcggccgtgtacgaggacgcagaactgatggtgcgacatctgaatacgctgcacccgtagaaacggcagtacttcacctatcctaccgaagtagacttagactttacaaattaaatnttagtacaagttaactctaaactaaatgggtaaatacggtacctaaagtaaaacgtcgggaagtaacgttaacgttagggttacgttttaacgttaaccgttacgttaacccgtacggtaaggggttaaacttcgggttaccggtttccgtaccggttaccgggggaccgtaaggggaaccctaaggttccgggttaacttacgg

SEQ ID NO: 28244 - DNA, 129 bp, Homo sapiens
  misc_feature: GYAE6OF02FL6XB.47.78.H01.1.454.CMB.1.raw
  modified_base (129)..(129): a, c, t, g, unknown or other
  misc_feature (129)..(129): n is a, c, g, or t
tcagagctcacgtacacgaccggtgctcgatttagtgtgagtagtttgggtttgggcacagcggccctggctgcctggtcaaggactacttcctatgtatactctgagcgggctggcaaggcgcatagn

SEQ ID NO: 28245 - DNA, 232 bp, Homo sapiens
  misc_feature: GYAE6OF02HKOD3.47.78.H01.1.454.CMB.1.raw
  modified_base (230)..(232): a, c, t, g, unknown or other
  misc_feature (230)..(232): n is a, c, g, or t
tcagagctcacgtacacgaccggtgctcgatttagtgtgagtagtttgggtttgggcggagggaccaaactgaccgtcctaggcgcagtctgggtctctcacccttgttctggtctggcctcctcagtctgggttcttgtcggaacaggtcagcccaaggctgccccctcggtcactctgttcccaccctcctctacgtgagctctgagcgggctggcaaggcgcatagnnn

SEQ ID NO: 28246 - DNA, 130 bp, Homo sapiens; identical to SEQ ID NO: 28067
  misc_feature: GYAE6OF02FRTSI.47.78.H01.1.454.CMB.1.raw
  modified_base (130)..(130): a, c, t, g, unknown or other
  misc_feature (130)..(130): n is a, c, g, or t

SEQ ID NO: 28247 - DNA, 777 bp, Homo sapiens
  misc_feature: GYAE6OF02IUA9W.47.78.H01.1.454.CMB.1.raw
tcagagctcacgtacacgaccggtgctcgatttagtgtgagtagtttgggtttgggggggggagaggagccccagccttgggattcccaagtgttttcattcagtgatcaggactgaacacagaggactcaccatggagtttgggctgagctggattttcctcggtgctcttttaaaaggtgtccagtgtggggtgcactgatggagtcgtgggggaggcctcaagtaaacgggccggggggttacccttaaactcctcctgcgcacgcgtcgtggtacttttcctttcgtacgtacaacgttcgtaggtaattaacggcggttacggggtcccgaccgacgggtcctaccggaggggtagtcggggccggtggggtagggttggggttcgggccggttggtacgaagacggacaaggtaacgtgtaggtggtcgacgactatctagaactacgcgtcgaccgtaaccggaaggaacggacgagtaccttaccaacctactcccgtacgaagaacgtatagtaaacttaactaaaattaaatagttacgttaactaacttacgttaacttaaacgtaaaggtacgaagttaccggtacttaaacggaaacgttacgaaggttaacgttaacggttaaacggttttagtttaacgttacgtttaccggttaacgtaaacgggttaagggttaaccggttcgggtaaccggtttcggtaccggggttacggggaaccgggtaacgggtaacgttaacggttacggttaccgtttaacgg

SEQ ID NO: 28248 - DNA, 643 bp, Homo sapiens
  misc_feature: GYAE6OF02JURED.47.78.H01.1.454.CMB.1.raw
  modified_base (425)..(425): a, c, t, g, unknown or other
  misc_feature (425)..(425): n is a, c, g, or t
  modified_base (458)..(458): a, c, t, g, unknown or other
  misc_feature (458)..(458): n is a, c, g, or t
tcagagctcacgtacacgaccggtgctcgatttagtgtgagtagtttgggtttggggggggtagggagggagccccacgccttgggagttcccaacgtgttttctattcagtgatcaggactgaacacagaggactcaccatggagtttgggctgagctggattttcctcggtgctctttaaaaggtgtccagtgtggggtgcacctgatggagtcgtgggggaggcctcataaacggccgggggggtccttaaacgtctcctgcgcgacgcgtctggtactttccttcagtcaagtctggataagctgggtccgcgaggctcgaggatgggcctggagtgggtcgcgtgtcagacgcgagactcgagtcggtgacgatatctgaatacgctacggcctaccgtagaaaggcagacttccactcncctacgagtacgatagtacttacaaattaactntgtacctataacttactaaactaacgtgtaactacgtaactaagaaaacgtcggaacgttacgtaacgttaggtttagttttaactaccgttaggttaccgaacggtaaggggttaactcgggttaccggtttaccgttggggtacggggtaccggaagggtaacgtacgtacggttcgttaacg

SEQ ID NO: 28249 - DNA, 793 bp, Homo sapiens
  misc_feature: GYAE6OF02I3L5B.47.78.H01.1.454.CMB.1.raw
  modified_base (194)..(194): a, c, t, g, unknown or other
  misc_feature (194)..(194): n is a, c, g, or t
  modified_base (273)..(273): a, c, t, g, unknown or other
  misc_feature (273)..(273): n is a, c, g, or t
tcagagctcacgtacacgaccggtgctcgatttagtgtgagtagtttgggtttggggagagaagacaggattcaggacaatctccagcatggccgcttccctctcctcctcaccctcctcactcactgtgcgaggtcctgggcccactctggtggtgactcacgcccaccctcagcgtcgtcgggacccccggnaggaggtctcatctcttgctcgtggaacgcacgctacccaactacgtacgggaaggtatgtatcgtacgttacgtggtnactacgacccgtaaccccgtacccccggaacccggacccccctaaaaccttccctactaacctaccttaaacgtaacgtaaactacgtaccgaccggtcccgtaccgtaccggtacggggtcccctacgacccgtactttcgtccgtacggtacctaccgtaagttccgacgaccctacctccgacccgtccccgttccgtccggtactcgtacgggtccgggtaccgtccgggtacccggagtcggtacggtacgtacggttagttactttacgtttacgttacggtaacgtaacgtaacgtaaacggttggtaaggttacgttaacgtcgtaacggttggttaacggtttcgggttagggtttacccgggtacgggtaacgggttaaccggtaccggttaccggtaacccggttcgtaaccggtacgtacccggaccgtaaccggtcccggtacccgtcccggtaccgtcccgtacccgtccgttacccgttcccgtcccctcgttcctacggtaccg

SEQ ID NO: 28250 - DNA, 795 bp, Homo sapiens
  misc_feature: GYAE6OF02HVAPU.47.78.H01.1.454.CMB.1.raw
  modified_base (528)..(528): a, c, t, g, unknown or other
  misc_feature (528)..(528): n is a, c, g, or t
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggattttcctcggtgctcttttaaaaggtgtccagtgtgggtgcaccgtgatggagtcgtgggggagcctcgaataaacggcccggggggttacccttaaactctcctgcgcagcgtctggtacttttccttacgagtactaagtcgtaggaataagcgtcgggtccgccgacggcctccgaggggagtcggggccgtgggtaggttggggttcggtaccggtgtaccgaaaggaggtcgaaacggtaactggtaagttgggtcgacgacctatcctagtaacctacgtactcgacccgaccggtaaggaaacgtaccgaataccgttaccaaccgtaactccgtaaccgaacggtaaacgattaggtaacctttaanaaaaactttaaacgttaagttaacgttaaaccttaacgtttaaacttaaccttaaaaccgtaaagttaaacgggtatttaaaccggaaccgttaaagtaaaacgttaaccggaaaggttaaacgttaaccggttaggttttaacttttaacgtttaccgtttacgttaacccgtaacggttaaagggaacggtttcggtaacgggttttccgacgggttacggggtacggtaaacggtaaccggtaagtttacgggttacgttaacg

SEQ ID NO: 28251 - DNA, 234 bp, Homo sapiens
  misc_feature: GYAE6OF02IWMA7.47.78.H01.1.454.CMB.1.raw
  modified_base (230)..(234): a, c, t, g, unknown or other
  misc_feature (230)..(234): n is a, c, g, or t
tcagagctcacgtacacgaccggtgctcgatttagtgtgagtagtttgggtttgggcggagggaccaaactgaccgtcctaggcgcagtctgggtctctcacccttgttctggtctggcctcctcagtctgggttcttgtcggaacaggtcagcccaaggctgccccctcggtcactctgttcccaccctcctctacgtgagctctgagcgggctggcaaggcgcatagnnnnn

SEQ ID NO: 28252 - DNA, 606 bp, Homo sapiens
  misc_feature: GYAE6OF02ISCRG.47.78.H01.1.454.CMB.1.raw
  modified_base (260)..(260): a, c, t, g, unknown or other
  misc_feature (260)..(260): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (463)..(463): a, c, t, g, unknown or other
  misc_feature (463)..(463): n is a, c, g, or t
  modified_base (511)..(511): a, c, t, g, unknown or other
  misc_feature (511)..(511): n is a, c, g, or t
tcagagctcacgtacacgaccggtgctcgatttagtgtgagtagtttgggtttggggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtcgtgggggaggcctcagtaaaggccgggggggtcccttaaacgtctcctgcncagcgtctggatttccttcagtcaagtctggataagctgggtccgccaggctccgagggagtcggggccctgggaggttggggttcggcccggttgtaccgaaggtgacaggaacctgagtggtgcgacatctagaactacgctgccaccgtagaagcagacttcgacntcncagatangtaatacaaataatatgtacattntacctaagaatggatacgacctaagaaatcggaagtatacgtaggttntttaacgtcgttacgttaccacggtaagggtacgttggtaccgtttccgtacggtaccgggggaccggtaggaacgtaacggttggactttacgg

SEQ ID NO: 28253 - DNA, 377 bp, Homo sapiens
  misc_feature: GYAE6OF02H0CTR.47.78.H01.1.454.CMB.1.raw
  modified_base (84)..(84): a, c, t, g, unknown or other
  misc_feature (84)..(84): n is a, c, g, or t
  modified_base (145)..(145): a, c, t, g, unknown or other
  misc_feature (145)..(145): n is a, c, g, or t
  modified_base (308)..(313): a, c, t, g, unknown or other
  misc_feature (308)..(313): n is a, c, g, or t
  modified_base (316)..(319): a, c, t, g, unknown or other
  misc_feature (316)..(319): n is a, c, g, or t
  modified_base (321)..(377): a, c, t, g, unknown or other
  misc_feature (321)..(377): n is a, c, g, or t
tcagagctcacgtacacgaccggtgctcgattttagtgtgagtagtttgggtttggggccagttttctctgaatcaaaacccgngaccggccggcggacagcctcggcccctcggggcccagaaaccctgggtcaccgtctcctnagcttccaccaagggcccatcggtcttaccccctggaccgcccctgcctccaggagcacctcgtggggggaccacgaggccggccccttaggggctgccctggtacgaaaggcttacttcctaatgtatactctgagtcgggcctggcaacgggcgcagtagnnnnnntannnngnnnnnnnnnnnnnnnnnnnnnnnnnnnnnnnnnnnnnnnnnnnnnnnnnnnnnnnnn

SEQ ID NO: 28254 - DNA, 713 bp, Homo sapiens
  misc_feature: GYAE6OF02JE2TP.47.78.H01.1.454.CMB.1.raw
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggtacttttcctcggtgctctttaaaggtgtcagtgtgggtgcactgatggagtcgtggggaggtcctacgaagtaacggccggggggtaccttaaactctcctcgcgacgagtcgtacgtggtactttccttacgacgtactaacgttcgtaggtactaacgtacgtacgggtccgccgacggtcctacggagggtacgtcgggtccgtgggtaggttcggggtcggtcggtacggtacgaaggacgacgaacggtaacgtacggtaagtcgggtacgacgacgtagtacgtagtaactaccgacgtacgaccgtaccggtacgaaacggcgtacgtactaccgtaaccgtactcccgtaacgaacggtaagtacgtaattactaacgtaaaagttaataacttaggtaactagttactaactaacgtaagtaaggtactaacgtaccgtaagtaaacgtcgaagtactaagtacggttattacgtactacgttacgaacggtggtaacgtcggttacgtcggttggacgggtacgtaggtaacgtaggttacgtagtacgg

SEQ ID NO: 28255 - DNA, 780 bp, Homo sapiens
  misc_feature: GYAE6OF02FRB9R.47.78.H01.1.454.CMB.1.raw
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtcgtgggggacggcctcataaaggcccgggggggtccctaaactctcctgcgcagcgtctggatttcctttcagtcaagtctaggataagctagggtccgccaggcctccgaggggatcgggaccgtgggtaggttcggggttcgggccggttggtcgaaacggtacggaccgaacgaaccgttggaaggtgggttaggaccgtacattcgtaggtaaactacggtctacggaccgaaccccgtagtaaaacgggctaggtacgttacctaacccgtactccgtacccaaggtaacgtacgttacggtatttaacgtaaaagttaaaacttacgttacgttaactaacttaacgtaccttaaacgtaaacgttaacgggtaacttaacgaaccgttaagtaaaaacgttacggaaggtaacgttaacggtaacggtttaacgttttaacgtttaaccgttacggtttaacccgaacggttaagggtaaccgttacggttacccggttaccgtttacgggttaccgggggtaccggtaacgggggtaactaacggttacggttaccgtttaacgg

SEQ ID NO: 28256 - DNA, 796 bp, Homo sapiens
  misc_feature: GYAE6OF02IPZNY.47.78.H01.1.454.CMB.1.raw
tcagagctcacgtacacgaccggtgctcgatttagtgtgagtagtttgggtttgggggggagaggagccccagccttgggattcccaagtgttttcattcagtgatcaggactgaacacagaggactcaccatggagtttgggactgagctgggttttcctcgttgctcttttaagaggtgtccagtgtcaggtgcgccgtggtggaggtcgggggagcggtggtccagcctgggacgtcccgtgacgactcgtcctgtcgcacgcctcgtggccttcgaccttacgaaataattaagtgactactgacgtaggtcgggttaccctccgaacggtccgttaccgacgggtaccggaagggggtacccgtaaggtacgggttggggtacgggtaccgggttaactagttaaccgtccggtaccgtaaggttacggaaccttacgttcgtacgtaacgttaacgttaccgcgtaacggtacccttacccgtagggtacccggggtacccttacgtttacccgaaccgtaccgtacccgtaccgtaaccgaaacgtaacccgtaaaccgtttacccgaaacgtaaaccggttaccgtacgttaacgttaccgtaccgaccgtacccgtacgaaacccgcgttaaccgacggtaaaccgaacgtccgggaacctaccggttacctccttacccgttaacgttacgtaccgtcggttaccgacggtaacggaggttaccggtcgtaacggttacttacggttacgtttaacggcggtaagttcccggttagtacccccggg

SEQ ID NO: 28257 - DNA, 284 bp, Homo sapiens
  misc_feature: GYAE6OF02H68YZ.47.78.H01.1.454.CMB.1.raw
  modified_base (269)..(284): a, c, t, g, unknown or other
  misc_feature (269)..(284): n is a, c, g, or t
tcagagctcacgtacacgaccggtgctcgatttagtgtgagtagtttgggtttgggggtgatcactactactactactacatggacgtctggggcaaagggaccacggtcaccgtctcctcagcttccaccaagggcccatcggtcttccccctggcgcccctgctccaggagccacctcgtgggggcacagcggccctgggctgcctggtacaaggacctacttcctacgtgacgtctctgacggcggtcgtggacgaaggcgcatgnnnnnnnnnnnnnnnn

SEQ ID NO: 28258 - DNA, 736 bp, Homo sapiens
  misc_feature: GYAE6OF02FS2N9.47.78.H01.1.454.CMB.1.raw
  modified_base (302)..(302): a, c, t, g, unknown or other
  misc_feature (302)..(302): n is a, c, g, or t
tcagagctcacgtacacgaccggtgctcgatttagtgtgagtagtttgggtttggggggggagaggagccccagccttgggattcccaagtgttttcattcagtgatcaggactgaacacagaggactcaccatggagtttgggctgagctggattttcctcggtgctcttttaaaaggtgtccagtgtggggtgcaccgtgatggagtctgggggagcctcataaaggccggggggtccttaactctcctgcgcagcgtctggatttccgttcagtcaagttctggataagctagggtccnccgaggcctccagggatggccctggtacggtgggttcgggccgtggtccgaagaggacagtaacgtgagttcgggtagccgagtactcgttacggaactaacggtctaggaccgtacccggttaggaaaacggcgtacggtaacgttaccgaacccgtaagttcctacccgaagtacgtaagtcgtaactttacgaaacgttaaaattactacggttcctaagtttactacgttaaactaaagtacggtaagtaacgtacccgttaagaaaacgttccggaaggtactttaaaccgggtaggttaacgtttttaagttaccgtttacggttcccgttaaccggtaagggtaacgttccggtaccgggttttacgtacccggttcgggggttacccgggacgggttaaccgtaacggtacggttaccgttacggg

SEQ ID NO: 28259 - DNA, 772 bp, Homo sapiens
  misc_feature: GYAE6OF02IY98Y.47.78.H01.1.454.CMB.1.raw
  modified_base (223)..(223): a, c, t, g, unknown or other
  misc_feature (223)..(223): n is a, c, g, or t
  modified_base (545)..(545): a, c, t, g, unknown or other
  misc_feature (545)..(545): n is a, c, g, or t
tcagagctcacgtacacgaccggtgctcgatttagtgtgagtagtttgggtttggggggagaggagccccagccttggattcccaagtgttttcattcagtgatcaggactgaacacagaggactcaccatggagtttgggctgagctggtattttccgtcggtgtctacgttttaaaaggtgtccagttggtgggtgcaccgtgagtggagtcggtaggggngccgtacgagtaacggccgggggttaccttaaacgtcgtaccgtgcgcgacgcgtcgtggtactttccttcagtctacgtcgtaggtaagtacgtcgtacggtccgcaggtcctcgagggcgttcgggccgtgggtaggttcgggttacggtccgtggtacgaagacgacgaacgtaacgtggtacgtggtacgcgaacgtgttacgtagtaacttacgcgtacgaccgtaacccggtagaacggtcgacgtaacgtaccgacttacgttacccgacgaaaggctaagtacgttaacgaacttaaagtaacgtgttaacgtnttaacctttacgaaaccgttagtaaagttccggtagttaaacgacccgtttaaagaaaccgtttggaaacggttaacgttaacggttaaccggtttttagtttaaacttaccggttaccgttaaccggaaaaggttaccgggaatttccccgggggtaaccttacggttaccgggttaccgggacccggttaacgggtaacttaacgggtttccggtacgtttaccg

SEQ ID NO: 28260 - DNA, 790 bp, Homo sapiens
  misc_feature: GYAE6OF02G6ZPK.47.78.H01.1.454.CMB.1.raw
tcagagctcacgtacacgaccggtgctcgatttagtgtgagtagtttgggtttgggggggagaggagccccagccttgggattcccaagtgttttcattcagtgatcaggactgaacacagagactcaccatggagttggctgagctggattttcctcggtgtcttacgttttaaaaggtgtccagtggtggggtgcactgatggagtcgtgggggagcctcgaagtaacgggtcccggggggtacccttaaacctcctccgtcgccgcgacggtcgtcgtggtacttttccttcgtagtactaacgtcgtaggtaatacggtcgtcgggtcccgccgtaacggcctaccggacggggtagtccggggtacgttggggtaagggttcggggttcgggtcccggtaggtacggaacggacggacgaaacggtaaccgtggtagttcgggtacggacgtaacgtagtcgtaagaacgtacgtcgtacggacctacccggtaaggtaaaacggcgaagtaccttacccaacctacgtaccctaccgtaacggaagtagttaacgtaaattaaccgaaaattaaaccgtagtttacgtaactaagttactaaccttaactaaaggtagtaacgtacgtaccgttaaagaaaagttcggtaagtagttaacgtagttttacgtttaataccggttacttaaccggtaacgtaagggtacgttccgggttacggttccggtttacggacccgggggtacggtaacgggtaacttaacgggttcgggttattaccgg

SEQ ID NO: 28261 - DNA, 153 bp, Homo sapiens
  misc_feature: GYAE6OF02HII4C.13.29.C07.1.454.CMB.1.raw
  modified_base (153)..(153): a, c, t, g, unknown or other
  misc_feature (153)..(153): n is a, c, g, or t
tcagtcacgtactacacgaccggtgctcgatttagagtgctacgaagggaaagggacacgactggagattaaacgaactgtggctgcaccatctgtcttcatcttcccgccatctgatagtacgtgactgagcgggctggcaaggcgcatagn

SEQ ID NO: 28262 - DNA, 498 bp, Homo sapiens
  misc_feature: GYAE6OF02HSQ6Y.13.29.C07.1.454.CMB.1.raw
  modified_base (470)..(471): a, c, t, g, unknown or other
  misc_feature (470)..(471): n is a, c, g, or t
  modified_base (474)..(498): a, c, t, g, unknown or other
  misc_feature (474)..(498): n is a, c, g, or t
tcagtcacgtactacacgaccggtgctcgatttagagtgctacgaagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgaccccgtcggggcccgggaaccctggtccaccgtctcctcagcctccaccaagggcccatccgtccttccccctggccaccctcctccaacgagccacctcgtcggggggcacgacgccgggccctcgggctcgcccgttggtacgaaggaccttaccgttacctagtacgtcgtactcgtaggcgggccgtggcgaaggccgcatcgnnacnnnnnnnnnnnnnnnnnnnnnnnnn

SEQ ID NO: 28263 - DNA, 632 bp, Homo sapiens
  misc_feature: GYAE6OF02JYI81.13.29.C07.1.454.CMB.1.raw
  modified_base (198)..(198): a, c, t, g, unknown or other
  misc_feature (198)..(198): n is a, c, g, or t
  modified_base (257)..(257): a, c, t, g, unknown or other
  misc_feature (257)..(257): n is a, c, g, or t
tcagtcacgtactacacgaccggtgctcgatttagagtgctacgaagggaaagggagagctgctcagttaggacccagagggaaccatggaaaccccagcgcagcttctcttcctcctgctactctggctcccagataccaccggagaattgtgttgacgcagtctccaggcaccctgtctttgctccgagggaaagngccaccctctcctgcagggccagtcagagtgttagcagcagctattagccttggtaccngcagaacctggccaggccccacgacgtcctccatctaccgagtattagtctacggacggacgacctagcaactccacgagaccgtagtacggagtgacgtagggtcgtagacgtacgacgttactctaccgtctaaccgacgtctacgacgtacgaacgtacgtaccgtaacgtagtaaaccgttgtacgttaacctttcgtttactttacgtacctaccgtacgtagttacgggtactccggtacccgttaacttcggtttacggtaccggaccggtacggtactcggttagacggtaactagtacgacgtcgtacgtcggtagtacctacgtacgacgtacgttacgccgtttagccttaccgttacccgtcg

SEQ ID NO: 28264 - DNA, 577 bp, Homo sapiens
  misc_feature: GYAE6OF01CCAMZ.39.16.B05.1.454.CMB.1.raw
tcagtcgcactagtcacgaccggtgctcgatttagagctcacgtaagggcgtgggcctcaggaagcagcatcggaggtgcctcagccgactggcatggactcccgtctcttcctcggcgtccttgcttactgcacaggatccgtggcctcctatgagctcgtctcagccaccgctcagtgtccgtgtccccgaggacagacagccagcatcacctgctctaggaaatacattaggagtaataaagtatgacttgctggtaatcactacagaacgaccaggccagtcccctgtcgctgattcatactagtaccaaagtactaccgaaagccggtccctacgaaggggactccccgtggacgcgaattcctctacggtcctacccaaactcgtacgggaaacacgagacccactcgtagaaccctattcgaacggaccgggtaaccctagggcctaagtaggactagaagcgtagactaattagtcgtagacggtgtagggacaggtgaggacgaaaggggtgtaccggaggacggaccaagtctacgacccgtacctaggtcacggtcccgtaaacgg

SEQ ID NO: 28265 - DNA, 618 bp, Homo sapiens
  misc_feature: GYAE6OF01B137B.39.16.B05.1.454.CMB.1.raw
  modified_base (340)..(340): a, c, t, g, unknown or other
  misc_feature (340)..(340): n is a, c, g, or t
  modified_base (388)..(388): a, c, t, g, unknown or other
  misc_feature (388)..(388): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgtggtttccgtgtgctattttagaaggtgtccagtgtgaggtgcagctggtggagtctgggggaggcttgggtccagccgtggggggtccctggagactctcctgtgcagcctctggattcacctttaggaactattggatgagttgggtccgccaggctgcaggggaagggctggagtgggtgccaanataggaggtagatgggaaagagaaggaaatactaatgtgggaaccttntggtaggaacggggaccgtaagtttaccaagttctaccgaagaagaacaaaccgacaaagtaaacttacaccttagtattttaacgaaattacgaaactagaccctagaagacgaccggaacggaacgacgtctaggttactaccttagttcggtagacgggaaaggggggcctagggtgggacgtggggactacgggtcggggacccggaacggggtaaaccccccggg

SEQ ID NO: 28266 - DNA, 521 bp, Homo sapiens
  misc_feature: GYAE6OF01BXBRP.39.16.B05.1.454.CMB.1.raw
  modified_base (501)..(501): a, c, t, g, unknown or other
  misc_feature (501)..(501): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttaggaactattggatgagttgggtccgccaggctgcaggggaagggctggagtgggtggccaacatagaggtagatgggaagagagaaatactatgtggactctgtgaagggcgatcacatctccagagacaacgaccaagaatcactgtatttacaaatgaacagcctgagagcgaggacacgtctgtatatattgtgacggaaagggggcaggtggcgtgggntacgtggggccgaaccgggg

SEQ ID NO: 28267 - DNA, 472 bp, Homo sapiens
  misc_feature: GYAE6OF01BZMX5.39.16.B05.1.454.CMB.1.raw
  modified_base (377)..(377): a, c, t, g, unknown or other
  misc_feature (377)..(377): n is a, c, g, or t
  modified_base (437)..(437): a, c, t, g, unknown or other
  misc_feature (437)..(437): n is a, c, g, or t
  modified_base (463)..(463): a, c, t, g, unknown or other
  misc_feature (463)..(463): n is a, c, g, or t
tcagtcgcactagtcacgaccggtgctcgatttagagctcacgtaagggctgggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagcggccctcagggatcccctgagcgattctctggctccaactctgggaacacagccactctgacccatcagcggacccnggctatggatgaagctgacttattattgtcaggtgtgggacagcagcaaggggtgtcggnggaggccagctgaccgtctaggtacngccgaacgg

SEQ ID NO: 28268 - DNA, 493 bp, Homo sapiens
  misc_feature: GYAE6OF01CJVRW.39.16.B05.1.454.CMB.1.raw
tcagtcgcactagtcacgaccggtgctcgatttagagctcacgtaaggggctgggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagcgccctcagggactccctgagcgattctctggctccaactcgtaggaacacacgccactctgaccatcacgcgggacccaggctagtggatgaagctgaactattattgtctaggtgtgggacaggcagacgtaaggggtgtcgggagggagggaccaaggctaggacccgtactaggtcaggccctaacggg

SEQ ID NO: 28269 - DNA, 527 bp, Homo sapiens
  misc_feature: GYAE6OF01DPLZ9.39.16.B05.1.454.CMB.1.raw
  modified_base (122)..(122): a, c, t, g, unknown or other
  misc_feature (122)..(122): n is a, c, g, or t
  modified_base (125)..(125): a, c, t, g, unknown or other
  misc_feature (125)..(125): n is a, c, g, or t
  modified_base (130)..(130): a, c, t, g, unknown or other
  misc_feature (130)..(130): n is a, c, g, or t
  modified_base (139)..(142): a, c, t, g, unknown or other
  misc_feature (139)..(142): n is a, c, g, or t
  modified_base (149)..(149): a, c, t, g, unknown or other
  misc_feature (149)..(149): n is a, c, g, or t
  modified_base (151)..(152): a, c, t, g, unknown or other
  misc_feature (151)..(152): n is a, c, g, or t
  modified_base (161)..(161): a, c, t, g, unknown or other
  misc_feature (161)..(161): n is a, c, g, or t
  modified_base (167)..(167): a, c, t, g, unknown or other
  misc_feature (167)..(167): n is a, c, g, or t
  modified_base (169)..(169): a, c, t, g, unknown or other
  misc_feature (169)..(169): n is a, c, g, or t
  modified_base (173)..(173): a, c, t, g, unknown or other
  misc_feature (173)..(173): n is a, c, g, or t
  modified_base (176)..(176): a, c, t, g, unknown or other
  misc_feature (176)..(176): n is a, c, g, or t
  modified_base (180)..(180): a, c, t, g, unknown or other
  misc_feature (180)..(180): n is a, c, g, or t
  modified_base (185)..(185): a, c, t, g, unknown or other
  misc_feature (185)..(185): n is a, c, g, or t
  modified_base (190)..(190): a, c, t, g, unknown or other
  misc_feature (190)..(190): n is a, c, g, or t
  modified_base (270)..(270): a, c, t, g, unknown or other
  misc_feature (270)..(270): n is a, c, g, or t
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
tcagtcgcactagtcacgaccggtgctcgatttagagctcacgtattgggtttgaggtctcagagaggagccttagccctggactccaaggcctttccacttggtgatcagcactgagcgcnggngagcncatgatggnnnntgttctntnntattgagtntcagtngngtgnagntggngagtntgggngctgtcagccgtgggggtcctgagctctcctgtgcagcctctggtattcacctttaggaactattggatgagttgggccncgaggctgacaggggagggctggagtgggnggaccaanatagaggtagagtaggaagagaagaaatactagtgtgacttntgtagagggcattcacatcncagagacacgcaagatcacgtntattacaatgaactagcgtagagagaccgagtacagtctgaacttactagttgtaggacgggtaaaggggggcctaaagggtcgggtacggttcggggtaccgttaccggtcggggggaccgtaaaccccggggg

SEQ ID NO: 28270 - DNA, 555 bp, Homo sapiens
  misc_feature: GYAE6OF01D0EN2.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgcttattttagaaggtgtccagtgtgaggtgcagctgggtggagtcgtggggggaggcttggtccagccgtggggggtccctggagactctcctgtgcagcctctggattcacctttaggaactattggatggagttgggtccgccaggctgcgaggggaggggctgggagtgggtggccaacgatagaggtagatgggaaagagaagaaatactatggtggactcgtgtgaagggccgattcaccatctccagagaacaacgccaagaattcacttgttaatttaacaaatgaacagcctagagagaccgaggacacgtctgtatactattggtgagggaagggggcgaggtggcgtggggactacggcggggccgacggggtaacccccgg

SEQ ID NO: 28271 - DNA, 575 bp, Homo sapiens
  misc_feature: GYAE6OF01CL431.39.16.B05.1.454.CMB.1.raw
  modified_base (342)..(342): a, c, t, g, unknown or other
  misc_feature (342)..(342): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcttggtccagccgtggggggtccctgagactctcctgtgcagccctctggattcacctttaggaactagtggatgagttgggtccgccaggctgcaggggaaggggctgggagtggggtgccaanagtaggaggtagagtggaaagaggaagaaatactagtggtggacttcgtagtggaagggccgattccaaccgtatcctaccagaacgaccaacgacccaagaacttcactgtaatttacaaatgaacagacctaggacgagccggaggacacgtctagtatactattggtcgagggaaagggggcaggtgggcgtcggggcctaggtcggggcctaacggggtaacccccggg

SEQ ID NO: 28272 - DNA, 576 bp, Homo sapiens
  misc_feature: GYAE6OF01APILY.39.16.B05.1.454.CMB.1.raw
  modified_base (502)..(502): a, c, t, g, unknown or other
  misc_feature (502)..(502): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtggggggaggcttggtccagccgtggggggtcccctggagactctcctgtgcagcctctggattcacctttaggaactattggatgagttgggtccgccaggctgcgaggggagggctgggagtgggtgccaagagtaggaggtagagtagggaagagaagaaatactatgtggactcgtagtggaagggccgattcaccatcctaccaagacgaacaacgaccaaagtaactcactagttaactttaacaaagttcgaaacacgtctagaagacgaccgaggacacgtntagtattactagttggtaggacgggaaagggggcgaggtcggcgtagggctacggtcggggccgaacccggggg

SEQ ID NO: 28273 - DNA, 533 bp, Homo sapiens
  misc_feature: GYAE6OF01CWP57.39.16.B05.1.454.CMB.1.raw
  modified_base (414)..(414): a, c, t, g, unknown or other
  misc_feature (414)..(414): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcacctttaggaactattggatgagttgggtccgcaggctgcgaggggaagggctgggagtgggtggaccaacagtagaggtagatgggaagagaagaaatactaatgtggactctgtagaagggccgattcaccatctcaganacaacgcaagatcatgtattacaaatgaacagcctagagacgacgagacacgtctgtatactagttgtagacggaaagggggcaaggtggacgtgggactacgtggggccgaaccgggg

SEQ ID NO: 28274 - DNA, 547 bp, Homo sapiens
  misc_feature: GYAE6OF01AMFI4.39.16.B05.1.454.CMB.1.raw
  modified_base (338)..(338): a, c, t, g, unknown or other
  misc_feature (338)..(338): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcagctggtggagtcgtgggggaggcttggtccagccgtggggggtccctgagactctcctgtgcagcctctggattcacctttaggaactattggatgagttgggtccgcaggctgcagggagggctggagtgggtggccaanatagaggtagatgggaagagagaaatactatgtggacttcgtggtgaaggggccgattcaccatctcagtagacaacgccaagattcactgtattacaaatgaacagcctagacgagccgaaggacacgtctgttaactactaagttggtaggacggtaaaggggggctagggtggtcgtggggctacggtcggggccgtaaccggggg

SEQ ID NO: 28275 - DNA, 552 bp, Homo sapiens
  misc_feature: GYAE6OF01BGEQ1.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttaggaactattggatgagttggggtccgccgaggctggcgaggggaaggggctgggagtggggtggccaagatagaggtagatgggaaagagaagaaatactaatgtggactctgtggaagggccgattcaccatctccagagacaacgccaagaacttcactgtatttaacaatgaacagcctgagagaccgaggacacgtctgtactactattggtggacgggaaagggggcaggtggcgtggggctacggtcgggggccgaacggggtaacccccgg

SEQ ID NO: 28276 - DNA, 539 bp, Homo sapiens
  misc_feature: GYAE6OF01EJZ09.39.16.B05.1.454.CMB.1.raw
  modified_base (338)..(338): a, c, t, g, unknown or other
  misc_feature (338)..(338): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttaggaactattggatgagttgggtccgccaggctgcgaggggaaggggctgggagtgggtggaccncaacatagaggtagatggaagagagaaatactatgtggactcgtaggtgaagggccgattcacatctcagagacaacgacaagaattcactgtaatttaacaaatagaacagcctagagagaccgagacacgtctgtatactagttgtaggacggaagggggcaggtggacgttgggactacggtggggcccgaaccgggg

SEQ ID NO: 28277 - DNA, 671 bp, Homo sapiens
  misc_feature: GYAE6OF01CORQE.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggtttccttgttgctattttagaaggtgtccagtgtgaggtgcagctggtggagtcgtgggggaggcttggtccagccgtggggggtcccctggagactctccgtgtgcagcctctggattcacctttaggaactattggatgagttgggtccgcaggctgcgagggaggggctgggagtgggtggccaacgagtaggaggtagagtagggaagagaagaaatactagtggtagacttcgtagtaggaacgggccgtaacgttccgaccacttccgtaccaggaacgaacgaaaccgaccaaagtaacgttacaacgttagttaactttaacaaaagttacgaaacgtacgacccgttaggaacggtacggaccggagggaacctacggttacttaggtaacttacgttagtttagggtcggtaacgggggaaacggggggtctaggggtacgggtccgggtacggggtaccgttaaccgggttcgggggaaccccgtaaccggggggttaacccccccggg

SEQ ID NO: 28278 - DNA, 608 bp, Homo sapiens
  misc_feature: GYAE6OF01DRYGE.39.16.B05.1.454.CMB.1.raw
  modified_base (229)..(229): a, c, t, g, unknown or other
  misc_feature (229)..(229): n is a, c, g, or t
  modified_base (239)..(239): a, c, t, g, unknown or other
  misc_feature (239)..(239): n is a, c, g, or t
tcagtcgcactagtcacgaccggtgctcgatttagagctcacgtaaggggctgggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattagganataaatatgnttgctggtatcagcagaacgccaggccacgtcccctgtcgctgatcatctaatacaagactaccaagccggccctcgacggactcccgagacgcgtattcctcgtcgcctaccaactcgtacggaacacgacgaccactcgtacgaccctagtacgacggacccgggacccgaggtacctaagtacgggtatacggaacgtcgtacgtaacgttaagtttagttcggttacgtagggttcggttacgggacgtaggacgtaaggacggtaaagggggtcggttaccggggacgggtaacggggaccgtaacggtaccgtacggtaccccggttaccgtaacgggtaccgacggtaccccggtaaccggg

SEQ ID NO: 28279 - DNA, 701 bp, Homo sapiens
  misc_feature: GYAE6OF01CY4QQ.39.16.B05.1.454.CMB.1.raw
  modified_base (200)..(200): a, c, t, g, unknown or other
  misc_feature (200)..(200): n is a, c, g, or t
  modified_base (268)..(268): a, c, t, g, unknown or other
  misc_feature (268)..(268): n is a, c, g, or t
  modified_base (325)..(325): a, c, t, g, unknown or other
  misc_feature (325)..(325): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcggtggtttcgtcgtaggctattagtaaggtgtcagtgtgaggtgcgagngtggtggagtggtgggggaggtcgttggtaccaggccggtggggggtccctgagctcgtcctggtgcncgtcctcgtagtacttacgtacgtttaaggacttagtggtagtggtacggtcggccncgtgcgtgacgggagggaggtcgtaggcggtgggtcggacgacgtagtaggaggagagtaggaaggaagaagtaagtaagtagtagtacggtacgtacgtaggtacggtacggtaccgtaccgtaccgtaaccgtacgtacgtaccgtaacgaacgaacgtaacgtacgtaacgtaaacgtaactacttacgttaacgttaacgttaacgtaacgtaacgtaacgtacgtaacgtaggacggtacggaacgacgtaacgtacgtacgttacgttacgttacgttacggttagggtacgggtaacggggtaacggggtacgggtacgggtacgggtacgggtacgggtacgggtaccgggtaccggggtacccgggg

SEQ ID NO: 28280 - DNA, 588 bp, Homo sapiens
  misc_feature: GYAE6OF01AP7JU.39.16.B05.1.454.CMB.1.raw
  modified_base (518)..(518): a, c, t, g, unknown or other
  misc_feature (518)..(518): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctggagctctcctgtgcagcctctggtacttcctacctttaggaacttagttggatggaggttcgggtccgccgaggctggcgaggggaaggggctagggaggtggggtcgaccaacagtaggaggtagagtagggaagagaagaaatactagtgtggactcgtggtaggaacgggccgtattccgacctactcctacgagacgaacaacgaccaagtaattaccacgttagtaactttaacaatacgaactagacctagagtacgcgaagacgacgtntagtatacgtagtgtaggacggaagggggcaggtggcgtgggctacggcggggccgaccgggtaccccgg

SEQ ID NO: 28281 - DNA, 545 bp, Homo sapiens
  misc_feature: GYAE6OF01CA5CJ.39.16.B05.1.454.CMB.1.raw
  modified_base (338)..(338): a, c, t, g, unknown or other
  misc_feature (338)..(338): n is a, c, g, or t
  modified_base (355)..(355): a, c, t, g, unknown or other
  misc_feature (355)..(355): n is a, c, g, or t
  modified_base (497)..(497): a, c, t, g, unknown or other
  misc_feature (497)..(497): n is a, c, g, or t
  modified_base (525)..(525): a, c, t, g, unknown or other
  misc_feature (525)..(525): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgtggtttccttgtagctattttagaaggtgtccagtgtgaggtgcagctggtggagtcgtgggggagcttggtccagccgtggggggtccctgagacgtctcctgtgcagcctctggattcacctttaggactattggatgagttgggtccgccaggctgcgagggagggctggagtgggtgccaantagaggtagatgggaanagagaaatactagtgtggactcgtggtgaacgggccgtattacacctatcgtaccagtaagaccaacgaccaagtaactcacttgtaatttacaaatagaacgagacctagagagccgaggacacgtctagtatatagttgngacggaaggggctaggtcgtcgtcgggntacggtgggccgtaccgggg

SEQ ID NO: 28282 - DNA, 539 bp, Homo sapiens
  misc_feature: GYAE6OF01DTZCH.39.16.B05.1.454.CMB.1.raw
  modified_base (229)..(229): a, c, t, g, unknown or other
  misc_feature (229)..(229): n is a, c, g, or t
tcagtcgcactagtcacgaccggtgctcgatttagagctcacgtaaggggctgggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattagganataaatatgcttgctggtatcagcagaagccaggccagtcccctgtgctgatcatctatcaagactaccaagcggccctcagggactcccgtgagtcgattctctggcctccaactcgtagggaacacacgccactctcgaccatcaggccgggacccaggctagtggatgaagcgtgtacttattattgtcgtaggtgtagggactagcgaaggacgaaaggggttcggttacggggacgggaacgggacccgtaaggtccgtacggtacccggttaccgtagggtacccacggaccccgtaaaccggg

SEQ ID NO: 28283 - DNA, 535 bp, Homo sapiens
  misc_feature: GYAE6OF01D09G6.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttaggaactattggatgagttgggtccgccaggctgcaggggaagggctggagtgggtggccaacatagaggtagatggaagagagaaatactatgtggactcgtgtgaagggccgattcaccatctccagagacaacgaccaagaattcactagtatttaacaaatagaacagacctgagtagaccgaggacacgtctgtatactattgtgaggaagggggcaggtggcgtgggctaggtcggggccgaggggtaacccccgg

SEQ ID NO: 28284 - DNA, 172 bp, Homo sapiens
  misc_feature: GYAE6OF01CVT0D.39.16.B05.1.454.CMB.1.raw
  modified_base (171)..(172): a, c, t, g, unknown or other
  misc_feature (171)..(172): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgggctggcaaggcgcatagnn

SEQ ID NO: 28285 - DNA, 538 bp, Homo sapiens
  misc_feature: GYAE6OF01DSLQJ.39.16.B05.1.454.CMB.1.raw
tcagtcgcactagtcacgaccggtgctcgatttagagctcacgtaaggggctgggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctgaaatacattaggagataaatatgcttgctggtatcagcagaagccaggccagtccctgtgctgatcatctatacaagactaaccaagccggcctcgacgggtctcccgtgagcgtattcgtctcgctaccaacgtcgtacgggaacacacgccactcagaccatcgaagccggacccagcctatggatagaagtctagtaactactttagttcgtacgtagggtgtagggactaggacgagaccggtaaaggggttcgggtacggtacggggacggaaccgaacggtcgtacggtaccgtaccgtaggtcacgcccgtaacggg

SEQ ID NO: 28286 - DNA, 603 bp, Homo sapiens
  misc_feature: GYAE6OF01BTDJF.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccgagccgtggggggtccctgagactctcctgtgcagcctctggattcacctttaggaactattggatgagttgggtccgccaggctggcgagggagggctgggagtggggtgacaacgagtaggaggtagagtaggaagagaagaaatactagtgtggactcgtggtagaagggccgtattcaaccatcctaccaagacgaacgaaccgacctaaagtaattaccaacttagttaactttaacaaatagaaacacgtactagaacgagaccggagacgtaccgtagtacgttaatacgttagttggtaggaagggaaacgggggtctagggtggacgttacgggacgtacgggtcggggacccgtaaccccggggg

SEQ ID NO: 28287 - DNA, 804 bp, Homo sapiens
  misc_feature: GYAE6OF01C266X.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgacgctctcgtgtcgcacgtcctcgtaggtacttaccttaaccgtttaacggtaactttagttacggtagttaggtacgggtttcggggtccccgaccgagggtccgttagggaccgggaaaggggggaacgggggtccggttaggggtaggggtttgggggaccgggtaacccaaaaggtaaggttaagggtaaaggggttaaggaaggttaaggggaaaaggaaggtaaagtaaaacgttaacgtagtaggtacgggtacttcggtagggtaagggaacgggtccgtaacgttcccaaccgtacttaccgaccgtaacgaaccgaaccgtaaaccgaaccgtaaacgtaacttaccgtaacgtttagttaaacttttaaacaaacgtacgaaacgacgtaccgtaaggaacgaccggaacgacggaacctacgttcttaagttaactacgtttaagtcgggtaacggggaggggtaaacggggggtcgtaaggggtcgggtcggttacgggtaccggtaccgggtaccggggacccgggtaacccggggtaaccccccggg

SEQ ID NO: 28288 - DNA, 675 bp, Homo sapiens
  misc_feature: GYAE6OF01CKYEW.39.16.B05.1.454.CMB.1.raw
tcagtcgcactagtcacgaccggtgctcgatttagagctcacgtaaggggctgggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccacgtcccctgtcgctgatcatctatcaaagactaccaagccggccctcgacgggtactcccgtaggacgtcggtactttccgtcgtcgggacccttacccgtaaaccgttccggttaacgggggaaaccctaaccgtaacgtacccctaccgttaccgttacgaaacccctacgtaccgaacggcccggggaaccccgagggtaccttaacggtagggaacttaggaacgtacgttagtaacttaagtttacttcggttaccggtagggttacgggtacgggacgtacggacgtaagggtacggtaaaggggggtttcggttaccggggacggggaaacgggtacccgtaaacggtccgtacggtacccggttaccgtaacgggtacccgacgggtaccccgtaaccggg

SEQ ID NO: 28289 - DNA, 729 bp, Homo sapiens
  misc_feature: GYAE6OF01CS8KX.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggagcttggtccagccgtggggggtccctggagactctcctgtgcagcctcgtggattcaccgtttaggaactagttggatggagttcgggtccgccaggctgcgaggggagggctgggagtgggtcggaccaagagtaaggaggtaagagtaggggaaagaaggaagtaaaactacgtagtagggtaggaccttggtggtaggaacggggtcccgtaattacccaaccctaattcccgtaacccgaaggaaacgtaaaccgaaaccgggaaccctaaaaggtaaacctttaccgaaaccgtttaaggttaaacttttaaaccaaaattacgggaaaaccacggtacccttaggaaacgggacggacccggaaacgggaaccaccggttacttaggttaataaccgttaagttcggtacgggaacggggaaaacgggggggcctaaaggggtcgggtacggtggggtaccttaacgggtccggggggaccccgaaacggggggtaaaccccccccgg

SEQ ID NO: 28290 - DNA, 554 bp, Homo sapiens
  misc_feature: GYAE6OF01EVUMJ.39.16.B05.1.454.CMB.1.raw
  modified_base (430)..(431): a, c, t, g, unknown or other
  misc_feature (430)..(431): n is a, c, g, or t
  modified_base (440)..(440): a, c, t, g, unknown or other
  misc_feature (440)..(440): n is a, c, g, or t
  modified_base (459)..(459): a, c, t, g, unknown or other
  misc_feature (459)..(459): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcttggtccagccgtggggggtccctgagactctcctgtgcacgcctctggtattctacctttaggaacttagttggatgaggttcggtccgccgaggctggccaggggaaagggggcttggggagtggggtaggccaacgatagaggtagatgggaaagagagaaatactaatgtggactctagtgaagggccgattcaccatctcagnnacacacaanatacactatattataatanaacagactcgagagacgacggacgacgtctagtatactattagtaggtacggaaacgggggacggaggtggcggtgggcgtacggtcgggtacgg

SEQ ID NO: 28291 - DNA, 890 bp, Homo sapiens
  misc_feature: GYAE6OF01DOA9G.39.16.B05.1.454.CMB.1.raw
  modified_base (104)..(104): a, c, t, g, unknown or other
  misc_feature (104)..(104): n is a, c, g, or t
  modified_base (261)..(261): a, c, t, g, unknown or other
  misc_feature (261)..(261): n is a, c, g, or t
tcagtcgcactagtcacgaccggtgctcgatttagagctcacgtaaggggctgggcctcaggaagcagcatcggaggtgcctcagccatggcatggactccctntcttcctcggcgttccttgcttactgcacgaggtactccgtggccctacctatggagtctgtcctcgacgccacgtctcgaggtcgttccgtcgtaccccgaggaaccagacacgccagcactccactgctacgtaggaaatacgtagttaaggaanaattaaatgtcgcttgtacgtaggtactacgaagacgaaggaccgaccgtacggtaccctccgtcccgtggtacgcgtaagtacctaacgtacttaactacgtaacgaaacgtaaccgtaaccggaccggtcccgtaccgtaacggtaaccggtaccgtcccggtaaggtaccgtaacgttacgttccgtaccgtaaccgtacccttaccgtaaacggtaccgggaacccggtaaaccctcccggaaccccgtaacccgtaaccgtaccgtaaacgtaccgggtaaaccgggtaccgggtaaacgggggttaaccggaacggggttaccggggtaacgtaaccggggtaacccgttaccgttaaacgtttttaccggtaccgggttaagggttaccgggtagggttaccggtcgggtaaaagttaagggtaaagtaaaggtaaggtttacgggtaacgtttaaccgtttaagggtttaaaccggtttttaccggaaccggggttttaaacccggttaaacccggggaaacccggtttaaccggggaaacccccttttaaccgggggacccctttaaaaccggggttaacccgttccggaaaaccccggtaaccccgggtaaaacccccg

SEQ ID NO: 28292 - DNA, 744 bp, Homo sapiens
  misc_feature: GYAE6OF01EEHAV.39.16.B05.1.454.CMB.1.raw
  modified_base (249)..(249): a, c, t, g, unknown or other
  misc_feature (249)..(249): n is a, c, g, or t
tcagtcgcactagtcacgaccggtgctcgatttagagctcacgtaaggggctgggcctcaggaagcagcatcggaggtgcctcagccatggcatggactccctctcttcctcggcgtccttgcttactgcacaggctccgtggcctctatgagctgtctcacgccacgctcgagtcgtccgtcgtccccgaggacagacagccagcactcacctgctcgtaggaaactacagttaaggataattaaatntcgtacttgtacgttaggtactcagacaagaccgccgaggcccaccgttccctagtcgtccgtagtactctactacgttacaacctaaacggtacctaaccggaacgggtcccgtcccgtaaggaaccggggttacctacccggtaggaaccgtaccgttaacgtttcccgtacggtttccgggaaccctttaaccccgtaaaccggtttccggaaccgggtaaaccaccgtacccgtacccgtaaccgttccgtaaccggaacctacgtaccgggaacggtacccggaccgtacggtactacgtacggacgtacgaacgtacgtacttaacgttaacgttcgttacgggtacgtagggttacggacggtacgacgtacgggtaacggtaccgggggtaaagggttcccgggtacgggaaacgggtaccgggaacgtaccggtaccggtacgtaccccggtaggtaacccgccggtaaccgaccccgggtacggg

SEQ ID NO: 28293 - DNA, 602 bp, Homo sapiens
  misc_feature: GYAE6OF01EYF96.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttgggtccaggccgtggggggtccctgagactctcctgtgcagccctctggattcaccgtttaggaactattggatgaggtttgggtccgcgaggctgcgaggggaagggctgggagtgggtggccaaacgagtaggaggtagagtagggaagagaagaaatactagtgtggacttcgtggtaggaacgggccgtaattccaccatcctaccagacgaacaacgaccaaagaacttcaactagttaatttaacaatgaacagcctaggagagaccggagacgacgtcgtatactacttattgggtgaacggggaaacggggggctaagggtcggacggtcggggaccttacgggcgggggacccgaaccgggggtaaccccccgg

SEQ ID NO: 28294 - DNA, 586 bp, Homo sapiens
  misc_feature: GYAE6OF01DTT23.39.16.B05.1.454.CMB.1.raw
  modified_base (264)..(264): a, c, t, g, unknown or other
  misc_feature (264)..(264): n is a, c, g, or t
  modified_base (342)..(342): a, c, t, g, unknown or other
  misc_feature (342)..(342): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggagcttggtccaggccgtggggggtccctgagacctctcctgtgcagcctntggattcacctttaggaactattggatgagttgggtccgccaggctggcgaggggaggggctggagtgggtggccaantaggaggtagagtaggaaagagaagaaaattactatggtggacttcgtaggtggaaagggccgtaattccacctatctaccaagacgaacaaacgaccaaagtaacttcaacgtgttaatttaacaaatagaacagacctaggagacgaccgagactacgtctagtatactagttggtaggagggaaagggggcagggtcggcgtggggaccttagggcggggcccggacggggtaacccccgg

SEQ ID NO: 28295 - DNA, 672 bp, Homo sapiens
  misc_feature: GYAE6OF01CCXHD.39.16.B05.1.454.CMB.1.raw
  modified_base (459)..(459): a, c, t, g, unknown or other
  misc_feature (459)..(459): n is a, c, g, or t
tcagtcgcactagtcacgaccggtgctcgatttagagctcacgtattgggtttgaggtctcagagaggagccttagccctggactccaaggcctttccactttggtgatcagcactgagcacagaggactcaccatggaagttggggctgagtcgttgggtttttccttgttgtcttattttagaaggtgtccagtgtgaggtgcagctggtggagtcggtggggggagtcgttcggtccacggtccggttcgggggggtccccttgggacggtaccttccgttccgttggtcgccgacgtccccgttcgttgggtaactttcctaaccgtttttaagggtaaaccttagttggaatggtaggtttcgggtcccgcgaggctggcggaggggagggcgtgggaggtgggtcggaccaacgagttaggaggtagagtagggaagagaagaaatctagtgngtactgtggaggaacgggctatccacctatctaccgaagacgaacaacgacaaagtactactacttagttaacttaacaaagtacgaactacgtacgtaggaagacggacgaagacgtacgttatagtaatacttagttggtaggtaacggggaaggggtacgtagggtcggtcggtagggaccgttacgggcggggaccggtaaacccgggg

SEQ ID NO: 28296 - DNA, 534 bp, Homo sapiens
  misc_feature: GYAE6OF01BE5VX.39.16.B05.1.454.CMB.1.raw
  modified_base (408)..(408): a, c, t, g, unknown or other
  misc_feature (408)..(408): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtgggagtcgtgggggaggcttggtccaggcctgggggggtccctgagactctcctgtgcagcctctggattcacctttaggaactattggatgagttgggtccgccaggctgcaggggaaggggctgggagtgggtggccaacatagaggtagatggaagagagaaatactatgtgactctgtgagggcgattcacatctcaganacacgcaagatcactgtattacaatgaacagcctagagagccgaggaccacgtctagtatacttagttgtaggacggaaaggggggcaggtgggtcgtgggacgtacgtggggccgtaaccggggg

SEQ ID NO: 28297 - DNA, 833 bp, Homo sapiens
  misc_feature: GYAE6OF01DK2TB.39.16.B05.1.454.CMB.1.raw
  modified_base (428)..(428): a, c, t, g, unknown or other
  misc_feature (428)..(428): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgtggtttcttgttgcttattttagagtgtcagtgtgagtgcagcgtgggtggagtcggtgggggaggtcgttggtccaggcccggttcgggggggtcccctggacggaccttccgttccgtggtcgccgaaggtcccgttcgtggtactttccgtaaccgttttaggaaaccttagttaggtagttaggtacggtttcgggggtcccgccgtacggcgtggcggaaggggtaagggcgtagggaggtcggggtcgaccgaaacgaggtaggaggtanaggtaggaaagagaagaaatactagtagcggtaacctggtagttagggaacggtcgtactaccgtaccactacctaccgaagtaacgaaccgtaaccgaaccctaaagtaacttacctaaacgtttaacgttaacgttttaaaacgaaacgttaaccgtaaacgtaaccggtaccgttaacgggtaaccgaacccgggtaccggaacggtaacccgtaacccgggtttaccgttaaggttaaaccgttaaacgtttacgggtttacggggtaacggggtaaacggggtaaaacggggggggttaccgtaaacggggtttaccggggttaccgggttacgggggtaaaccccgggtttaccggggttaccccggggggaacccggttaaaaccccccccggggggg

SEQ ID NO: 28298 - DNA, 570 bp, Homo sapiens
  misc_feature: GYAE6OF01BS67A.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttgggtccagccgtggggggtccctgagactctcctgtgcagcctctggattcacctttaggaactattggatgagttgggtccgccaggctggcgagggaaggggctgggagtgggtggccaacagtaggaggtagagtaggaagagaagaaatactatgtggactcgtggtagaagggccgagttcacctatctacagagaaccaacgaccaagaattcactagtatttaacaaatagaacagacctagagagccgaaggactacgtctagtactactagttgaggacgggaaagggggtcaaggtgggcgtgggacgttacggtcggggcccgacggggtaaacccccgg

SEQ ID NO: 28299 - DNA, 882 bp, Homo sapiens
  misc_feature: GYAE6OF01COCA5.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagcttgggttttccttgttgcttattttagaaggtgtccagtgtgaggtgcagctggtggaggtcgtggggggaggcgttggtccgaggccgtgggggtccctggacgactcctcctgtcgcacgccttcgtggactttcctaacccgtttaggaaacctttagttggaagtggtagggtttcggggtccccgccgtagggccgtggaccggaaggggggtaaacgggggcgttaggggaagggttcgggggtacgggaccccaaaaggtaagtagggtaaagggtaaggaagtaaggggaaaaggaaggaaagtaaaaagtacgtaagttgggtacggtacttcgtaggtagggaacggggtccgtaagttcccaaccgtacttaccgtaccgaaggaaacgaaaccgaaaccgtaaccgaaaacggtaaactttaccgtaacgttaacgtttaaactttaaacctaaaagttaacgtaaaccgtaaacggtaccccgttaagggaaacgtaaccgggacccgggtaaacgggtaacccgttaccggttaacgttaacgggtttaactttaaacgtttaacggtttacgggttaaccggggtaaccgggggtaaaaacggggggggtcgttaacggggggttaccggggtaccgggttacgggggtaacccggtttacccgggggtaccggggggtaacccccggggtaaaccccggggggtaaacccccccccggg

SEQ ID NO: 28300 - DNA, 805 bp, Homo sapiens
  misc_feature: GYAE6OF01DOE0R.39.16.B05.1.454.CMB.1.raw
tcagtcgcactagtcacgaccggtgctcgatttagagctcacgtattgggaggtctcagagaggagccttagccctggactccaaggccctttccacttggtgatcagcactgagcacagaggactcaccatggaattggggctgagtcgttgggttttccttgttgtcttattttagaaggtgtcagtgtggaggtgcagcgtgggtgggagtcggtggggggaggtcgtttgggtcccgaggtccggttgggggggttcccctaggacgtacctctccgtggtgccaggtcccttcgtagggtactttacctaacccgttttaaggaacctttaagttggtaattggtagggtttcgggtccccgaccgaggtcgtcggacggaagggggaaggggtctaggggtagggttggggacggacccaaagagttaaggaaggtagagtagggaaagaacgaagtaaaagtacttaagtggtacggtaaccttcggttagggtacggaacggggtcccgtaacgtttccgaaacccgttacttccccgtaccgtaaaggaaccgtaaaccgaaacccggaaccgtaaaacgtaacgtttacgaaccctttaaggttaaacttttaaacgaaaaggttaccgaaaccgtacgtaaccggtaggaaacgaccggaaccggacgtaaccgtaccgtagttagttaactagtttacgttaggtcgggaaagggtaacgggggctaaggggtcgtacgggttcgggaccggttaccgggcgggggtaaccccggaaccgggggttacccccg

SEQ ID NO: 28301 - DNA, 630 bp, Homo sapiens
  misc_feature: GYAE6OF01CZ175.39.16.B05.1.454.CMB.1.raw
tcagtcgcactagtcacgaccggtgctcgatttagagctcacgtaaggggcgtgggcctcaggaagccagcatcggaggtgcctcagccatgggccatggatccctctccttccgtcggcgtccttgcttactgcacaggatccgtggcctctatgagctgtctcagccacgctcagtcgtccgtcgtccccaggacagaccagccagcatcacctgctacaggaaatctagtaggatactaaatatgcttgctggtactcagctagaagccacggccacgtcccctgcgctgactcatcatcaagtactaccgacgtccgaccgtgacggtactccgtgacgtcgtacgtcgtcgtcggtacctcccgtaacgtcgtacggtacctaacgtacgtacccacgttcgtaccgaccctacgtaccgaccggacccgggtaccacgggtaccgttagtacggtaacgttacggaacgtacgttaagttacgttaacgttaccggttagtaccggtaggttcgggtaacggtacaacggtacgtaacgggaccgggttagggtcggggttcgggaacgggacgggtacgacggtcgtacgtaccggacgttacggaccgccggccggtaccgg

SEQ ID NO: 28302 - DNA, 704 bp, Homo sapiens
  misc_feature: GYAE6OF01B4I4U.39.16.B05.1.454.CMB.1.raw
  modified_base (236)..(236): a, c, t, g, unknown or other
  misc_feature (236)..(236): n is a, c, g, or t
tcagtcgcactagtcacgaccggtgctcgatttagagctcacgtaaggggctgggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatccactgctctaggaaatacattaggagataatntagcttgctggtatcagacagaacgccaggccagtcccctgtcgctgactcagtctatcaagactaccaagccggcctacgacgggactcccgtagacgtacgtacgtttcgtacgtcggtaccctacccgaacgttccggtaacggggaacctaccggacgtacccctacgtccgtacgtaccctacgtccgtaacgggaccccgggaccctacgggtaccgtaacgtacgggtaacttacgggtaacgaccgttacggtaactttacggtttacgtttcgggtaccggtaaggggtttcgggtacgggtaaccgtacgggaccggtaagggtaaccgggttaaaaggggggttccggttacccgggggacggggtaaccgggggtaaccctaaccgggtccggttacccgggtaacccgggttcccggttaaacgggaccccggtacgggaccccggtaacccggg

SEQ ID NO: 28303 - DNA, 719 bp, Homo sapiens
  misc_feature: GYAE6OF01DM64S.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattgggctgagctggtttcctgtgctatttagagtgtccagtgtgaggtgcagctggtggagtcgtgggggaggtcgttggtccaggccgtggggggtccctggagactctcctgtgcagcctcgtggtattcctaccgtttaggaacttagttggatggtaggttcgggtccgccgaggctgcggaggggaacgggcgtgggaggtgggtcgaccaagagtaggaggtagagtagggaagagaagaaatactagtgtcgactcgtaggtaggaacgggtcctagttaccaccgtattacctaccgaaggaacgaaccaaccgaccgaaagtaacttacctaacgtttaggtttaaactttaaccgaaagttaacggaaaccgtacggtacccgttaagggaacggaaccggtacccgggaaacggtaccgtaacgtttaccgttaaggtaactttaaacgttacgtttacgggagggtaaaccgggggtaaacgggggggcttaaacgggggtccggtacgggttacggggtacccgtttaccggggtaccgggggtaccccggtaaacccccggggggg

SEQ ID NO: 28304 - DNA, 861 bp, Homo sapiens
  misc_feature: GYAE6OF01DNCJO.39.16.B05.1.454.CMB.1.raw
  modified_base (271)..(271): a, c, t, g, unknown or other
  misc_feature (271)..(271): n is a, c, g, or t
  modified_base (381)..(381): a, c, t, g, unknown or other
  misc_feature (381)..(381): n is a, c, g, or t
tcagtcgcactagtcacgaccggtgctcgatttagagctcacgtattgggtttgaggtctcagagaggagcccttagccctggactccaaggccttttccacttggtgatccagcactgacgcacagaggactctaccgatgggtaagttcgggcttgtagtcgtttgggttttcctttgttagtacttagttttagtaaggtcttaccgaggtgtaggaggtgcgtaagtcgtgggttaggcgtttcgggtagggagtcgttcggtccgngtcggttccgttccgtgacgtccttcctcgtgtcgcgacgtccttaccgtaggtacttaaccgttaggaccttaaggttacgggtaacgtacggtacgggtttaccggtnaccccgttacggggtaacgggtcccggttaaaggggccggttacgggggtacgggtaccggtttaaggggacggttccggggtaaaacgtccgtaaaaacggtcccggttaaaaggaaaggtttaagtaaacggttaacgggtaaaagtacgggtaaacggtaaagttacccgtaaaggtttaaccgggtaacggttcggtacgttcggtaaccgggtaaccggttacgtaaccccgtaccgtaactacctaaccgtaaccgtaacgaacgttaccgaaacttaccgtaaacgttaactaacgtagttacgtaacgttaactagaactagaacgtccggaacgtaggtacctaggtacaccggtacgttgtaagttacggtaacgttaggtacgggacggtaacggggtcgggtaacggtcgggtaccggtacgggtacccgggtacccgtccggggtacccgtccgggtaacccccggg

SEQ ID NO: 28305 - DNA, 565 bp, Homo sapiens
  misc_feature: GYAE6OF01AY8JI.39.16.B05.1.454.CMB.1.raw
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtggggggaggcgttggtccaggccgtgggggggtcccctggacgactctcctgtgcagcctctggattcacctttaggaactattggatgagttgggtccgccaggctgcgaggggaagggctgggagtggggtgccaacatagaggtagagtggaagagagaaatactatgtggactcgtgtggaagggccgattcacatcacagagacaacgcaagatcactgtattacaatgaacngaccngagacgcgaggacacgtctagtataacttgttggtggaacgggaaaggggggctaagggtcgggacgttaggggaccgtacgggtcggggcccgtaaaccccgggggg

SEQ ID NO: 28306 - DNA, 704 bp, Homo sapiens
  misc_feature: GYAE6OF01CW9KC.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattgggctgagctggtttccttgttgctattttagaaggtgtcagtgtgaggtgcagctgggtggagtcgtgggggaggtcgttggtccagccgtcggggggtccctgagactcgtcctgtgcagccctgtggattccaaccttttaggaaacttagttggactggaggttgggtccgcaggctgcgagggagggctgggagtgggtgaccaagagtagaggtagagtggaaagagtaagaaatacgtaatggtagtattcgtgtaggaacgggcgtattaccgacctaatccgtacgagaacgtaaccaaacgacccaagtaaacttcgaacttacggttaatttaacgaaaattcggaaaactacggtaccctaggtaacgaccggtaccggaaacgggtaaccgtaaccggttcgttaacgggttaactaaacccgtttaagtttacggggtaacgggtacgggggtaaaagggggggtccgtaaggggttcggggcggtttacggggacccgttaacgggttaccgggggggaccccgtaaacccggggggttaaacccccccggg

SEQ ID NO: 28307 - DNA, 639 bp, Homo sapiens
  misc_feature: GYAE6OF01DG6AH.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctcgtggacttccacctttaggaacttattggattgaggtttcggggtccgccgaggctggacgagggggaagggcgtagggaggtggggtcggacccaagagtaaggaggtagagtagggaaagagaagtaaatactatggtaggacttcgtggtaggaaggggccgtattccaacctatcctaccaagagaaccaacgaccaagtaacttacacgttagttaactttaacaaatacgaaacacgtacccgtagaggacgaccggaaggacctacgttctagttaattactaaggttcggtaggacggggaaagggggcgtaggtcgggtacgtcggggtacgttaccgggtcgggggacccgtaaacccggggg

SEQ ID NO: 28308 - DNA, 530 bp, Homo sapiens
  misc_feature: GYAE6OF01BCJQ2.39.16.B05.1.454.CMB.1.raw
  modified_base (441)..(441): a, c, t, g, unknown or other
  misc_feature (441)..(441): n is a, c, g, or t
  modified_base (465)..(465): a, c, t, g, unknown or other
  misc_feature (465)..(465): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttaggaactattggatgagttgggtccgcaggctgcgaggggagggctgggagtgggtcggccaacataggaggtagagtgggaagagaagaaatactatgtaggactctggtgaagggccgattcaccatctcagagacaacgcaagatcactgtattacaaatnaacagctgagagcgacgacacgtntgtatactattgtggaggaagggggcaggcggtcgtgggactacggtcggggccgtaacccgggg

SEQ ID NO: 28309 - DNA, 539 bp, Homo sapiens
  misc_feature: GYAE6OF01BUSTD.39.16.B05.1.454.CMB.1.raw
  modified_base (490)..(490): a, c, t, g, unknown or other
  misc_feature (490)..(490): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcttgggtccaggccgtggggggtccctgagactctcctgtgcagcctctggattcacctttaggaactattggatgagttgggtccgccaggctgcgaggggaaggggctgggagtgggtggccaacatagaggtagagtgggaagagagaaatactatgtggactctggtgaagggccgattcaccatctcagagacaacgccaagaattcactgtatttacaaatagaacagacctagagagaccgaggacacgtctgtatactattgtgnggaagggggcaggtggcgtgggctaggcgggccgacggggtaaccccgg

SEQ ID NO: 28310 - DNA, 651 bp, Homo sapiens
  misc_feature: GYAE6OF01CQYZ4.39.16.B05.1.454.CMB.1.raw
  modified_base (263)..(263): a, c, t, g, unknown or other
  misc_feature (263)..(263): n is a, c, g, or t
  modified_base (308)..(308): a, c, t, g, unknown or other
  misc_feature (308)..(308): n is a, c, g, or t
tcagtcgcactagtcacgaccggtgctcgatttagagctcacgtattgggtttgaggtctcagagaggagccttagcccctggactccaaggcctttccacttggtgatcagcactgagcacagaggactcaccatggaattggggctgagctgggttttccttgtgctattttagaaggtgtccagtgtgaggtgcagctggtggagtcgtgggggaggcttggtccagccgtggggggtccctgagacctctccgtgtgcngcctctggattcacctttaaggactattggatggagttgggtccncaggctgcgaggggaagggcgtgggagtggggtcgaccaaagagtaaggaaggttagaagtgggaaagaaggaaagaaactaacgtataggaggtactgtcgtaggaaggccgtattcacaacgtctacccgaagacgaaccaagaccgaaagaacttacaacttagttaaactttaacaaaactaggtaaaccagtcccgtaaggacgaacggaccgaaggactaccggtacttagtaataaccttaagttacggttaggaaccggggtaaaggggggacctaaaggtcggggaccgttagggacccggttacgggtccgggggaacccggtaacccggggg

SEQ ID NO: 28311 - DNA, 549 bp, Homo sapiens
  misc_feature: GYAE6OF01BGH56.39.16.B05.1.454.CMB.1.raw
  modified_base (532)..(532): a, c, t, g, unknown or other
  misc_feature (532)..(532): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcttgggtccagccgtggggggtccctgagactctcctgtgcagcctctggattcacctttaggaactattggatgagttgggtccgcaggctgcgaggggagggctggagtgggtggaccaacgatagaggtagatgggaagagagaaatactatgtggactcgtgtggaagggccgattccaccatctccagagacaacgccaagatcatagtactttaacaaatagaacagcctaggagagaccgaggaccacgtctgttatacttagttgtaggacgggaaaggggggcaggtggcgtgggctacggngggcccggaacccgggg

SEQ ID NO: 28312 - DNA, 699 bp, Homo sapiens
  misc_feature: GYAE6OF01CT4PP.39.16.B05.1.454.CMB.1.raw
  modified_base (239)..(239): a, c, t, g, unknown or other
  misc_feature (239)..(239): n is a, c, g, or t
tcagtcgcactagtcacgaccggtgctcgatttagagctcacgtaaggggctgggcctcaggaagcagcatcggaggtgcctcagccatggcatggatccctctcttcctcggcgtccttgcttactgcacaggatccgtggcctctatgagctgtctcagccacgctcagtcgtccgtcgtcccaggacagacagccagcatcacctgctctaggaaattcagttaggataataaatntgtacttgcgttaggtaactcagtacgaagaacgccgacggacccaccggtcccctggtacgcttacgactactactactacgtacaaagtacgtaaccgaacgccggacctacggacggtacctcccgaggtaacgcgtaacttccgtcgtcgtacccttaccgaaagttccggtaacggaaccaaccgtacgaccctacgttccgacggaacctacgtaccggaacggtacccgggaacctggaccgttaacgtaggtaacgtacggaattccgggtaattacggtaacgtttacggttaggtccggttaggggtacgtaagggtaccgaggaccgtaagggtaaccgggttaaaggggtcgggtaccggggaacgggtaacgggtaacccacgggtccggttaaccggtacccggttaccgggtaacggaccggtaaccgggaacccggttaacggg

SEQ ID NO: 28313 - DNA, 656 bp, Homo sapiens
  misc_feature: GYAE6OF01BP0F4.39.16.B05.1.454.CMB.1.raw
tcagtcgcactagtcacgaccggtgctcgatttagagctcacgtaaggggctgggcctcaggaagcagcatcggaggtgcctcagccatggcatggatccctctcttcctcggcgtccttgcttactgcacaggatccgtggcctcctatgagctgtctcagccacgctcagtgtccgtcgtccccaggacagacagccagcatcacctgctcgtaggaaactacagttagggaataataaaatatgtcttgcgtggtatcgagcaagaacgccgaggcccacgtcccctgtcgctgactcattactaatacaaatactaaccgaacggcccggtaccctacgaacgggacctcccgtaggacggtcgttaactttccgtaccggtcgtacccttacccgtaacgtccggtaacgggaacccacgaccgacctacctccgtacaccgtactacgaacgggacccggaacccgaggtactagtacggataggacgtacgtacgtaacttacgttagttacggtacggtagggttcgggtacggactaacggacgtaaacgggtcgggtaaacggggttcgggtacgggaacggggtacggaaccaggtccgtaacccggtacggtaccgaggtacggaaccgcccggtaaacccggg

SEQ ID NO: 28314 - DNA, 821 bp, Homo sapiens
  misc_feature: GYAE6OF01DKV43.39.16.B05.1.454.CMB.1.raw
  modified_base (335)..(335): a, c, t, g, unknown or other
  misc_feature (335)..(335): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagcttgggttttccttgtgctattttagaaggtgtccagtgtgaggtgcagctgggtggagtcgtgggggagtcgttggtcccgaggccggttggggggtcccctggagtacctcgtcctggtgcgacgcctcgtggtacttactaacccgtttaaggaacttagttaggatcggtaggtttcggggcccnccgaggtccgtaggaccggaaggggtaaggggctagggagttggggacgaccaaagagtaggaacggtagagtacgggaaagagaaagtaaactagtaagtggtacgactcgttaggagggaacggtaccgtatacccgaactacgttaccgaccaaaggaaccgaaacccgaaccggaacctaaaaggtaacctttacgaaaccgtttaacggttaaacttttaaaaccgtaaaagttacgaaaaacccgtcgggaacccgttagggaaacggtaaccggacccgggtaaacggtaacccggttaaccgtacggtttaaggttaaaaccttaaccggttaagtttaccggggtaagggtaaacccggggggaaaaaggggggtcgttaagggggtacggaccggggtttacgggggtaacccgttaaacgggggttccccggggggaaaccccggtaaaccccgggggggttaaaccccccccgg

SEQ ID NO: 28315 - DNA, 787 bp, Homo sapiens
  misc_feature: GYAE6OF01AJESN.39.16.B05.1.454.CMB.1.raw
tcagtcgcactagtcacgaccggtgctcgatttagagctcacgtaaggggctgggcctcaggaagcagcatcggaggtgcctcagccaatggcatggatccctctcttcctcggcgtccttgcttactgcacaggatccttggcctctatgagctgtctcagccacgctcagtcgtccgtcgtcccaggacagacacgccagcatccacctgctctaggaaactacagttaggataataatatcgcttgctaggtatcacgcgagaacgccgaggccgtacgtccctgcgtctagactactatctaactacgaaagtaaccgtaaccggaacggcccgggtaccctacggaacggtacctccggtaggtacgtccgtacttccggtcgtaccgtaccctaacccgtacgttaccggtaacggaaccaccgtaccgcccttaaccgtaccgtaccggaaccgtacggtaccggtaaccggggtacccgggaacccgtaggtaccgtaacggtacgggtaacgtacggtaacgtaccgtttaacgtttaacgtttaacggtttacggttacgggtacgggttacggggttacgggtacgggtaacgacgggacggtaaccgggggttaaaccggggtaacggggggttaccggggttaacccgggggaacggggtaacccgggtaaccccggttaaaccggggttccccggttaaccgggttaaaccccgggtttcccggtaaacccggggtacccggtaaaccccggggtaccccggttaccccgggg

SEQ ID NO: 28316 - DNA, 832 bp, Homo sapiens
  misc_feature: GYAE6OF01EG6CR.39.16.B05.1.454.CMB.1.raw
  modified_base (404)..(404): a, c, t, g, unknown or other
  misc_feature (404)..(404): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttcctgttgctattttagaagtgtccagtgtgaggtgcagctggtggagtcgtgggggagtcgttggcccaggcccgttggggggtcccctggacgacctcctcctgtcgcacgccttctggatttccaccgttttaggaacttagttcgggatggaggtttcggggtcccgccgagggtcctggccgaagggggaaggggtctgggaggtggggtcgacccaaagagtaggaggtagagtagggaaacgnggaagaaagtactaagtggttaggacttcgtggtaggaaacggggtcccgtaagtttccaacccgtacttccgttacccgaaggtaacgaaaccgaaaccggaccctaaaagggtaacttttaaccgtaaccgtttaggtttaaactttttaaaccgaaaagtttaccggtaaaaccgtacggtaccccttaagggaacggtaaccgggtaacccgggaaaccggggtaacccgttaaccgggttaccgttaacgggtttaaactttaaacccggtttaaggttttacgggtaacggggtaaaccgggggtaaaacggggggggtcgttaaacgggggtcgggtacccgggttacggggggtaacccgtttaccgggggaccggggggtacccccggtaaaccggggggttaaaccccccccccgggg

SEQ ID NO: 28317 - DNA, 707 bp, Homo sapiens
  misc_feature: GYAE6OF01DM1V8.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcgtgggggagcttggtccagccgttggggggtccctgacgtactctcctgtcgcagcctcgtggtacttcctaaccgttttaaggaacttagttggatggaggttcgggtccgcaggctggcgaggggagggcgtgggagtggggtcggacccaaagagtaaggaaggttagaacgtgggaaaggagaagtaaaagttacgtaagttggtacggtacttcgtggttagggaaacgggtcccgtaacgtttacccaacctacgttaccctaccgaaggaacgaaaccgaaaccgacccgaaagtaactttaccaacgtttacgttaactttaaaccaaattacgaacacgtaccgtaggaacgacgaccggaacggaccgtacgttacgttagttaacttacgttagttacggtaggaacggggtaaaggggggctaacggggtggtaccggtcggggtacgtaccgggtcggggacccggtaccggggtaacccccggg

SEQ ID NO: 28318 - DNA, 594 bp, Homo sapiens
  misc_feature: GYAE6OF01BMZML.39.16.B05.1.454.CMB.1.raw
  modified_base (346)..(346): a, c, t, g, unknown or other
  misc_feature (346)..(346): n is a, c, g, or t
  modified_base (387)..(387): a, c, t, g, unknown or other
  misc_feature (387)..(387): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagctgggtggagtcgtgggggaggcgttggtccaggccgtgggggggtccctgagactctcctgtgcagcctctggattcacctttaggaactattggatgagttgggtccgcaggctgcagggagggctggagtgggtggaccaanataggaggtagatagggaagagaagaaatactatgtgactntggtaggaacgggccgtagttccaccactcctcccgaagacgaacaacgaccaaagtaacttacactagttaatttaacaaagtgaacacgtctaggagacgaccgaggacacgtctagtactacgttagttcggtaggacggggtaaagggggctagggtcggtcggtacgggaccgtacgtcggggggcccgtaaacccgggggg

SEQ ID NO: 28319 - DNA, 717 bp, Homo sapiens
  misc_feature: GYAE6OF01A1YDD.39.16.B05.1.454.CMB.1.raw
tcagtcgcactagtcacgaccggtgctcgatttagagctcacgtattgggtttgaggtctcagagaggagccttagcccctggactccaaggcctttccacttggtgatcagcactgagtcacagaggactcaccatggaattggggctgagcgttgggttttccttgttgcttattttagaaggtgtccagtgtgaggtgcagcgtggtggagtcggtgggggaggtcgttggtccaggccggtggggggtccctgagactctccgtgtgccacggcctcgtaggtacttccgtaccgtttaaggaacttagttggatggtaggtttccgggtccgcgaggccgtggacggtaaggggacggggtctagggaggtcggggtacgaccaacgtagtaggaggtagaagtaggaaagagaagtaaatcgtagtgtgacgtgtaggacgacggctactacacgtactccaacgacgaacgaccgaacgacccaaagtaaccttacgtaacgtttagtttaacttaagaaaaccgttagtaaaccgtacgtaccgtaagtaacggaaccgtaacggaaccgggtaactaaccggttaccgtaagttaaacccgttaagtttacggtacgttaggggaaccggggtaaacgggggtgtaacgggttccgggtacgggtacgggtagtcccggggtaaggggccccggtaaaaccccggggg

SEQ ID NO: 28320 - DNA, 790 bp, Homo sapiens
  misc_feature: GYAE6OF01BFKRP.39.16.B05.1.454.CMB.1.raw
  modified_base (737)..(737): a, c, t, g, unknown or other
  misc_feature (737)..(737): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccagtggaagttggggctggagtcgttgggtttttccttggttgtctttagttttaagaaggtgtccagtgtgaggtgcgagtcgtgggtggaggtcggtgggggacggtcgttcggtccgaggtcccggttcggggggtcccctggacgtacctccgttccgtggtgccgacgtcccgttcgtacggtactttccgtaaccgtttaaggtaaactttaggttaggtagttggtacggtttccggggtcccggccggtacgggtccgtacggaccgggaagggggtaacggggtcggtaggggtacggggttggggtaccggaccgtaaacgtaggtaaggtaagggtaagaggtaaggaaagggtaaggaaagtaaacgttaacgttagtacgggtacgtaacgttggtacgggtacgggacgggtaccgttagtaccccaccgtacgttaccgaacgaaaggaacgaaccgtaaaccgaccgaaaagttaccgttaccaagtttacgtttaaacttaaacgaaatcgaaacctgaccgtagaaccggacgtacggacggtacctagttcgtaagttaatacgtagttcgggaggaacggggtaggggntacgggtggacgtcgggtacgtcgggccggggaacccggtccggtaaccccgg

SEQ ID NO: 28321 - DNA, 834 bp, Homo sapiens
  misc_feature: GYAE6OF01C25CU.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagtcgttggtccaggccgtggggggtccctgagactctcctgtgcagcctcgtggattccaccgttttaaggaaccttagttggattggtacgtttggggtcccgccgaggctgacggtaaggggaaggggtcgttagggacgggttggggtacggaccctaaacgaagttaagggagggttaagaagttaggggaaaagtaaggaaagtaaaaattaaccgtaagttgggtacggtaacgttacgttagggtaacgggaacgggtacccggtaactttaccgtaaccctaacgtttcctaacccgaaggtaaccgaaacccgtaaaccggtaaccctaaaaggtaaactttccgtaaacgtttagtttaaacctttttaaacgaaaactttaccggaaaacgtaccggaccgttaaggacggtaacggtaccgaaacgggtaccctacggttacgttaaggttaacttaaacccgttagtttacgggtacggggtaaccgggggaaaaacgggggggttcgaacggggttacgggtacgggtttaccgggggtaacccggttacccggggtacccgggggaaccccgggtaaacccgggggttaaacccccccccggggg

SEQ ID NO: 28322 - DNA, 614 bp, Homo sapiens
  misc_feature: GYAE6OF01C3PG9.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagcttgggttttccttgttgcttatttttagaaggtgtccagtgtgaggtgcagctggtggagtcgtgggggagcttggtccaggccgtgggggtccctgagactctcctgtgcagcctcgtggattcaccgtttaggaactagttgatgagttgggtccgccaggctgcgagggagggctggagtgggtgcaacgatagagtagataggaagagaagaaaatgtaagtgtggacttgtaggtaggaacgggccgtattccaacctagtactaccgagaacgaacaaaccgaccaaagtaacttcgaactagttaatttaaacaaagttagaaacgacgtacccgtagaagacgaccggaggaaccacggtctattagtacttagttaggtaggaacgggtaaagggggcgaagggtggtccgtggggacctaacgggttccggggaccgaacccggggtaaacccccgg

SEQ ID NO: 28323 - DNA, 659 bp, Homo sapiens
  misc_feature: GYAE6OF01AE6DN.39.16.B05.1.454.CMB.1.raw
  modified_base (232)..(232): a, c, t, g, unknown or other
  misc_feature (232)..(232): n is a, c, g, or t
tcagtcgcactagtcacgaccggtgctcgatttagagctcacgtaaggggctgggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatccacctgctctaggaaatacagttagganataaatatgcttgctggtatcagcaagaagccaggccacgtcccctgtgctgatcattactatacaagtactaaccgaacggccggtcctacgacggggtacctcccgtaggacgtaccgttacttccgtcgtcggtcctaccaaccgtacgtacgggaaccaccgaacgcccacctacgtacgaaccctactaccgaaccggacccgggaacccgacggtacgtacggtaggacgtagaacgtcgtacgtaactttaagtttacgttacgttacgtagggttcgggtaacgggacgacggtcggaacggtaacggggtaacggggttccggtaccggggacgggtaacgggaccggaaccggtacccggttacgggtaccccgtttaccggtaaccgggcccgaaccggtaccccggtaacccggg

SEQ ID NO: 28324 - DNA, 614 bp, Homo sapiens
  misc_feature: GYAE6OF01EHR4T.39.16.B05.1.454.CMB.1.raw
  modified_base (389)..(389): a, c, t, g, unknown or other
  misc_feature (389)..(389): n is a, c, g, or t
  modified_base (469)..(469): a, c, t, g, unknown or other
  misc_feature (469)..(469): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctcgtggtattcgtaggtttagtgacgcctggataaacgtggggtccgccgaggcctccggagggggaaggggctgggagtggggtccgaccaaacattaaagaaagagtaggaagtagaaagtaaaaactntagtaggactgtaggtaggaacggggtcccgtttaccattccgtacgaggaccaacgcatgctattagctattattgaanaaataacagtcgtagagacgaccggaggacgtacgtcttacattactactacgtggtcgccgtggtcgggtctaacgttggtggtaccgttccgggtaccgggggtaccgaaaccggggacccgtaccgggtaccgttacccccg

SEQ ID NO: 28325 - DNA, 661 bp, Homo sapiens
  misc_feature: GYAE6OF01C3ZU9.39.16.B05.1.454.CMB.1.raw
  modified_base (336)..(336): a, c, t, g, unknown or other
  misc_feature (336)..(336): n is a, c, g, or t
  modified_base (440)..(440): a, c, t, g, unknown or other
  misc_feature (440)..(440): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgtcttattttagaggtgtccagtgtgaggtgcagcgtggtggagtcgtgggggagtcgttggtccgagccggtcggggggtcccctggacgtactctcctggtgcagccctgtggtacttaccgtaacctttaaggaacttagttggaatggtacggtttcgggtcccnccgtaggtctaggacggagggggaagggcgtagggtaggtgggtacgaccgaagagtaaggaggtagagtaggaagagaaagaatatagtgtagactcgtaggnggacggacgtataccgactagtcacagacaacacgacaaatactacacttagttaacttaacaaatacgaacacgtaccgtaggaagacggaccggaacgtacgtacgtacgttacgtattaacgttagttacggtagggtaacggggaacgggggtcgtaagggtcggtaccggtaggggtaccgttacggggccggggaacccggtaaacccccggggg

SEQ ID NO: 28326 - DNA, 661 bp, Homo sapiens
  misc_feature: GYAE6OF01A4WCR.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctggttttccttgttgcttattttagagtgtccagtgtgagtgcagctggtggagtcgtgggggagcttggtccagcccgtgggggtccctgacgactctcctgtgcagcctctggtattcctaaccttttaggaacttagttggagtgtaggttcgggtccgccgaggcgtggcggaggggaaggggcgtgggagggttcggggacggaccgaacgtaagtaggaggtagagtaggaaagagaagaaacttaacgtatggtacgacttcgtggtagggaacgggtacgtacgttaccaccgtacttcgtacccgaagaacgaacaaaccgaccaaagtaacttctaacgttagttaactttaaacaaagttacgaacacgtacgtagaagaacgccgaacggtacctacgtcttagtaacttagtagttagggtacggtaggggaacgggggctaacgggtggtacggtagggcgttacgggcggggtacccggaacccggggtaacccccggg

SEQ ID NO: 28327 - DNA, 932 bp, Homo sapiens
  misc_feature: GYAE6OF01DEOC5.39.16.B05.1.454.CMB.1.raw
tcagtcgcactagtcacgaccggtgctcgatttagagctcacgtattgggtttgaggtctcagagaggagccttagccctggactccaaggtcctttccacttggtgatcagcactgagcacgagagactcaccagtggaagttgggctgagtcgttgggttttccttgttgtctttattttaggaggtgtccgtagtgtggaggtgcaggtcgtgggtggtaggtcggtgggggagtcgttcgggtccgacggtccgggtcggggggtccctaggacgtaccgtccgttccgtggtcgcccgtacgtccctttcggtacggttacgttttaccgttaaccggtttaaagggtaaactttagggttacggtaaggttacggggttaccggggttttacccggggccccggtacccgggtacggggtaccttacggggaacgggggtaaaacggggggggaaccgggggttgggttaaggggggtacggggttaccgggggttaccgaaaaccccggtaaagtaaagggttaacggggaaggggtttaagggaaacggttaaagggggaaaaggtaaacggtaaaaggttaaaacgttacggttaaggttacgggttacggtaacgttcgttaagggacgggtaaccgggtactacttaccgaccggtactccctaacgaacgaacccgtaacggaaccgaaccgtaaagttaaccgttaattaaccgttttaacgttaaactttaaacgtaagtaacgaacgtaccggtaacccgtgggaaaccgtacgggaccggtaacggtacgtaacccgttaggttaacgtaactttacgggttaaggttacggggacgggaaacggggtaggggccgtaagggttccggtacgggtcccggtacggtcggggtacccgggtcccgggtaaccccggg

SEQ ID NO: 28328 - DNA, 774 bp, Homo sapiens
  misc_feature: GYAE6OF01C64A9.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccagtggaagttggggctggagtcgttgggttttccttgttgcttattttagaaggtgtccaggtgtgaggtgcagcgtgggtggaggtcggtgggggaggtcgttggtccgaggccggtcggggggtccctggacgtcctctccgtgtcgaccgagtccttcgtaggtaactttccgtaaccgtttaacgggaaacttgtagggtaagttcggtaagggtttcggggtccgacggtcggcgtggacgggaagggggaacgggtcggttagggacgggtggggtaccggaccaaaagtagtaaggtaaggtaaggtaagtaaggggaaagaagtaaacggtaaaattacggtaagtggggtacgtaaccttggttaagggtacgggtaaacgggtcgtacttacaacctaacgtctaccgaacggaacaaccgaaaccgaacctaaaggtaatcgtaattaacgtttaactaaactaaagtaacgaacacggtaccgtagaacggaaccggaccgaaggtaactaccgttaagtcgttaaacttaccgtagtttacgggaaccgggaaggggtaaagggggaccgtaggtcgggtacggacgggtaccggtacgggtaccggggaccggtaaacccccggggg

SEQ ID NO: 28329 - DNA, 705 bp, Homo sapiens
  misc_feature: GYAE6OF01ATNJO.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaagtgtccagtgtgaggtgcagcgtggtggagtcgtgggggaggtcttggtccaggccgtggggggtccctgacgactctccgtgtgcacgtcctcgtggtacttccgtaaccgtttaggaaacttagttggattggtaggttcggggtccgccgaggtccgtggacgagggggaaggggcgtgggaggttgggtacggaccgaaacgtagtaggaggtaagagtagggaaagaaggaaagtaaatacgtaagtggtaggaccttcgtggtagaacgggcctagttccaacctatccgtaccgaaggacgaacccgtaaccgaaccgtaagtaacttaccgtaaacttacgttaaactttaacgaaataccgggtaaccacggtaccgtaggaaacggtacggacccggtaagaacccgtacgtaccgttagttaacgtacgtagtttacggtagggtacggggaaaggggtcagggtcgggtaccgtgggaccgttaccgggccgggaccggtaacccggggtaacccccgg

SEQ ID NO: 28330 - DNA, 798 bp, Homo sapiens
  misc_feature: GYAE6OF01CNTM3.39.16.B05.1.454.CMB.1.raw
  modified_base (218)..(218): a, c, t, g, unknown or other
  misc_feature (218)..(218): n is a, c, g, or t
tcagtcgcactagtcacgaccggtgctcgatttagagctcacgtattgggtttgaggtctcagagaggagccttagccctggacctccaaggcctttccacttggtgatcagcactgagcacagagactcaccatggagttgggctgagtcttcgggttttccttgttgtcttagttttagaaggtgtacagtgtggtacggtgcagtcgtggtaggngtcggtgggggagtcgttcggaccgacggtccggttcggggggtccctagacgtaccgtccgttccgtgttacgctacggtcccttcggtaggtaactttaccgttaacgtttaaggaacctttagttaggagttaggtacggtttcgggtaccccgaccggacggtacgttcggaacgggtaacgggggaagggtccggttggggaacgggttcggggtacgaacccgtaataaacggtagggaggttaaaggagtaacgggaaagaagaaagtaaattacgtgtacggtagtacgtcgttagggacggtacggccgtaacgtccgtaacctactaccgtaaccgaacggaaacgaacccgtaaacggaaccttaaaacgtaacgttaacccgtaaactttaggttaaaacttttaaactaaaccgttaacgaaaccgtaggtacccgttaaggaaccggtacgaacggttacgacgtacgtacttagtaaactgttacggtacgagggtaacgggaaagggtcgaaggtcgggtacgggtacggacccgtacggggcccggtacggtaaacccccggg

SEQ ID NO: 28331 - DNA, 618 bp, Homo sapiens
  misc_feature: GYAE6OF01CFYN4.39.16.B05.1.454.CMB.1.raw
  modified_base (197)..(197): a, c, t, g, unknown or other
  misc_feature (197)..(197): n is a, c, g, or t
  modified_base (373)..(373): a, c, t, g, unknown or other
  misc_feature (373)..(373): n is a, c, g, or t
tcagtcgcactagtcacgaccggtgctcgatttagagctcacgtaaggggctgggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacncgccagcactcacctgctactaggaaatacgaagttaggataataaatatcgtcttgcgtaggtactcgagacgaagacgccgacggcctaccgtcccgtagtcgctagactactatacctaatacaaacgtactaaccgaacggccggtacccgtagtaaccgggtaccttccgngtacgtaccgtacttccgtcgtcgtaccctaaccgtaaccgtcggtaacggacacgtaccgacctacgtcgacgtacacgtaccgacggcccgacgtagctagacgatagacgtgtatacttattacgtcgtaggtaggtaggtacggacgaggtacggacggacgggtaagggtcggtacgggacggacggtacgacgtccggtacggtacccggtacgtaggacccgtacggacccgtaccgg

SEQ ID NO: 28332 - DNA, 685 bp, Homo sapiens
  misc_feature: GYAE6OF01BFDA5.39.16.B05.1.454.CMB.1.raw
  modified_base (152)..(152): a, c, t, g, unknown or other
  misc_feature (152)..(152): n is a, c, g, or t
  modified_base (576)..(576): a, c, t, g, unknown or other
  misc_feature (576)..(576): n is a, c, g, or t
tcagtcgcactagtcacgaccggtgctcgatttagagctcacgtaaggggctgggcctcaggaagcagcatcggaggtgcctcagccatggcatggatccctctcttcctcggcgtccttgcttactgcacaggatccgtggcctctatganctgtctcagccacgctcagtcgtccgtgtccccaggacagaccagccagcactccactgcctcgtagaaatcgtagttacggataataaatgtcgcttgacttggtatccgagacctaaggaacgtccacggccctaacggttccccgtagtcgcctagtactacgtagttcctaagacgaaagtactaaacccgaacggtccggtacccctaggacggggtacctacccgtaggacgtccgtatttccgtacgtcggaccttaccggaacgtcgtaacggaacctacgtaccgacctacgttccgacgtacctagtcccggaacggtcccgggaacctaggtcgttaagacgggtagtacggtaacgtcctaggttaacttacgtttacgtacgtacggtacgggtggtaccggaataccggngtaagggaccggttaaggggtcgggttacccgggaaggggaccggtaccgtacggcccggttacggaacccggttccggtaccggtacccgacggtaccccgtaacggg

SEQ ID NO: 28333 - DNA, 829 bp, Homo sapiens
  misc_feature: GYAE6OF01ENU16.39.16.B05.1.454.CMB.1.raw
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccagtgaagttggggctgagtcgttgggttttccttgttgtcttattttagaaggtgttccagtgtgaggtgcagcgtgggnggngtacggtgggggagtcgttggtccgaggtcccggtcggggggtcccctggacgtacctccgtccgtggtcgacacgcctcgtaggtactttacctaaccgtttaaggtaaccttagtttggacgttcgggtaggtttaccggggttcccgcccggaagggtccgtggaacccggggtagggggtaacgggggtccgttaaggggtacgggttcggggttcggaacccgaaataggttaagggaaggggttaagaaggttaacgggaaagaaaggtaaacgtaaaagttaccgtaaggttacgggttacgtaacgttacggttagggtaacgggaaccggggtccttaacttacctaaccctacgtaccgttacgaacgaaacggaccaccggtaaaccgaacgtaacttacgtaactcgtttaaacgttaataaacgtacgaacgttacgaccgtaggtaaccggaacgtaccgggaacgtaccgtacgtacgttataacctttagttaagttacgggttaggaaccgggggaacgggggtacggagggttaacggccggggtaggtacccggtaacggggtacgggggaccccggtaacccggggttaacccccgg

SEQ ID NO: 28334 - DNA, 582 bp, Homo sapiens
  misc_feature: GYAE6OF01A8FBG.39.16.B05.1.454.CMB.1.raw
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
  modified_base (436)..(436): a, c, t, g, unknown or other
  misc_feature (436)..(436): n is a, c, g, or t
  modified_base (547)..(547): a, c, t, g, unknown or other
  misc_feature (547)..(547): n is a, c, g, or t
  modified_base (554)..(554): a, c, t, g, unknown or other
  misc_feature (554)..(554): n is a, c, g, or t
  modified_base (565)..(565): a, c, t, g, unknown or other
  misc_feature (565)..(565): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggaggcttggtccgagccgtcggggggtcccctgagtactcctccnggtgcagccctntggacttctacctttaggaacttatggatgagttcgggtccgcaggctgcgagggagggcgtggaggtgggtgaccaacataggaggtacgagtagggaagaaggaacgtaaagtacgtaagtggtaggactcgtagtaggtaacggggcgtattccaaccnctctacctagaacgacaaccgacaaggtaactcatatacttaacaatagaacacgcctagagagacgacggtacaccgtctagttatacttagtgtaggagggaaggggcnggtgcgnggtacgtcggnggtcccggtaaccgggg

SEQ ID NO: 28335 - DNA, 733 bp, Homo sapiens
  misc_feature: GYAE6OF01BC188.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttcctgttgctattttagaaggtgtccagtgtgaggtgcagccgtggagtcgtggggagggcgttggttccgacgccggtcgggggtccggtcgaggactcctcctgtgcgacgccgtctcggtattcctaccgtttacggtaacgtattggtagtggtaggttcgggttccggaccgacggcgtcggacggacggggaaggggtcggtgggtaggtgggtcgggaccgaacgaagtaggaggtaaggtagtagggaaggaacgaaggtaaataacgtagtaggtcggacgttcgtaggtacggaagggtaccggtaactttacaacccgtacttacctaccccgaaaggtaaacgaaaccgaaacttggaacccgtaacgggaactcgtaccctaacttccgtaattcccggtagaactaaacgttaacgggaacctaaccgtaggaaggaaggaaaggaacgcggtaacccggttgtttaagttttaacgtttaaacgcggttacggtacggtaagttcggaacgtaaactttaaacgtagtagggaaacgttaaacgggtaaggtaacccccggggg

SEQ ID NO: 28336 - DNA, 866 bp, Homo sapiens
  misc_feature: GYAE6OF01A6Z0T.39.16.B05.1.454.CMB.1.raw
tcagtcgcactagtcacgaccggtgctcgatttagagctcacgtaaggggctgggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctagaatacagttaggatataaatatgtcttgcgtggtactcagacagaacgccgacggcctaccgtccccgtggtcgtctgactctactctaataccaaagtactaaccgaacggcccgggtccctacggaacgggtaccttccccgtaggacggtcctaacgtttccgtacgtccggtacctaacccgtaaccgttacggtaaccgggtaaccaacgtaccgtacccctacgttaccgtaccgtaaacccgtacgtaccgggtaaccgggacccggggtaaccccgtaggggttaccgttaacgggtttacgggtaaaccggttacgggtaaacccgttccgggtttaaacgtttaacccggttttaaacttttacgggtttaaccggtttaaccggggtaacggggtttcggggtaaccggggtaaccgtaaccgggaaccggtaaaccgggggtaaacgggggtttaaaacccggggggtttcgggggtttaaccccggggggaaaccgggggttaaccgggggtaaaacccccggttaacggggttaaccccggtaaccccgggggtttaaccccgggtttaaccccgggttaacgggggtaaccccccggtaaaccccggggtaacccccggggttaaacccccgggg

SEQ ID NO: 28337 - DNA, 786 bp, Homo sapiens
  misc_feature: GYAE6OF01AMBDE.39.16.B05.1.454.CMB.1.raw
tcagtcgcactagtcacgaccggtgctcgatttagagctcacgtattgggaggtctcagagaggagccttacgccctcggactccaaggcctttccacttggtgatcagcactgagcacagaggactcacatggaattgggctgagcttgggtttccttgttgctattttagaaggtgtcagtgtgaggtgcagcgtggtggagtcgtggggagtcttggtccaggtccgtggggggtccctggacgtacgttcctccgtgtcgccgtacgtcccttcgtggtacttccgtaaccgtttacggaacttagttggtaataggtaggtttcgggtcccgccgtagggtctacggacgtaaggggtaacggggccgtaggggtaacggttggggtaccggtaccgaaacgtaggtaaggaagggttaaggagtaagggaaagaaggtaaaggtaaaacttacgtaagtaggtacgggtaacttacggtcggtaacgggtaacgggtaccgtaacgttaccgaaccgtacgtaccgtaccaaggtaaacgaacaaaccgtaacccgaaagttaaactcgtaaaccgttagttaacgttttaagaaaacgttagtaaacccgaggtaacctacggtacgaaacggtacccggtaaggaaaccgtaccgttaacgtagttaacgttaacgttaagttacgggtaggaacgggtaacgggggacctagggttacggacggttacggggacgttaacgggtaaccgggtccgggaaccgggttaaacccccggg

SEQ ID NO: 28338 - DNA, 711 bp, Homo sapiens
  misc_feature: GYAE6OF01BMM18.39.16.B05.1.454.CMB.1.raw
  modified_base (251)..(251): a, c, t, g, unknown or other
  misc_feature (251)..(251): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcttattttagaaggtgtccagtgtgaggtgcagctggtggagtcgtggggagtcttggtccagccgtggggggtccctgacnctctcctgtgcagcctacgtggattctaccttaggaacttagtgtatgtaggttggtccgccgaggcgtgcgaaggggacgggtcgtggaggtgggtacggacctaacgagttaggaggtagagtaggaagagaagtaaatactagtgtagggtactacgtaggttaggaacggggtaccgactttacccgaacctacgtaccttaccccgaagtaacggtaaccaaccggaaccctaaaggtaaacttccctaacgttaacgtttaacttttaaacaaaacgtagaaaccgacggttacctagggtaacgaacggccggaacggtaccgtaaccgtcgttacgttaaacgttaaccgttaggttacgttagggaaccggggtaaagggggaccgtaagggtacgggtcggtacggggtacccgtaacgggttccggggggacccgtaaaccccgggggg

SEQ ID NO: 28339 - DNA, 1034 bp, Homo sapiens
  misc_feature: GYAE6OF01DF5OJ.39.16.B05.1.454.CMB.1.raw
tcagtcgcactagtcacgaccggtgctcgatttagagctcacgtattgggtttgaggtctcagagaggagccttagccctggactccaaggtccctttccacttggtgatcagcactgagcacagagactcaccagtggagttgggctgagtcgttgggttttccttgttgctttagtttagaggtgtccgagtgtgaggtgcgaggtcgtgggtggtaggtcggtgggggacggtcgttcggtccgacggtccgggttcgggggtccctggaccgtccttccgttccgtggtcgccgtacgtcccgttcgtaggtactttaccgttaaccgtttaacggtaacctttaggttacggtaggttacgggttacgggttttccgggccccggtaccggtaagggtccggttacggggaaccgggtaaaggggggggtaccggggtacgggttacggggttaacgggggttccgggggttaacccgggaaacccggaaaacggttaaggttaaacgggggtaaagggttaaacgggtaaaggttaaacggggaaaaaggtaaacggtaaaaaggttaaaacgtttaacgtaagggtttacgggttacggttaaccggttagggttaacgggtaacggggtaaacccggggtccttaaacgtttaccccggaaccccgttaaacgttccgtaaacccccgggaaaagtaaacccggaaaccgggtaaaaccccggtaaacccgtaaagtttaaacccttacccgtttaaagtttaacgtttaaaacgtttaaacgtaaacgtaacggtaaccgttaaccggtccggtaaaggacccgggaacggtacccgaacgggtaaccgttaaccgttacggttaattaaacggtttaaccgtttaagggtttccggggaaagggggtaaccgggggtaaagggggttaccgggttaaggggtcccggggttaaccgggtacgggggttacccgggtaacccgggggtacccgggggaaacccccgggttaaaccccccgggggg

SEQ ID NO: 28340 - DNA, 817 bp, Homo sapiens
  misc_feature: GYAE6OF01BHUQ5.39.16.B05.1.454.CMB.1.raw
tcagtcgcactagtcacgaccggtgctcgatttagagctcacgtaaggggctgggcctcaggaagcagcatcggaggtgcctcagccatggcatggactccctctcttcctcggcgtccttgcttactgcacgaggactccgtgcctctatgagctgtctcgacgccacgtctcgaggtcgtccgtcgtccccgaggacacgacacgaccagctactccacctgcctacgtaaggtaaactacgtaaggtttaaggaagtaaattaaagttacgtcgtacgtttcggcgttaggtataccgaggacgaaggaccgccggtacgcctaccggttcccgtgtccgtcgtacgtactacgtacttaactagtaacgtaaacgtaacccgtaacccggaaccggtccccggtaaccccgttacggaaaccggggttaccctacccggtaacggggtaccttacgtttaccgtttccgttaccggtaccgtaccccttaaccggtaaccgttaccgggaacgtaaaccctacggtacccgtacccttaccgttacgtaacccgtaacgtaaccggtacccgggaaccgggtaaccccggaccgttaaggtaaccgtttaggacggtaacggttacgacccgttagtaacgtttaagtttcgtttaacgttcgggttacggttagggttacggacggacgacgggtacggtaacggtaacggggttaacggggtcgggtaaccgggacggggtaacctaacgggtaccgtacggtaacccggttcccgggacggtacccgacggtaacggtcccggtacccgg

SEQ ID NO: 28341 - DNA, 744 bp, Homo sapiens
  misc_feature: GYAE6OF01B9QNP.39.16.B05.1.454.CMB.1.raw
  modified_base (653)..(653): a, c, t, g, unknown or other
  misc_feature (653)..(653): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaagttggggctgagcttgggttttccttgttgcttattttagaaggttgtcctagtgtgaggtgcgagcgtgggtggagtcggtgggggagtcgttcggtcccaggtcccggttcggggggtcccctggacgtacttcctccgtgtcgcacgtcccttcgtggtacttccttaacccgttaaggtacttagttggaacttggtaggtttccgggtacccgcgtaggcgttcgggaccggtaagggggtaagggcggtagggacgggttaggggtaccgacccgaaagtagttaagggaggtaaggacgtaggggaaacgagtaagtaaaatcgtagtagggtacgtaacgttcgagggtacgggaacggtaccggtacttacccgacctacttcccgtacgaacggaacgtaacccgaaaccgtacccgtaaattaacgttacctaacgttagtttaaacttaataaacgtacgaacacgtcgaggacggacgccggaacggacgtaccgtagttnaacgtttactaggttcggacgggtaacgggaacggggtcgagggtcgtcggtacggtaccggtacgggtccgggaaccggtaaccccgggg

SEQ ID NO: 28342 - DNA, 984 bp, Homo sapiens
  misc_feature: GYAE6OF01DPY45.39.16.B05.1.454.CMB.1.raw
tcagtcgcactagtcacgaccggtgctcgatttagagctcacgtattgggtttgaggtctcagagaggagccttagccctggactccaaggccctttaccacttggtgatacagcactgagcacagaggactcaacatggaattggggctgagcgttgggttttccttgttgtcttattttagaaggtgtcagtgtgaggtgcagcgtgggtggacgtccggtgggggacggtcgttcggtccgacggtcccggtcgggggggtcccctaggaacgtaccgtttccgtccgtggtacggtccgtacgtcccttcggttaggtactttacccgttaaacccgttttaaggtaaaccttaggttacggaagttcggttacgggtttcggggtccccgaccggtacgggtcgtgggaccgggaagggggtaacgggggtcgttagggggtaacgggttcgggggtacggaaccccgtaaagtaacgggttaaagggtaagggttacggaaaggtaagggggaaaaggaagggtaaaagtaaaacgttaaccgttaaggttacggggttacggtaaccgtttacggttaggggttaacgggtaaccggggtaccctttaaaccgtttcccgaaaccttacgttaccccgtaccggaaaaggaaaaccggaaacccgaaacccggtacttaaaaaggttaaacccctttaccgtaacccgttttaaaggtttaactttaaacgtaaagttaacccggaaaaacgtccgtaccggtaaagggacccggttaaccggacccggtaaacggggacccttaacgggttttacgtaaccgttaaacggttaccgttttaagggttccgggtaacggggaaaaccgggggggggaaaccgggttcgttaaacggggttcggggttaccccggttacgggggtaacccgttaaccggggggcccgggggtaaacccccggtaaaacccccgggggg

SEQ ID NO: 28343 - DNA, 715 bp, Homo sapiens
  misc_feature: GYAE6OF01CVFXE.39.16.B05.1.454.CMB.1.raw
  modified_base (193)..(193): a, c, t, g, unknown or other
  misc_feature (193)..(193): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (442)..(442): a, c, t, g, unknown or other
  misc_feature (442)..(442): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttctgtgctattttagaacgtgtcagtgtgaggtncagcgtgggtcggagttcggtgggggagtcgtttggaccaggccgtcggggggtccctgacggaccttcctccgtggttgcacggccctgtcggtaatttcctaacgtttaggaacttagttgggatggtaggttcgggtaccnccgnggtcctgacggaggggaacgggtctagggtaggtcgggtacggaccctaagaggtaggaggttaggaatagggaaagaagaacgtaaaagtcgtagttagnggtaactgtaggtaagggaacgggtacctagttacaaccgtactctacgaggaacaacgaacgaccgaaagtaactaccgtaacgttaagttaactttaaacaaagtacgaaacgtacgacgtacgaaggtaccgacgggtaacgactaacggtcgttacgaacgttaacgtagtttcggaagggttaacgggaaacgggggggtacgtaaggtcggggtaccggttacggggtagtacccggggtccgggggtaccggtaaacccccggggg

SEQ ID NO: 28344 - DNA, 880 bp, Homo sapiens
  misc_feature: GYAE6OF01DZR31.39.16.B05.1.454.CMB.1.raw
  modified_base (144)..(144): a, c, t, g, unknown or other
  misc_feature (144)..(144): n is a, c, g, or t
  modified_base (147)..(147): a, c, t, g, unknown or other
  misc_feature (147)..(147): n is a, c, g, or t
  modified_base (174)..(174): a, c, t, g, unknown or other
  misc_feature (174)..(174): n is a, c, g, or t
  modified_base (176)..(176): a, c, t, g, unknown or other
  misc_feature (176)..(176): n is a, c, g, or t
  modified_base (182)..(182): a, c, t, g, unknown or other
  misc_feature (182)..(182): n is a, c, g, or t
  modified_base (185)..(185): a, c, t, g, unknown or other
  misc_feature (185)..(185): n is a, c, g, or t
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
tcagtcgcactagtcacgaccggtgctcgatttagagctcacgtattgggtttgaggtctcagagaggagccttagccctggactccaaggtcctttccacttggtgatcagcactgagcacagaggactcacatggattgggntgngcgtggtttctgtagctatttagagtncngtgtgnggncngngtggtggagtggtggggngtcttggccgnggtccgggtcggggtcctgtacgtaccttcctcgttggctacgcgtcccttggtcgttaactttccctttaaccggtttaaggtaacttagttaggggtcttaggttagggttccgggtcccgaccggaggccgtcgggaggggaggggtagggcgtggggtaaggtcggggtaaccaaccgaaagtggttaaaggtacggtaaaggtcgtaaaaggggaggaaaggtaaaacctaaagtttacgtacgggtttaggtaacccgggtttacgttaccgggttaaagggggtaacgggaaccccgggttaccggttaaacccgttaaccctaaacccggtttaccgttaacccggtaaacccgaaacgggttaaccgaaaccccggtaaacccggaaccgtaaaacggtttaccttaccgtaaagttttaccgtttaaaactttaaaaccagttaaaacgtaacgttaccgaacgttagggtacccgaaccgggttaaccggaccggttaacgttacccgttagttaacggttaaaccttaccggtttaagggtaacggggttaaggggggaacgggggttaaaggggaaccggttgggacgggttagggttaaaccgggtccgggtacggggtaccccggacccggggttaaaccccccggg

SEQ ID NO: 28345 - DNA, 845 bp, Homo sapiens
  misc_feature: GYAE6OF01BLIN8.39.16.B05.1.454.CMB.1.raw
  modified_base (183)..(183): a, c, t, g, unknown or other
  misc_feature (183)..(183): n is a, c, g, or t
  modified_base (197)..(197): a, c, t, g, unknown or other
  misc_feature (197)..(197): n is a, c, g, or t
tcagtcgcactagtcacgaccggtgctcgatttagagctcacgtattgggaggtctcagagaggagccttagccctggactccgaaggccctttccacttggtgatcagcactgagcacagaggactcaccatggaattggggctgagtcgttgggttttcctgttgcttattttagaaggtntccagtgtgaggtncaggtctgggtggtacgcggtgggggagtcgttgggtccaggtccggtcgggggtccctaggaccgtcttccgtccgtaggtcgcgtacgtccgttccgtagggtacttaccgtaaccggttttaaggaactttagttggaagttcggtaacggtttcggggaccccacggtaggcgttcggaggaacggggagggtcgtcgggagttcgggaccgaaccgaagtagtaagggaaggttaaggaggtaagggaaagaaggtaaagtaaacgttacgtaggtacgggtacgtaccgtaggtaggagggtaccggtacgtacgttaccaccgtatcccgtaacgacgaaccgaacaccggaactaacggtacttcgtaagttagttaacttaacgtaaactacgaacacgtacgacggtaaacgaccggtaaccggaataacccggtacgttaacggtttaactaaccgttaaacgggtttaacgttccgggttaaaagggggaaccccggggggtaaaacgggggtcccggtttaaaacgggggtcggggtttaaaccccggggaccgggggtttaacccgttaacccggggggggtacccccggtaaacccgggggttaaaaccccccgggggtttaccccccccggg

SEQ ID NO: 28346 - DNA, 952 bp, Homo sapiens
  misc_feature: GYAE6OF01CKYJQ.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagtcgtgggttttccttgttgcttattttagaaggtgtccagtgtgaggtgcagctggtggagtcgtgggggagtcttggccaggccggtcgggggtccctggacgtaccttccgtcctgtcgcgacgtcccgttgtggtacttaccgtaacccgtttaaggtaaaccttaggttaggtaacttgggtacggttccggggtcccgaccgtaggtccgtggaccggaagggggaacggggtcggttaggggtacgggttggggtaccggacccgtaaacgaggttaacggaaggggttaagaggtaaggaaggtaaggaaacgtaaaattacgtagtcggtagtaacgttcggtaggtacgggaaccgggtccgttaacgttacccgaaccgtaccgttacccgtaacccgtaaacgggaacgaaacccgtaaaacccggtaaacccgggtaaaacttaaacccgtttaccggttaaaacccgtttaagttttaaaccggttttaaaaaccttaaacggttaaaccggtaaaaccggtaacccgttacccgggttaagggtaaaaccgggtacccgggtaacccggggtaaacggtaaacccggttaccgtttaaccggttaacggtttaaaaccgtttaaacggtttacggttaaaccgggggttacgggtaaaacccgggggggtaaaaaccggggggttgggtaccgggttaaccggggtcggggttaacccggggtaccgggttaaccggggtccccgggggggtaaaccccgggttaacccccgggggttaaaccccccccggg

SEQ ID NO: 28347 - DNA, 679 bp, Homo sapiens
  misc_feature: GYAE6OF01CTJBG.39.16.B05.1.454.CMB.1.raw
  modified_base (539)..(539): a, c, t, g, unknown or other
  misc_feature (539)..(539): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagtctttggttttccttgttgcttattttagaaggtgtccagtgtgaggtgcgagtcgtgggtggagtcggtggggggagtcgttggtccgaggtccggtcggggggtccctggacgtacctctccgttgtcgcacgtccctgtggtactttacctaccgtttaaggaacttagttggacttggtaggttcgggtacccgccgaggcgtggacggaagggggaacgggtcgtgggaggtcgggtggaccaagagtaggaggtagagtaggaagaagaagtaaatcgtagtggtacgtactgtgtaggacgggtcctatccactatccgacaggtaacgaaccgaaaccgcgtaaagtacttaccgaatttacgttaaatttaacgaaatcgaacncgtccgtaaggagacgccgaagacctaggtctaagttaacttacgtagttcggacgggaaggggaacgggggtcagggtccgggtcggtacggggtactaaccggggcggggaccccggtaaccgggggtaacccccccg

SEQ ID NO: 28348 - DNA, 786 bp, Homo sapiens
  misc_feature: GYAE6OF01BG06A.39.16.B05.1.454.CMB.1.raw
  modified_base (367)..(367): a, c, t, g, unknown or other
  misc_feature (367)..(367): n is a, c, g, or t
  modified_base (388)..(388): a, c, t, g, unknown or other
  misc_feature (388)..(388): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccagtggaagttggggctgagtcgttgggttttccttgttgcttattttagaaggtgtccagtgtgaggtgcagcgtggtggagtcggtgggggagtcgttggtccgacggtcccggttcggggggtcccctaggacggtaccttccgttcccgttggtcgcctacgtcccttcgtggtacttccgtaaccgtttaaggaacttagttggagtggtggttcggccgaccgaggtcnggcgaaggggagggcgtaggnggtgggtacgaccaagagtaggagtagaggtaggaacgagaagtaaatacgtagtagggtcgtacgtgtaggtaggaaccgggtccgtaattacccgaaccgtactaccgtaccgtaagaccgtaaacccaaccggaaccaaagttcttaaccgtaacgtttaggttaaaaccttaacgtaaagttacggaaacctacgggtaccgttagggaaaccggtacgggtacccggaacggtaaccctcggttttaaccgtacggttaaacccttaggttttaacgtcggggtttaccgggggaaaccgggggttaagggggtctaccggggttcgggtaaccgggttacgggaccccggtttagggggtcccgggggaaaccccggtaaaccccccggggg

SEQ ID NO: 28349 - DNA, 881 bp, Homo sapiens
  misc_feature: GYAE6OF01BBMWZ.39.16.B05.1.454.CMB.1.raw
tcagtcgcactagtcacgaccggtgctcgatttagagctcacgtattgggtttgaggtctcagagaggagccttagccctggactccaaggcctttccacgttggtgatcagcactgagcacagagactcaccatggaagttgggctgagtcgttggttttccttgttgcttagttttagaaggtgtccgagtgtgaggtgcgagtcgtggtggaggtcggtgggggagtcgttcggtcccgacggtcccgggttcggggggtcccctaggacgtaccgttccgtccgttggtcgaccgtacgtcccgttcgtacggttaacctttaccgttaaccgtttttaaggaaacctttaggttaggtaacgttgggttaacgggtttccggggtaccccgtaccgtacgggtaccgttcggacgggaacgggggtaacggggtcgttaggggtaggttcggggtacggaacccgtaagtaacggttaacggggtaaggtaagtaacggtaagggaaaggtaaacgtaaacgtaaaattaccggttagttacgggtacgtaccgtttacggtacgggtaacgggtaaccgggtacccgttacgttaacccgaaccgttacgtaccccgtaacggaaacgaaccgtaaaccgaaacccgtaactaaaggttaaccttacgtaacgtttaacttaaacttaacgaaagtacaaaccgtacggtacgacgaaaggaccggacggaaggacccgtacgttacgtacgttaacgtttaacgtaggttacgggtaacgggaacggggggtaaacgggtccgtaaggggtcccggttacggggtaccgggtacccggttacgggggtacccgggaacccggttaaacccgggg

SEQ ID NO: 28350 - DNA, 714 bp, Homo sapiens
  misc_feature: GYAE6OF01DX00A.39.16.B05.1.454.CMB.1.raw
  modified_base (181)..(181): a, c, t, g, unknown or other
  misc_feature (181)..(181): n is a, c, g, or t
tcagtcgcactagtcacgaccggtgctcgatttagagctcacgtattgggaggtctcagagaggagccttagccctggactcccaaggcctttccacttggtgatcagcactgagcacagaggactcaccatggaattgggctgagtcttgggttttccttgttgcttattttagaaggtntccagtgtgaggtgcagctggtggagtcggtgggggagtcgttggtccaggccggtgggggtccctggacgtacctcttccgtgtcgcgacgcccgttgtggtacttcctaaccgttttaaggaaacttgttaggtacgttgggacggttttacggggccccgaccggagggtaccgttgggaccggtaaggggggaacggggtcgttagggggacgggttgggggtacgacccaaacggtagtagggaagggtagagtagggaaaagtaacgaaagtaaaatcgtataggtggaacttcgtaggaggtaacgggcctaattaccaccactcgtacagtaacgaacgaacgaccaagtaacttctacgttataactttaacaattacgaagacgacaggaacgacggaccggaggtacctacgtctgttaacaagttcgttagggtacgggtaaggggaaagggggtaccagggttcggacggttcgggacggtacgggtccgggggcccggtaacccggggtaaacccccgg

SEQ ID NO: 28351 - DNA, 799 bp, Homo sapiens
  misc_feature: GYAE6OF01A1UCN.39.16.B05.1.454.CMB.1.raw
  modified_base (205)..(205): a, c, t, g, unknown or other
  misc_feature (205)..(205): n is a, c, g, or t
tcagtcgcactagtcacgaccggtgctcgatttagagctcacgtattgggtttgaggtctcagagaggagccttagccctggactccaaggcctttccacttggtgatcagcactgagcacagagacctcaccatggaattggggctgagcttgggtttccttgtgcttatttagaggtctccagtgtgtaggtgcagcgtgggnggtaggttcggtgggggacgtcgttcggccgacggtcccggtcggggggttcccctggtacggtaccttccgtccgtggtcgaccgtacgtcctcgtaggtaccttaccgtaaccgtttaacggaacttagttggacttggtacgggttcggggttccccgacgtagggccttaggaccgggtaagggggaacggggttcgtgggggacggttcggggtaccgtaccgaaacgtgggtaacgggtaaacggttacggaaggtaagggaaaggtaaacgtaaagttaaaacgttcggttaaggtcgtacgggttacgttcggttaacggttacggggaaccgggttacctacgtttaacccacctacgttacccgtacgtaaaccgtacgaacccgtaacggaacccgtaaactaacgtccgtaagttacgttaagtttaaaccgaagtacgaacgtacgtcgtagaggaccgtacggacgtacgtccgtactagttacgtaagttcgtaggtaggggaaccgggtacgggtcgagggttacccggtggttacgggaccgtaacccggggtggggacccccgggttaaccccggg

SEQ ID NO: 28352 - DNA, 767 bp, Homo sapiens
  misc_feature: GYAE6OF01CBVVI.39.16.B05.1.454.CMB.1.raw
  modified_base (193)..(193): a, c, t, g, unknown or other
  misc_feature (193)..(193): n is a, c, g, or t
  modified_base (592)..(592): a, c, t, g, unknown or other
  misc_feature (592)..(592): n is a, c, g, or t
  modified_base (692)..(692): a, c, t, g, unknown or other
  misc_feature (692)..(692): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagcttgggttttccttgttgcttattttagaaggtgtcagtgtgaggtncagcgtggtggaggtcggtgggggagtccgtttacgggtccgacggtcccgggttcggggggtcccctaggacgtaccttccgtaccgttggtcgactacggtccttacgtggtaactttccgtaacgtttagaacttagtggagtcggtagttcggtaccgacgaggtctaggcgtaagggggaggtcgtagggtaggtggggtacgacctaagtagtaacggaaggtacgagtaaggaaagtagaaagtaaagttactagtggtacgtaccttgttaggacgggaacggtaccgtaattcccaactacttaccgaccgtaagaacgaaaccgaaccgtaacccgtaaagtaacgttaacctacgtttaactttaacttaaacgtaatacggtaaacncggtaaccgtaggaacgtccggaacgtaacggtaccgtacgttaaccgtagttaacccgtatttaaggtacggtaacgggtaaccggggaaacgggggtnacgggttggacccgggttagggtacccgtacggggtacccggggaccccgggtaaccccggggttaaaccccccg

SEQ ID NO: 28353 - DNA, 679 bp, Homo sapiens
  misc_feature: GYAE6OF01BQHMG.39.16.B05.1.454.CMB.1.raw
  modified_base (254)..(254): a, c, t, g, unknown or other
  misc_feature (254)..(254): n is a, c, g, or t
  modified_base (427)..(427): a, c, t, g, unknown or other
  misc_feature (427)..(427): n is a, c, g, or t
  modified_base (437)..(437): a, c, t, g, unknown or other
  misc_feature (437)..(437): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgtcttagttttagaaggtgtccagtgtgaggtgcagctggtggagtcgtgggggtagcgttggtccgaggccggtgggggtccccnggacgactcgtcctgtcgctacgtcctcgtaggtacttcctaaccgtttaggaaccttagttcggtagttagtaggtttcgggtaccggccgtaggccttaggcggaaggggaacgggtcgtagggtaggtggggtacgaccaagtagtaggaggtagagtaggaaagagaanaaatactagngggttacgacttcgtagtaggacgggtaccgtactccgaacctagtcccgtacgagaaccaaacgaaccgaccgaaagtaacttcgtaacgttattaacgttaactaaatcgtaaaccgagtacccgagtacgacgacgggacgactcgtgttaaccgtattaaccgtgttggtaggaaggggtaacggggcctagggtcggtaggtacgggtcggtacggtccgggaccggtaacccgggg

SEQ ID NO: 28354 - DNA, 746 bp, Homo sapiens
  misc_feature: GYAE6OF01A1KPU.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccagtggaattggggctgagtcttgggttttccttgttgcttatttagaaggtgtccagtgtgaggtgcagcgtggtggtagtcggtgggggagcgttggccacggtccggttcgggggtccctgacgaccttcgtccgtgtcgcacgcctacgtggtacttccgtaccgtttaaggaacttagttggagttggtacggttcgggtcccgacgtggcgtcggacgggaggggaacgggtcgtggggaggttggggtacggaccaagtaggtaggaggtagtaggtaggaaaggaagaaacgtaaattagtaagtggtagtacttaggtcggtacgggacgggtaccttacgtaccaccgtacttcccgtaaccgaaggaccaaacccgaaccgaaccgtaaacgttaacttaccgtaacgtttagttaaacctttaacaaagttaccgaaacgacgtacgtaagggaacgaaccggtacgggaacggtacctacggttcttaacggtaacttaaggttgtacgggtagggaaacggggggtaagggtcccgtaagggttccgggtacggttacggggtaccgtaccggggtcggggaacccggtaaccccggggg

SEQ ID NO: 28355 - DNA, 1019 bp, Homo sapiens
  misc_feature: GYAE6OF01AGBWS.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccagtggaattgggctgagtcgttggtttttccgttgttgacttagttttagaaggtgtccgagtgtgaggtgcagcgtgggtggtgtacggtggggtagtcgttggtccgaggtccggtcgggggtaccctggcgtaccgtcctccgtgtacgcgtacgtccttagtacgtactttaccgtaaccgtttaacggtaacttgttacggagttggttaacgggttccggggttcccggaacccgtggtccgttacggggaccggtaagggggtaacggggtcggttagggtacgggttacggggtaccggaacccgttaaaacgaggttaacggtaacgggtaaaggtagtaagggggtaaaaggaaacggtaaaacggtaaacgttaacgtttaacgggtttgggtaccggttacgtttaccggggttagggttacgggtaaacccgggggtcccgttaacgttacccgttaaccttaaccggttacccgtaaccccggttaaacgaaaccccgggtaaaccgtaaaacccccgtaaccgggttaaaacccggtttaaaccgtttaaccccgttaaaccgttttaaaccggtttaaacgttttaaaaacccggtaaaccgttttaaacgggaaacccgttaaacggttaccccgggtaaagggtaaccgggaaccgggttaaacccccggacggggttaaaaccccggtccgggtttaacgttcggttaaaaacccgttttgttaaacccgggttttggggaaaccccggggtaaccgggggtaaaaccgggggggttaccgtaccggggtttacgggtacccggttaccggggtacccgggttaacggggtaccccgggggtcccgggttaaaacccccccgggggg

SEQ ID NO: 28356 - DNA, 477 bp, Homo sapiens
  misc_feature: GYAE6OF02JJU13.39.16.B05.1.454.CMB.1.raw
tcagtcgcactagtcacgaccggtgctcgatttagagctcacgtaagggctgggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagcggccctcagggatccctgagcgattctctggctccaactctgggaacacagccactctgaccatcagcgggacccaggctatggatgaagctgactattatgtcaggtgtgggacagcagcaaaggggtgttcgggcggagggaccaagctggaccgtccgtaggtcagcccgaagg

SEQ ID NO: 28357 - DNA, 494 bp, Homo sapiens
  misc_feature: GYAE6OF02GVI40.39.16.B05.1.454.CMB.1.raw
tcagtcgcactagtcacgaccggtgctcgatttagagctcacgtaaggggctgggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagcgcctcagggatccctgagcgattctctggctccaactctgggaacacagccactctacgaccatcagccggacccaggctagtggatgaagctgacttattatgtctaggtgtgggacagcagcgaaggggtgttcgggcggacgggaccgaaggcgtacggaccgttccgtagggtcgacgcccgtaacggg

SEQ ID NO: 28358 - DNA, 506 bp, Homo sapiens
  misc_feature: GYAE6OF02JWJP8.39.16.B05.1.454.CMB.1.raw
  modified_base (228)..(228): a, c, t, g, unknown or other
  misc_feature (228)..(228): n is a, c, g, or t
tcagtcgcactagtcacgaccggtgctcgatttagagctcacgtaagggctgggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattagganataaatatgcttgctggtatcagcagaagccaggccagtcccctgtcgctgatcatctatcaagataccaagcggcctcagggactcctgagcgattctctcggctccaactctcgggaacacgacgccacgtctacgaccatcgacgaccgggacccaggctagtgagtgagtctgactagttatgtactaggttgtgggacagacgagacgtaagggtcggtcggacggagggacgaagcgtacgaccggtccgtaggtaccacggacccgtacgg

SEQ ID NO: 28359 - DNA, 667 bp, Homo sapiens
  misc_feature: GYAE6OF02HT070.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgtggtttcgtcgtagctatttagaaggtgtcagtgtgaggtgcgagcgtggtggagtcgtggggaggcttggtccagccgtgggggtccctgagactctcctgtgcagtcctctggattcacctttaggaactattggatgagttggtccgcgaggctggcagggagggcgtggaggtgggtagaccaacagtagaggtagagtggaagagagaaaatactagtagtaggtacttcgtaggtaggaaacggggaccgtaacgttaccaacccgtaatacctaccgaaggaacgaaccgaaacgacccgaaagtaacgttacctacgttagttaaatttaacctaaaattacgtaaacaacgaccgtacggtacggaacgtacccgtaacggaacgtaaccggttcgttagtaacgttaaccgttaagtttacggttacggacggggtaaaacgggggtccgaagggttcgggcggtaggggtaccgttacggtcgggggacccggtaacccggggg

SEQ ID NO: 28360 - DNA, 522 bp, Homo sapiens
  misc_feature: GYAE6OF02HK0OG.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttaggaactattggatgagttgggtccgccaggctgcagggaaggggctgggagtgggtggccaacgatagaggtagatggaagagagaaatactatgtgactctgtgaagggccgattcacatctcagagacaacgccaagaattcactgtattacaaatagaacagcctgagagcgagacacgtctagtatactattgtgcggaaagggggcaggtggcgtgggctacgtggggccgagggaaccccgg

SEQ ID NO: 28361 - DNA, 169 bp, Homo sapiens
  misc_feature: GYAE6OF02GPGP4.39.16.B05.1.454.CMB.1.raw
  modified_base (167)..(169): a, c, t, g, unknown or other
  misc_feature (167)..(169): n is a, c, g, or t
tcagtcgcactagtcacgaccggtgctcgatttagagctcacgtattgggaggtctcagagaggaaccttagccctggactccaaggcctttccacttggtgatcagcactgagcacagaggactcaccatggaattggggctgagcgggctggcaaggcgcatagnnn

SEQ ID NO: 28362 - DNA, 526 bp, Homo sapiens
  misc_feature: GYAE6OF02GD5VO.39.16.B05.1.454.CMB.1.raw
  modified_base (461)..(461): a, c, t, g, unknown or other
  misc_feature (461)..(461): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctgggggggtccctgagactctcctgtgcagcctctggattcacctttaggaactattggatgagttgggtccgccaggctgcagggaggggctgggagtggggtggccaacagtagaggtagatggaagagaagaaatactatgtgactctgtgaagggccgatcacatctccagagacaacgcaagattcactgtattacaaatgaacacgcctgagagccgaggacacgtcngtatactatgtgacggaagggggcaggtggcgtgggctaggtcggggaccgacgggtaaccccgg

SEQ ID NO: 28363 - DNA, 534 bp, Homo sapiens
  misc_feature: GYAE6OF02JZQJ0.39.16.B05.1.454.CMB.1.raw
  modified_base (340)..(340): a, c, t, g, unknown or other
  misc_feature (340)..(340): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcagctggtggagtctgggggaggcttggtccagccgtgggggggtccctggagactctcctgtgcagcctctggattcacctttaggaactattggatgagttgggccgccagctggcaggggagggctgggagtgggtgccaantaggaggtagatgggaagagagaaatctagtgtggactcgtggtgaacgggcgatcacactctccagagacaacgacaagaacttcactgtattacaatagaacagcctagagacgccgaagacgacgtctagtatactagttgtagacggtaagggggcaggtggcgtgggctacggtgggaccgaaccgggg

SEQ ID NO: 28364 - DNA, 522 bp, Homo sapiens
  misc_feature: GYAE6OF02FQBG4.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggaggcttggtccagcctgggggtccctgagactctcctgtgcagcctctggattcacctttaggaactattggatgagttgggtccgcaggctgcagggaagggctggagtgggtggccaacatagaggtagatggaagagagaaatactatgtggactctgtgaagggccgattcaccatctccagagacaacgccaagaattcactgtatttacaaatgaacagcctgagagccgagacacgtctgtatactagttgtgacggaaagggggcaggtggcgtgggctacggtggggccgtaacgggg

SEQ ID NO: 28365 - DNA, 549 bp, Homo sapiens
  misc_feature: GYAE6OF02IC7NH.39.16.B05.1.454.CMB.1.raw
  modified_base (304)..(304): a, c, t, g, unknown or other
  misc_feature (304)..(304): n is a, c, g, or t
  modified_base (342)..(342): a, c, t, g, unknown or other
  misc_feature (342)..(342): n is a, c, g, or t
  modified_base (487)..(487): a, c, t, g, unknown or other
  misc_feature (487)..(487): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttaggactattggatgagttgggtccnccgaggctgcgagggagggctggaggtgggtggccaanatagaggtagatgggaagagagaaaatactatgtggactctgtgaaggcgattcacatctcagacgaacaacgaccaagaattacactagttatttaacaaatgaacagcctagagacgccgaaggacacgtctagtataacttnttggtggacgggaaagggggcaggtggcgtgggacgtacggtcggggaccgtaacccggggg

SEQ ID NO: 28366 - DNA, 682 bp, Homo sapiens
  misc_feature: GYAE6OF02IFLZR.39.16.B05.1.454.CMB.1.raw
  modified_base (306)..(306): a, c, t, g, unknown or other
  misc_feature (306)..(306): n is a, c, g, or t
  modified_base (616)..(616): a, c, t, g, unknown or other
  misc_feature (616)..(616): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggtttcctgttgctattttagaagtgtcagtgtgaggtgcagctgggtggagtcgtgggggaggcttgggtccaggccgtggggggtccctggagactctcctggtgcagcctctggattcaacctttaggaacttattaggatgaggttgggtccncaggctggcagggaagggctgggagtggggtggacccaaagataggaggtagagtagggaagagagtaaatacgtagtggagtacgtcgtaggtacggaagggtcccgtaagttccgaaccagttaccgtacccaaggtaacgaacgtaaccgaacccgtaaacggtaaactttaccgaacgttacggttaaactttaacgtaaaactacggtaaactaacgggtaccttaacggaagtacggaccggaagaccggtaacgtcccgtagtaacgtacgtttagttggtaacggtacggaaacggggggtntaacgggtgggtacgttaggggaccggttacgggacggggttcccgaacgggggtaaccccccggg

SEQ ID NO: 28367 - DNA, 533 bp, Homo sapiens
  misc_feature: GYAE6OF02IB11F.39.16.B05.1.454.CMB.1.raw
  modified_base (449)..(449): a, c, t, g, unknown or other
  misc_feature (449)..(449): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttaggaactattggatgagttgggtccgccaggctgcagggaaggggctggagtgggtggccaacatagaggtagatgggaagagagaaatactatgtggactctgtgaagggcgattcaccatctccagagacaacgccaagaattcactgtattacaaatgaacagctgagngccgaggacacgtctgtatactagttgtagacgggaaagggggcaaggtggcgtgggcttacggtcggggccgtaacccggggg

SEQ ID NO: 28368 - DNA, 559 bp, Homo sapiens
  misc_feature: GYAE6OF02IX1AH.39.16.B05.1.454.CMB.1.raw
  modified_base (303)..(303): a, c, t, g, unknown or other
  misc_feature (303)..(303): n is a, c, g, or t
  modified_base (379)..(379): a, c, t, g, unknown or other
  misc_feature (379)..(379): n is a, c, g, or t
  modified_base (447)..(447): a, c, t, g, unknown or other
  misc_feature (447)..(447): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttaggaactattggatgagttgggtccnccaggctgcaggggaagggctgggagtgggtgaccgaacgagtagaggtagagtggaagagagaaaatactagtgnggactcgtagtagaagggccgattcacatctccagagaccaacgccaagaacttcacttataacttanaaatgaaacagacctgaacgagaccgaaggacacgtcgtagtatactagttggagacggggaaaggggctaggtcggacgtgggaccgtacggcggggaccctaaccggggg

SEQ ID NO: 28369 - DNA, 711 bp, Homo sapiens
  misc_feature: GYAE6OF02JY22T.39.16.B05.1.454.CMB.1.raw
tcagtcgcactagtcacgaccggtgctcgatttagagctcacgtaagggcggtgggcctcaggaagcagcatcggaggtgcctcagccatggcatggatccctctcttcctcggcgtcccttgcttactgcacaggatccgtggcctcctatgacgctgtctcagccacgctcagtgtccttgtccccaggacagacagccagcatcacctgctctgaaatacattaggagtataaatatgcttgctggtactcgagcagaagccgaggccacgtcccctagtcgctgactcatctatacaacgactacccaaggccgtaccctacgacgggtaccttcccgtggacgccgtaacttccgtacgtcggaccttacccaaccgttccgtacgggaaccacgacgtaccgtactccgtacgaaccacgtaccgaacgggacccgggaaccccgagggtacccgttaagttcggaaccgtaacgggtaacggtccgtacgtaacgtttaacgtttagttacggtaccgtaaggggtttcggacggggtaaacctacgggtaccgtaacgggtaaccgggttaaacgggggtttaccgggtttaacccggggggacgggtaaaaccgggggtaacccgtaaacgggttccgtaaccgggtaacccggttacccggtaacgggtaacccggtaccggtaaccccggtaaacccggg

SEQ ID NO: 28370 - DNA, 584 bp, Homo sapiens
  misc_feature: GYAE6OF02JO9DL.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggcctggggggtccctggagactctcctgtgcagcctctggattcacctttaggactattggatgagttgggtccgccaggctggcaggggaagggctggaggtggggtgccaacgagtaggaggtagagtggaagagaagaaatactaagtgtaggactctggtaggaacgggcgagtcaccatctccagacgacaacgcaagattacactagtattacaatagaacagcctagacgacgaccgacggaacgtacgtacgtagtacttacgtagttggtacggtacgggaaacggggggtactaagggtagggtcgtagggtccggtaacggtcgggggaccgtaacccggggg

SEQ ID NO: 28371 - DNA, 529 bp, Homo sapiens
  misc_feature: GYAE6OF02G494W.39.16.B05.1.454.CMB.1.raw
  modified_base (479)..(479): a, c, t, g, unknown or other
  misc_feature (479)..(479): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttaggaactattggatgagttgggtccgccaggctgcgagggaggggctgggagtgggtggccaacataggaggtagatggaagagagaaatactatgtggactcgtgtgaagggcattcacatctcagagacaacgcaagaattcactgtattacaatgaacagacctgagacgaccgaggacacgtctagtatactattggngacggaagggggcaggtcggcgtgggctacggtcggggcccaaccggggg

SEQ ID NO: 28372 - DNA, 542 bp, Homo sapiens
  misc_feature: GYAE6OF02FFQEM.39.16.B05.1.454.CMB.1.raw
  modified_base (265)..(265): a, c, t, g, unknown or other
  misc_feature (265)..(265): n is a, c, g, or t
  modified_base (304)..(304): a, c, t, g, unknown or other
  misc_feature (304)..(304): n is a, c, g, or t
  modified_base (340)..(340): a, c, t, g, unknown or other
  misc_feature (340)..(340): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctntggattcacctttaggaactattggatgagttgggtccncaggctgcaggggagggctgggagtgggtggccaanataggaggtagatgggaagagaagaaatactaagtggtggactcgtggtggaacggggccgatcaccatctccagacgacaacgcaagaatcactgtaatttacaaatagaacagcctagagagccgagacacgtctagtatactattggtgacgggaagggggcaggtggcgtgggcgtacggtcggggaccgaaccgggg

SEQ ID NO: 28373 - DNA, 547 bp, Homo sapiens
  misc_feature: GYAE6OF02HM4VM.39.16.B05.1.454.CMB.1.raw
  modified_base (491)..(491): a, c, t, g, unknown or other
  misc_feature (491)..(491): n is a, c, g, or t
tcagtcgcactagtcacgaccggtgctcgatttagagctcacgtattgggtttgagggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcacctttaggaactattggatgagttgggtccgccaggctgcagggaaggggctggagtgggtcggccaacgagtagaggtagatggaagagaagaaaatactatgtggactctagtgaaggggccgattcaccatctcagagacaacgccaagaacttcacttgtatttacaaatgaacagcctagagagccgaggacacgtctgtactactagttgnggacggaagggggcagggtcggcgtgggtcgtacgtcggggaccctaacccggggg

SEQ ID NO: 28374 - DNA, 533 bp, Homo sapiens
  misc_feature: GYAE6OF02F4YOO.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcccgtggggggtcccctgagactctcctgtgcagcctctggattcacctttaggaactattggatgagttgggtccgccaggctgcagggaaggggctggagtgggtggccaacatagaggtagatggaagagagaaaatacatgtggactctgtgaagggcgatcacatctccagagacaacgccaagaatcactgtattacaaatgaacagctagagacgacgagacacgtctgtatactagttgtggacggaaagggggcaggtggcgtgggtacgtacgttcggggccgtaacccggggg

SEQ ID NO: 28375 - DNA, 774 bp, Homo sapiens
  misc_feature: GYAE6OF02JY6SI.39.16.B05.1.454.CMB.1.raw
  modified_base (342)..(342): a, c, t, g, unknown or other
  misc_feature (342)..(342): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcagctggtggagtcgtgggggaggcttggtccagccgtggggggtccctgagactctcctgtgcagcctctggattcacctttaggaactattggatgagttgggtccgccaggctgcgaggggagggctgggagtgggtggccaanagtaggaggtagagtaggaagagaagaaatactagtgtaggacttcgtaggtaggaaaggggcccgtaagtttaccgaacccgtagtacccgtaccgaaaggtaaacgaaaccgaaaccggtaacccgaaaaggttaaacctttaccgtaaaccgttacggtttaaacttttaaaccgtaaaaagtttaacggaaaaccgtaacggtacccctttaagggaaacggtaaccgggaaacccgggtaacgggtaaacccgtaaaccgggtttaccgttaacgggttaaccttaaaccgtttaaggtttaacgggttaacgggtaaccggggggtaaaaacggggggggtcgtaacggggttacggggtaccgggtacggggggttaccgtaacccggggttccggggggaaccccggttaaacccccggggggg

SEQ ID NO: 28376 - DNA, 667 bp, Homo sapiens
  misc_feature: GYAE6OF02IMUN2.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggagcttggtccagccgtgggggtccctggagactctcctgtgcagcctcgtggattcctaccgtttaaggaacttagttggaatggtaggtttcggggtcccgccgaggccgtggcgaagggggaaggggctgggaggtgggtcggaccaaacgtagtaagaggtaagagtagggaaagaagaagtaaatactaatggtagactgtagtaggaacgggtccgtacttaccaacctatcctaccagaacgaaccaaccgaccaagtaacttctaacgttagttaactttaacaaattcgaaactacgtacctagacggaacgacccggaaagaccgtaaccgtcttagttaacgttacgttagtttgggtacggaacggggaaaggggggtaccgtaagggtcgggtcggtcggggtacctacggggtacggggacccgtaaccccggggg

SEQ ID NO: 28377 - DNA, 517 bp, Homo sapiens
  misc_feature: GYAE6OF02IPH3C.39.16.B05.1.454.CMB.1.raw
  modified_base (377)..(377): a, c, t, g, unknown or other
  misc_feature (377)..(377): n is a, c, g, or t
  modified_base (429)..(429): a, c, t, g, unknown or other
  misc_feature (429)..(429): n is a, c, g, or t
  modified_base (484)..(484): a, c, t, g, unknown or other
  misc_feature (484)..(484): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcacctttaggaactattggatgagttgggtccgccaggctgcaggggagggctgggagtgggtgccaacatagaggtagagtggaagagagaatactatgtgactntgtagagggcatcacatctcagagacacgcaagaatcactgtattacaaatnaacagctagagacgacgaggacacgtctagtactattagtgtagacggaaggggnaggtggcgtggctacggtcgggaccgaccgggg

SEQ ID NO: 28378 - DNA, 544 bp, Homo sapiens
  misc_feature: GYAE6OF02IAZNH.39.16.B05.1.454.CMB.1.raw
  modified_base (266)..(266): a, c, t, g, unknown or other
  misc_feature (266)..(266): n is a, c, g, or t
  modified_base (415)..(415): a, c, t, g, unknown or other
  misc_feature (415)..(415): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcttgggtccagccgtggggggtccctgacgactctcctgtgcagccctntggattcacctttaggactattggatgagttgggtcccgccaggctgcagggaaggggctgggagtggggtggccaacatagaggtagagtgggaaagagagaaatactaatggtgactctgtgaagggccgattcaccatctccaganacaacgcaagaattcattgtatttaacaaatagaacagacctgagagccgagacacgctagtatactattgtgacggaaaggggggcaggtggcgtgggctacggtcgggaccgacgggtaacccccgg

SEQ ID NO: 28379 - DNA, 552 bp, Homo sapiens
  misc_feature: GYAE6OF02H2HXM.39.16.B05.1.454.CMB.1.raw
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
  modified_base (454)..(454): a, c, t, g, unknown or other
  misc_feature (454)..(454): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcttggtccagccgtggggggtccctgagactctcctgtgcagcctctggattcacctttaggaactattggatgagttgggtccnccaggctgcagggaggggctgggagtgggtggccaanatagaggtagatggaagagaagaaaatactatggtaggacttctggtaggaaggggccgtaattcaaccatctacagagacaacgacaaagaattcactagttaatttaanaaatagaaacagcctagagagccgaaggacacgtctagtatacttatgtgacgggaagggggcaggtggcgtgggcgtacgtggggaccgaaccgggg

SEQ ID NO: 28380 - DNA, 472 bp, Homo sapiens
  misc_feature: GYAE6OF02GJGO4.39.16.B05.1.454.CMB.1.raw
  modified_base (347)..(347): a, c, t, g, unknown or other
  misc_feature (347)..(347): n is a, c, g, or t
  modified_base (436)..(436): a, c, t, g, unknown or other
  misc_feature (436)..(436): n is a, c, g, or t
tcagtcgcactagtcacgaccggtgctcgatttagagctcacgtaaggggctgggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagccggcctcagggactccctgagcgattctctgctccactctggaacncagccactctgaccatcacgccggacccaggctagtgatgaagctagactattattgtcaggtgtgggacagcagcgaagggtgtcggnggacggacagcgtcgaccgtctaggcacgccaacgg

SEQ ID NO: 28381 - DNA, 542 bp, Homo sapiens
  misc_feature: GYAE6OF02I6IXL.39.16.B05.1.454.CMB.1.raw
  modified_base (301)..(301): a, c, t, g, unknown or other
  misc_feature (301)..(301): n is a, c, g, or t
  modified_base (405)..(405): a, c, t, g, unknown or other
  misc_feature (405)..(405): n is a, c, g, or t
  modified_base (464)..(464): a, c, t, g, unknown or other
  misc_feature (464)..(464): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggtttccttgttgctattttagaaggtgtccagtgtgaggtgcagctggtggagtcgtgggggaggcttggtccagccgtggggggtcccctgagactctcctgtgcagcctctggattcacctttaggaactattggatgagttgggtccnccgaggctggcgagggaggggctgggagtgggtggccaacataggaggtagatggaagagagaaatactatgtgactctgtgaaggccgatcaccatctcaganacacgaccaagacttcactgtacttaacaatagaacagcctagagagccgagacacgtntagtatactattggtcgacggaaaggggggtctaggtggacgtcgggactacggtcggggccgacggggtaaccccgg

SEQ ID NO: 28382 - DNA, 537 bp, Homo sapiens
  misc_feature: GYAE6OF02GNQ7X.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttaggaactattggatgagttgggtccgccaggctgcaggggaagggctgggagtgggtggccaacagtagaggtagatggaagagagaaatactatgtgactctgtaggaagggctattcaccatctcagagacacgaccaagatcactgtaattacaaatagaacagcctgagagccgagacgacgtctagtatactagttgtggacgggaaggggtacgaggcggtcgtagggctacggtcgggacgtaacccgggg

SEQ ID NO: 28383 - DNA, 558 bp, Homo sapiens
  misc_feature: GYAE6OF02JYWZY.39.16.B05.1.454.CMB.1.raw
  modified_base (437)..(437): a, c, t, g, unknown or other
  misc_feature (437)..(437): n is a, c, g, or t
  modified_base (451)..(451): a, c, t, g, unknown or other
  misc_feature (451)..(451): n is a, c, g, or t
  modified_base (475)..(475): a, c, t, g, unknown or other
  misc_feature (475)..(475): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaggtgtccagtgtgaggtgcagctggtggagtcgtgggggaggcttgggtccagccgtggggggtccctggagactctcctgtgcagcctctggattcacctttaggaactattggatgagttgggtccgcgaggctgcgagggaaggggctgggaggtggggtggccgaacgagtaggaggtagatggggaaagagaagaaagtactagtgtggactgtgtagaagggcgatcacatcaccagacgacacgacaagattcactntattacaaatgaanagcctagacgagccgagacacgtntagattacgtattggtggaacgggaagggggtcagggtcggtcgtgggtaccgtcggtacgggggccacggggtaacccccgg

SEQ ID NO: 28384 - DNA, 579 bp, Homo sapiens
  misc_feature: GYAE6OF02G9G35.39.16.B05.1.454.CMB.1.raw
  modified_base (407)..(407): a, c, t, g, unknown or other
  misc_feature (407)..(407): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttaggaactattggatgagttggtccgccaggctgcgaggggaagggctggaggtggggtggccaacgagtaggaggtagagtgggaagagaagaaatactagtgtgactcgtgtgaagggccgatcaccatcncagacgaacaacgaccaagaattacactagttaatttaacaaatagaaacagacctagaagacgaccggaaggaaccgacgtctagtaatacttagttggtaggacgggaaaggggggcgaaggtgggcgtcggggccgtacggtcggggaccggacggggtaacccccggg

SEQ ID NO: 28385 - DNA, 582 bp, Homo sapiens
  misc_feature: GYAE6OF02J1HY2.39.16.B05.1.454.CMB.1.raw
  modified_base (305)..(305): a, c, t, g, unknown or other
  misc_feature (305)..(305): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcagctggtggagtcgtgggggaggcttggtccagccgtggggggtccctgagactctcctgtgcagcctctggattcacctttaggaactattggatgaggttgggtccnccaggctgcgagggaggggctgggaggtgggtggccaacagtaggaggtagagtgggaagagaagaaatactagtgtggactcgtagtaggagggccgattcacatctacgagacgacaacgacaagtaacttcactgttaattaacaaatagaacagcctagagacgccgaagacctacgtctagtactagttacgttggtaggacgggtaaagggggctaaggggtcggtacggttcgggtaccgtacgggtacggggacccgtaaccccggggg

SEQ ID NO: 28386 - DNA, 593 bp, Homo sapiens
  misc_feature: GYAE6OF02HQ7HX.39.16.B05.1.454.CMB.1.raw
  modified_base (350)..(350): a, c, t, g, unknown or other
  misc_feature (350)..(350): n is a, c, g, or t
  modified_base (479)..(479): a, c, t, g, unknown or other
  misc_feature (479)..(479): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagcccgtgggggggtcccctggagacctctcctgtgcagcctctggattcacctttaggaacttattggatggagttgggtccgcgaggctgcgaggggagggctggaggtgggtgaccaanagtaggaggtagagtgggaagagaagaaaatacgtatgtggactgtaggtaggaacgggacgtacttccacctatcctacagacgaacaacgacaaagtacttacattattaattaacaaatagaacancgtagagacgaccgaaggacacgtctagtactacgttagttcggtaggacgggaagggggctagggtcggtcggtcgggtaccgtacgggtccggggacccggtaaacccgggg

SEQ ID NO: 28387 - DNA, 647 bp, Homo sapiens
  misc_feature: GYAE6OF02HTT3M.39.16.B05.1.454.CMB.1.raw
  modified_base (320)..(320): a, c, t, g, unknown or other
  misc_feature (320)..(320): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattgggctgagctgggttttccttgttgcttattttagaaggtgtccagtgtgaggtgcagctggtggagtcgtgggggaggtcgttgggtccaggccgtggggggtccctggacgactctcctggtcgcagcctcgtggtattctaccgtttaggaacttagttggatggtaggttcgggtcccncgaggctgacgagggaaggcgtagggtaggtgggtcgaccaagtagtaaggaggtagagtagggaaagagaagaaatacgtagtgtaggactcgtggaggaacggtcgtattccgacacttccacgaaggagtaaccaacgaccgaaagtaacttaccgaattagttaacttaaacaaatacgaactacgtacctagaagacgaccgaggaccgtacgttacgtagttaactacgttagtttcggacggtaacggggaaaggggcctaaggtcggacgttacggggccgttacgggtaccgggacccggtaaccgggtaacccccgg

SEQ ID NO: 28388 - DNA, 680 bp, Homo sapiens
  misc_feature: GYAE6OF02I0TVU.39.16.B05.1.454.CMB.1.raw
tcagtcgcactagtcacgaccggtgctcgatttagagctcacgtattgggaggtctcagagaggagccttagccctggactccaaggcctttcccacttggtgatcagcactgagcacagaggactcaccatggaattggggctgagctgggtttccttgttggtatttagaggtgtccagtgtgaggttgcagctggtggagtcgtgggggaggcttggtccagccgtgggggtccctgagactctcctgtgcagcctctggattcaccgtttaggaactattcggatgagttgggtccgccgaggctgcgaggggaacgggcgtgggagtgggtcggaccaacgtagtaggaggtacgagtagggaaagaggaagtaaaactctaagttggtacggacttcgtaggtacggaacgggccgtaatttccgacccttatccgttacccaaggacgtaacctaaacgtaccgaaagtaacttccaacttacgttaactttaaacaaaacgttcgaaacgtacgtaccttaggaacggacggacccggaaggaaccgtacggtacgttaagtaacttacgttagttggtacggtaacgggtaaacggggggtctaagggttcggtacgttacgggtaccgttaccggtcgggggacccgtaaccggggtacccccggtaccg

SEQ ID NO: 28389 - DNA, 788 bp, Homo sapiens
  misc_feature: GYAE6OF02JNETR.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctatttagaaggtgtccagtgtgaggtgcagctggtggagtcgtgggggagcttggtccagccgtgggggtccctgacgactctccgtgtcgcacgcctcgtggtacttccgtaaccgtttaaggaacttagttgggattggtaggtttcggggtacccgccgacgggtcgttcggaccggtaaggggggtaacgggggtccgttaggggaacggggttcggggggttaccgggaaccccgtaaaacggtaacgggttaaaggggaacggggttaaggtaaggttaggggaaaaggtaagggaaaggtaaaaagtttaccgttaaggttagggtacggtaaccttggttagggtacgggtaaacgggggccctaaatttcccgaacccgtaagttcccctacgaaagggaacgaacccgtaaaccgaccctaaaggtaacctttccgaaactttagttaaactttaaacaaagtttacgaaaccgtacgtcccgtaaggaaccgtacgaccggtaaggacctacgttctaaggttactacgttaggttcggtaacggaacgggggtaagggctaagggtcggtacgtcgggaactcgggtacggggacccgtaacccgggg

SEQ ID NO: 28390 - DNA, 667 bp, Homo sapiens
  misc_feature: GYAE6OF02GOXWN.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagcttgggttttccttgttgctattttagaaggtgtccagtgtgaggtgcagcgtgggtggagtcgtggggggaggtcgttggtccacggtccgtcgggggggtccctggacgtacctctccgtgtcgcagtcctcgtggtacttactaccgtttaaggaacttagttggatggtaggttcgggtcccgccgaggcgtcggcggagggggaggggtcgtggggtagggtggggtcggaccgaagagtaggaggtagagtaggaagaagaagaaatactagtggtacgactcgtaggtggaacgggtctacgttaccactatcctacgaagacgaaccacgaaccaagtactacacgttattacttaaacaagtacgaacacgtccgtaaggacgacgaccggaacgtaaccgacggttcctaagttactattaggttggtaagggaaccggggtaaagggggtctaagggtcggtacggtcggtaccgtacgggtccggggaccgtaacccggggtaccccgg

SEQ ID NO: 28391 - DNA, 578 bp, Homo sapiens
  misc_feature: GYAE6OF02G3QCT.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcttgggtccagccgtggggggtccctgagactctcctgtgcagcctctggattcacctttaggactattggatgagttgggtccgccaggctgcgaggggaagggctgggaggtgggtggccaacgagtaggaggtagagtgggaagagaagaaatacgtatggtagactctaggtggaagggtccgattacaccatctccagagacaacgaccaaagaacttcattcgtaattaactaaatagaacagcccgtagacgagccgaacgacgacgtctagtatacttagttggtggtacgggaaaggggggcaggtcggcgtcgggccgtagggtcggggacccgacggggtaacccccggg

SEQ ID NO: 28392 - DNA, 545 bp, Homo sapiens
  misc_feature: GYAE6OF02FOO6N.39.16.B05.1.454.CMB.1.raw
  modified_base (404)..(404): a, c, t, g, unknown or other
  misc_feature (404)..(404): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttaggaactattggatgagttgggtccgccaggctgcagggaaggggctggagtgggtggccaacataaagcaaagatgggaagtcggaaagagtatcgtggactctgtgaggggccggttcaccatcnccagagacaacgccaagaactccgtgcactctgacaaatcgaaacagtctgaagaggacccgaggacacggcttagtttatactggcgcggaaggaagaggacgtggggcggtttcggactacggtcggggcctaacgggg

SEQ ID NO: 28393 - DNA, 662 bp, Homo sapiens
  misc_feature: GYAE6OF02HF390.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcggtcggtttcgtgtaggcgtatttagaaggtgtccagtgtgaggtgcagctggtggagtcgtggggaggcttggccgagccgtgggggtcccctggacgctctccgtgtgctagcctctagtacttctacctttaggacttagttggatggtaggttcgggtccaccgaggtcctggaccggagggggaaggggccgttaggggaggttcggggtaggcccctaaagtagtaggaaggtacgaagtagggaacgaaggaaacgaaaagttactaagtgtacggtactacggtaggtacggtaacggggccgtacttaccgaacctagtccctaaccgagacgaaacgaaccggacctaaagtaactactcgtagttactttaacaacgtagaaccagacgtgagacggtacgaacgactacgtcgttagtatacttagttcggaacggtacgggaaacggggtcgtagggtcgcggtggaccgtacgggtcggggtacccggacccggggg

SEQ ID NO: 28394 - DNA, 639 bp, Homo sapiens
  misc_feature: GYAE6OF02GFPD3.39.16.B05.1.454.CMB.1.raw
  modified_base (482)..(482): a, c, t, g, unknown or other
  misc_feature (482)..(482): n is a, c, g, or t
  modified_base (509)..(509): a, c, t, g, unknown or other
  misc_feature (509)..(509): n is a, c, g, or t
  modified_base (562)..(562): a, c, t, g, unknown or other
  misc_feature (562)..(562): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttatttagaaggtgtcagtgtgaggtgcagctggtggagtcgtgggggaggcttggtccagccgtggggggtccctgagactctcctgtgcacgcctctggacttctacctttacgagttattggctgagtcgtcgggtccgccgaggcctccgaaggggtaaggggttggagggtggggtcggaccgaaacgaagtaaagacgaaagagtagggaaaggtacggaaaagtagtagtcgtaggacttcgtggtaggacggggtccggttaccaccagtccacgagacgaaccaaacgaccaaacgacctcgganacgattccgtagaactaaatcgaaacngtactagaacgtacgcccgtaaggccacggtcttagtttactactggaaccgnggaacggaagggtaacggtcgggttcgggtccgtttacggaccgttacgggtccggggacccgaaggggtaaccccg

SEQ ID NO: 28395 - DNA, 701 bp, Homo sapiens
  misc_feature: GYAE6OF02GIF1T.39.16.B05.1.454.CMB.1.raw
tcagtcgcactagtcacgaccggtgctcgatttagagctcacgtaaggggctgggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagaccagccagcatcaccgtgctcgtaggaatacattaggagataaatatgcttgctggtatcagcagacgccgaggccacgtccctgtcgctgatctatctatacaagtactaaccgaacgcccggtaccctagaaccgggtacttccccgtaggaccgtcgtactttccgtcgtacggtacccttaccgtaaccttccgggtaacggaaccctaaccgaacgtacccctacgttacccgtacgaaccctagtacccggaaccgggtacccgggtaaccccacggggtactacggttacgggtacgtaacggaaacgtcccgttaagtaaccttaagttttacgttacgttacgggttacgggtttacgggtacgggaacgttacggaacgacgggttaccggtaagggggtttccggtaaccggggtaccgggtaaccgggacccgtaacggtccggtacccggtacccgttaccggtaaccggtccgaacccggacccgtaaccgggg

SEQ ID NO: 28396 - DNA, 609 bp, Homo sapiens
  misc_feature: GYAE6OF02HPWHP.39.16.B05.1.454.CMB.1.raw
  modified_base (263)..(263): a, c, t, g, unknown or other
  misc_feature (263)..(263): n is a, c, g, or t
  modified_base (448)..(448): a, c, t, g, unknown or other
  misc_feature (448)..(448): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggaggcttgggtccagccgtggggggtccctgagactctctgtgcagcctntggattcaacctttaggaactattggatgtaggttgggtcccgccgaggcgtggacgaggggaaggggcgtgggaggtggggtcgaccaacgtagtaggaggtaagagtaggaagagaagaaatactagtgtgactgtgaggacgggctattcactatcacagacgacaacgacaagtatcagtnttaattaacaatacgaacacgtacctagacgacgaccggaagaccgtactacgtacgtattacttagttaggtacggaacggggaaaggggggtacgtacgggttgggacggttacgggaccgtaacgggtcggggtacccggacccggggtaacccccgg

SEQ ID NO: 28397 - DNA, 599 bp, Homo sapiens
  misc_feature: GYAE6OF02IPT85.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgacgactctcctgtgcagcctcgtggattccacctttaggaactatgccatgagcgtggggtccgccgaggttccgaggggaacgggcgtgggaggtgggtctcgattcgtggttaaccggtccgtcggttaccaccacatacgtacgacaagaaacgtggacggggtcccgttacacctatcctaccgagacgactaacttccgaaggaacaccacgtggactcgtacgactagtttacgaactagtctaggacggacccgacgacgaccgtacctaattaactagttacgttacaactacgtaccgacggcctaccgacgtaggtcgcgtgggtacgtcggttactcgtacg

SEQ ID NO: 28398 - DNA, 993 bp, Homo sapiens
  misc_feature: GYAE6OF02I8XWC.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagcttgggttttccttgttgcttattttagaggtgtcagtgtgaggtgcagctggtggagtcgtggggggagtcttggtccaggccgtcggggggtcccctaggacgtaccttccgtccgtgtcgccacgccttccgtggtactttcctaacccgttttaagggaaacctttagtttacgggattagggtagggttttcgggggtccccgtcccgtaagggtccgttgggaccgggtaaaggggggaacggggggtccgttagggggtaaggggtttcggggggtccgggtaaccccgaaaccggtaaaggttaacggggaagggggtttaaggaaggggttaaacgggggaaaacggggtaaaggtaaaacgggttaaaaattaaaccggttttaaggttacgggggttacgggttaaacgtttcccggttaggggttaacgggggtaaaccggggggtccccgtttaaaggtttacccccgtaacccgtaacgtttaccccgttacccggaaacgggtaacggtaaaaccccgtaacccggtaaaccccgtaaaaggttaaaccctttaccggttaaacctttaggtttaaaccgttttaaacctaaaaacgggtacggttaaaaaccgccggttaacccgttagggaaaccggacggggtaaccccgggtaaagggtaccccggtaaaccggttttctaagggttaactttaacccggttacgttttaggggtaacgggtaaccgggggaaacggggggtccgtaaggggttcgggaccggttcggggttaccggttaccgggggtacccgggggtacccggaacccgggggttaacccccccggg

SEQ ID NO: 28399 - DNA, 702 bp, Homo sapiens
  misc_feature: GYAE6OF02HZZYC.39.16.B05.1.454.CMB.1.raw
  modified_base (258)..(258): a, c, t, g, unknown or other
  misc_feature (258)..(258): n is a, c, g, or t
  modified_base (306)..(306): a, c, t, g, unknown or other
  misc_feature (306)..(306): n is a, c, g, or t
tcagtcgcactagtcacgaccggtgctcgatttagagctcacgtattgggaggtctcagagaggagccttagccctggactccaaggcctttccacttggtgatcagcactaagcacagaggactcaccatggaattgggctgagctgggttttccttgttgctattttagaagtgtccagtgtgagtgcagctggtggagtcgtgggggagcttggtccagccgtgggggtccctagacgctctcctgtgcagcctntggacttctacctttaaggaacttagttggatcgtaggttcgggtccnccgaggctggacgaggggtaacgggtctagggaggttggggtacggacccaaacgagttacggaagggtagagtagggaaagaggaaagtaaatacttaagtggtacggtaacttcgtagggtaggaacggggccctaatttaccgacccgtaactcccgtaccgacggtaacgaaccgaaaccgaaccaaaggtaaacttccaacgtttagttaacttttaacaaaacttacgaaacctaacgtaccgtagtaacgacgacccggaaggaaccgtaccgtacgttagtacttaacgttagtttacgtagggtaaccgggaaaggggggacgtagggtcgggtacggtcgggtacgtaccggtacggggaccggtaccgggaacccccggttacgg

SEQ ID NO: 28400 - DNA, 723 bp, Homo sapiens
  misc_feature: GYAE6OF02F90OB.39.16.B05.1.454.CMB.1.raw
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
tcagtcgcactagtcacgaccggtgctcgatttagagctcacgtaaggggctgggccgtcaggaagcagcatcggaggtgcctcagccatggcatggatccctctcttcctcggcgtccttgccttactgctacaggactccgtggcctcctatgagctgtctcagccacgctcagtcgtccgtcgtccccaggacagacacgccagccactccacctgcctctaggaactacagttagganactaaatntgcttgctggtatcagcaagacgccgaggccaccgtcccgtggtcgctgacttcatcgtaatcaagtactaaccgagccggcctaggacggtacttccgaggacgtcttactcgtcgtacgtccctaaccgtaacgttccgggaaaccggaacacccgtacgtaccccgttaacgtaccgtaccggtaaacctacgtaccgggtaaaccgggaccccgggtaaaccccgtaggtaccgtttaacggtcggtaaaccgtaacggaagttacccgtaaacgtttaacccgtttaagttttccgttaccggttaagggttaccgggtttaaggtaaccgggtacctaaggaccgtaggggtaaccgggtacgggggtttcgggttaacccggggaacgggttaaaccgggttacaacgggttccggttacggtaacccggttcggtaaccgggttccaccgggaccccgtaacggg

SEQ ID NO: 28401 - DNA, 729 bp, Homo sapiens
  misc_feature: GYAE6OF02H6O7P.39.16.B05.1.454.CMB.1.raw
  modified_base (366)..(366): a, c, t, g, unknown or other
  misc_feature (366)..(366): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcagctgggtggaggtcgtggggggaggtcgttggtccaggtccggtcggggggtccctgagactctcctgtgcagcctcgtggacttcctacctttacgagtttatggctgagcgtgggtcccgcgaggcctcggagggtaacggggttggaggtcggggtcgaccaanaataaacgcaagacgtaggaaggtacggaaaggtagtagtacgtaggtactcgtagggtagggacgggggtcccgttacaccgactccgtaccgaacggaacgtaaccgaaaccggtacccgaaaacggtacccgtaccgtagaccaattcgagtaaccaaagtacgtaacgaacgttcgtaggacgacggaccggaagggaccgacggttaccttagggtttttaactaccggtcggtaccggacgggtaaaggaacgggtaaacggggttaaccggtcggggggtttacccgggtttaccggtaaaccggttacccggggtacggggggtaccccggtaaacccgggggttaacccccggg

SEQ ID NO: 28402 - DNA, 693 bp, Homo sapiens
  misc_feature: GYAE6OF02H4QW0.39.16.B05.1.454.CMB.1.raw
  modified_base (190)..(190): a, c, t, g, unknown or other
  misc_feature (190)..(190): n is a, c, g, or t
  modified_base (322)..(322): a, c, t, g, unknown or other
  misc_feature (322)..(322): n is a, c, g, or t
  modified_base (453)..(453): a, c, t, g, unknown or other
  misc_feature (453)..(453): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgcttattttagaaggtgtccagtgngagtgcagctggtggagtcgtgggggaggtcttggtccgagtccgtgggggggtccctgacgactctccgtgtgcagcctctggattccacctttaggaacttagttggatgtaggttcggtccgccgaggntgcggaagggaggggtcgtggagggttggggcggtacccaagagtaggacggtagaggtaggaagagaagaaatactagtgagtactgtagtaggacggggtcgtactccgactactcccgtacacggaanacccgaacgacaaagtaacttctaacgttagttaatttaaacaaatacggaactacgtacccgtaggaaacggacggaccgggacgtaaaccgttaccggtaccgtagttacgttttaacttagggttttacggaccgggttaaccgggggaaaacgggggggttcgaacggggttcgggtcggtacggggttacccggttacccggggagggggtacccccggttaaacccccgggggg

SEQ ID NO: 28403 - DNA, 663 bp, Homo sapiens
  misc_feature: GYAE6OF02G7VB2.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttcctgttgctattttagaaggtgtccagtgtgaggtgcagctggtggagtcgtgggggaggcttggtccagccgtggggggtccctgagactctcctgtgcagcctctggattcaccgtttaggaacctagttggatggagtttcggggtcccgccgagggctggccgaggggaaggggctgggaggtggggtggaccaacgagtaggaggtagagtgggaagagaagaaatactagtgtagactcgtggtaggaagggccagttcacctatcctaccagacgaactaacgaccaaagtaacttcacttagttaatttaaccaaagtacgaaacacggtacccgtaggaacgacggacccggaacggaaccgtaacggttacgtaggttaaccttacgttaagtttacgggtaggaaccgggggtaaagggggggtctaaggggtcgggtacgttacgggggtaccttaccgggtcggggggtacccgtaccgggggtaaccccccggg

SEQ ID NO: 28404 - DNA, 606 bp, Homo sapiens
  misc_feature: GYAE6OF02IC9E5.39.16.B05.1.454.CMB.1.raw
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
tcagtcgcactagtcacgaccggtgctcgatttagagctcacgtattgggtttgaggtctcagagaggagccttagcccctggactccaaggcctttccacttggtgatcagcactgagcacagaggactcaccatggaattggggctgagctgggttttccttgttgctattttagaaggtgtccagtgtgaggtgcagctggtggagtctgggggagcttgggtccagccgtggggggtcccctggagactctcctgtgcagcctctggattcacctttaggaactattggatggagttgggccgccgaggctgcgagggagggctggngtgggtggccaanatagagtagatggaaganaagaaatacgtatgagactcgtgtggaagggccgtatcaccatcctcagacgaacaacgaccaagtaacttacaacttgttaaatttaacaaaacgttacgaaacacgaccgtagaagaacggtccgaaggaccgacgtactagtaacgtacttaagtggtaacggacgggaaaacggggggtactaacggtgggtaccgtacgggtaccgtaacgggtaccggggtaccgaaaccccgggggg

SEQ ID NO: 28405 - DNA, 790 bp, Homo sapiens
  misc_feature: GYAE6OF02JUQWR.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtggggggaggcttcggtccaggtccgtgggggggtcccctggacgactccgtcctggtgcacgcctcgtggattctaccgtttaggaacctagttggatgtaggttcgggcccgtcgagggtctggcggaaggggagggcgtggggtacggtggggtcggaccgaacgagttagggaaggtaggaacgtagggaaagaaggtaacgaaaacttaacgtaaggtagtacgggtaacttcggtaggtacgggaacggggtaccggtacgtttaccgaaccgtaacgtcccgttacccggaaggtaaacgtaaccgtaaaccggaacccgaaacggttaaacgtttaccgaacgtttaacgtttaaacgtttaaaaccgtaaaagttaacgtaaaaccggaacggttacccgtaaggggaaacggtaaccggaccggtaaccgggaacccgtacgttacgttagttacgttaacgtttacgttacgggtacgggtaacggggtaaaggggggtaccgtaagggtcgggtacggttccggggtacggtaccgggttacgggggtacccggtaaccccggggg

SEQ ID NO: 28406 - DNA, 678 bp, Homo sapiens
  misc_feature: GYAE6OF02JDRT2.39.16.B05.1.454.CMB.1.raw
  modified_base (309)..(309): a, c, t, g, unknown or other
  misc_feature (309)..(309): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtggggggagcttgggtccaggcccgttggggggtccctgacgactctcctgtgcagcctctggattcacctttaggaactattggatggagttgggtcccncaggctgcgtaggggaggggctggaggtgggtggaccaagagtaggaggtagagtagggaagagaaggaaactacgtaagtcggtagggaaccttgtaggtagggaacggggtacctaagttaccgaacctatccgtaccgaaggtaacgaaccgaaaccggaaccgaaaaggttaaccttacgtaacttaagttaactttaaaccgaaattacggaaacacggtaccttagggaacgacgtacccgggaaagtaccgtacgtacgtagtaacttacgttattacggtggaaccggggtaaaggggggtcctaagggtcggtcgtggggacctaacgggtcggggacccggtaaccggggtaaccccgg

SEQ ID NO: 28407 - DNA, 702 bp, Homo sapiens
  misc_feature: GYAE6OF02JBMMQ.39.16.B05.1.454.CMB.1.raw
  modified_base (165)..(165): a, c, t, g, unknown or other
  misc_feature (165)..(165): n is a, c, g, or t
  modified_base (179)..(179): a, c, t, g, unknown or other
  misc_feature (179)..(179): n is a, c, g, or t
  modified_base (216)..(216): a, c, t, g, unknown or other
  misc_feature (216)..(216): n is a, c, g, or t
  modified_base (262)..(262): a, c, t, g, unknown or other
  misc_feature (262)..(262): n is a, c, g, or t
  modified_base (610)..(610): a, c, t, g, unknown or other
  misc_feature (610)..(610): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaatgggctgagtgtggttttcctgttgntagttttagaggtntccagtgtgaggtgctagcgtggtggagtcgtggggngtcttggtccagccgtcgggggtcctaggacgtactcctcctgganccgtagccgttcgaggtacttcctaacgtttaacggaacttattgggaactggtaggtttacgggtccgccgtaggtcgtcggaggaacgggggaagggtcctaggggtaagggttcgggccggtaacccgaaaacgtagtaaagggaaggtacgaagtacgggaaagaacaaagtaaagtacgtagtagtcggtaacttgtagtaaggaacggggaccctaagttaccaacgactacgtaccgaagaaccgaacgaaaccgaacctaaaggtaattaccgacttagttaaattaaccgtaaagtaataccgaagtacccgtaagaccgttaagacgacgtaaaccgngtaacttagttactacgttagtcgttaggaaccggtacggggtagtaacgtggtaccggtggttgtaccgggttacgcccgggtaaaccggg

SEQ ID NO: 28408 - DNA, 741 bp, Homo sapiens
  misc_feature: GYAE6OF02JX753.39.16.B05.1.454.CMB.1.raw
  modified_base (256)..(256): a, c, t, g, unknown or other
  misc_feature (256)..(256): n is a, c, g, or t
  modified_base (351)..(351): a, c, t, g, unknown or other
  misc_feature (351)..(351): n is a, c, g, or t
tcagtcgcactagtcacgaccggtgctcgatttagagctcacgtattgggaggtctcagagaggagccttagccctggacctccaaggcctttccacttggtgatcagcactgagcacagaggactcaccatggaattggggctgagctgggtttcctgttgctatttagaggtgtccagtgtgaggtgcagctggtggagtcgtgggggagcttggtccaggccgtgggggtccctggagactctcctggtgacncgcctgtggacttcaccgtttaaggaacttagttggagtgtaggttcggtccgccgaggctggcgaggggagggctgggaggtgggtcgaccaanagtaggagtaggaagtaggaagtagaagtaaatactagtacgtaggacttgaggtaggaacggggcctaagtttccaaacccgagtttcccgaccgaaaggtacgaaaccgaacgtacccaaaggaacctttacgacgtttaacggttaaactttaaacgaaacgtggaaaaccgacggttcccgtaaaggtaccggggaaaggtacccccgggaaaggaacccttacggtaaccggttagtaaaacgttttacccgttaggtttaacggggtcgggggtaaaaccggggtaaacgggggggccttaaggggtaccgggttacggtaaccggggggttaccgttaaccgggtccgggggggttacccaaacccggggggttaacccccgg

SEQ ID NO: 28409 - DNA, 554 bp, Homo sapiens
  misc_feature: GYAE6OF02HFKRV.39.16.B05.1.454.CMB.1.raw
  modified_base (204)..(204): a, c, t, g, unknown or other
  misc_feature (204)..(204): n is a, c, g, or t
  modified_base (282)..(282): a, c, t, g, unknown or other
  misc_feature (282)..(282): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgcttattttagaaggtgtccagtgtgaggtgcagctggtggngtctgggggagcttggtccagccgtggggggtccctgagactctcctgtgcagcctctggattcacctttaggaactnttggatgagttggtccgcaggctgcgagggaagggctgggagtggggtgccaagatagaggtagagtgggaaagagaagaaatactagtgtggaactcgtggtgaaggggccgattccaccatctacgagacgacaacgaccaagaacttacactagttattaacaaatacgaaacagaccgtagagagaccgagaactacgtctagtatacgtattgtgaggaagggggacaggtggcgtgggctacggcgggaccgacgggtaaccccgg

SEQ ID NO: 28410 - DNA, 618 bp, Homo sapiens
  misc_feature: GYAE6OF02FQMFS.39.16.B05.1.454.CMB.1.raw
  modified_base (346)..(346): a, c, t, g, unknown or other
  misc_feature (346)..(346): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgagtgcagctggtggagtcgtgggggaggcttggtccagccgtggggggtccctgagactcctcctgtacagcctctggattcgaggtttagtgaccgcctggactaaacgtgggtcccgccgaggctaccgagggaaggggctgggagtgggtcnccgaacagttaagaaagatggaagtgaagaaaactagtaggtgactcgtgtagggaacgggtaccggtttaaccagtccgtccgaaggggaaccaaccgacctaagtgactattacgcatttagtttcgaataaataaacgagtctaggagacgaccggacggacacggtacctactaagtactactactcgtcgcggtcggtcggggactacgttacgttggtacggttcggtacgggacccggtaacgggaccgtaccggtctaccccgg

SEQ ID NO: 28411 - DNA, 794 bp, Homo sapiens
  misc_feature: GYAE6OF02H0UN9.39.16.B05.1.454.CMB.1.raw
  modified_base (278)..(278): a, c, t, g, unknown or other
  misc_feature (278)..(278): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagcttgggttttccttgttgcttattttaggaaggtgtccagtgtgaggtgcagtcgtgggtggagtcggtggggggtaggtcgttgggtccaggtccgtcgggggggtccctggagacctccgtctggtgccngtcctcgtggtacttacgtaaccgttaggaacttagttggataggtaggttcgggtcccgacgtacggtccgtggaccggaaggggaacggggtcgtaggggtaacgggtcggggttacggcccgtaaaacgtaggtaaacgggtagggttaaaggtaggtaagggaaaacgggtaaggaaacggtaaaagtaaccgttaagtaggtacgtaacggttcgtagggtaggaacggggtccgttagtacctaccgtaacgtctaccggtaagaacgacgtaaccgacgtaaagtaaacttacgtaacgttacgttaattaaactaaataacgaacgaacgtacccgagtaaccggacggtacccggaagtaaccggtacgtaacttaacgtacttaacgttaggttacggtaacggtaacgggtaaacgggggggaaccgtaacgggttccgggtcggttacggggttaccggtaaccggggttcggggtacccgggtacccggggtaacccccgggg

SEQ ID NO: 28412 - DNA, 727 bp, Homo sapiens
  misc_feature: GYAE6OF02JAVEO.39.16.B05.1.454.CMB.1.raw
  modified_base (165)..(165): a, c, t, g, unknown or other
  misc_feature (165)..(165): n is a, c, g, or t
  modified_base (681)..(681): a, c, t, g, unknown or other
  misc_feature (681)..(681): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggtttcctgttnctattttagagtgtccagtgtgaggtgcagctgggtcgggagtcggtgggggagtcgtttcgggtaccacggtccgggttccgggggggtaccctaggacgtaccttcctccgtggtagccgcggtccctggtggtacttacccgtaccgtttaaggaacttaggtggtactggtacgggttcgggtccccgtacgcgggtcctacggcggaacggggggaacgggtcgtggggtagggtcgggtacggacccgtaaataggtaaggtaacgggtagtaggtaacggaaaggaggtaaacgtaaaagttcgtaagttcgggtaacggtctacgttaggacgggtacgggccttacgttacccacgaccttcgacccgtagacaaccgaaccgaaccaagttactacgtaccttagtttaacttaactaaacaggtaaacctcgacgttcggaagaccggacggttacacgttccgtacgttagacttaacgtgttgggaccgtaggggaaccgggngtaaggtccggaggtccggtagccgggtagggccggtaaccccggg

SEQ ID NO: 28413 - DNA, 683 bp, Homo sapiens
  misc_feature: GYAE6OF02HDZS9.39.16.B05.1.454.CMB.1.raw
  modified_base (182)..(182): a, c, t, g, unknown or other
  misc_feature (182)..(182): n is a, c, g, or t
  modified_base (486)..(486): a, c, t, g, unknown or other
  misc_feature (486)..(486): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgtggtttcctgtagctatttagaaggtgtcngtgtgaggtgcagctggtgagtcgtgggggaggtcgttggtccagtccgtcggggggtccctgaacgcttcctcctgtcgcagtccctctggtacttcctacccgttttaggaaacttacgttaggactggtaaggttggggtcccgccgtaggtcctggacgagggggaacgggtcgtagggagttggggtaccggaccaaacggtgtaaggaggtaacgagtaagggaagaagagaaactcgtaatgtacggaactgtacggtaggaaccggggtctagttaccactagtccctgaacgtanaacgtaacgacccgaaagtaacttcctacgttagttaacctttaaataacgtacaaacggtacgtaccgtagtaacgacggaccgtaacggactaacggtcttaagtacgttacttaaggttggtaacggaacgggtaagggggactaggtcgggtacgtccgggtagttaccgggaccgggccggtaaccccgggg

SEQ ID NO: 28414 - DNA, 733 bp, Homo sapiens
  misc_feature: GYAE6OF02HS7D2.39.16.B05.1.454.CMB.1.raw
tcagtcgcactagtcacgaccggtgctcgatttagagctcacgtaagggctgggcctcaggaagcagcatcggaggtgcctcagccatggcatggatccctctcttcctcggctccttgcttactgcacaggatccgtggcctcctatgagctgtctcagccacgctcagtcgtccgtcgtaccccaggacacgacacgccagcatccacctgctgtaggaactcagttagataactaaatcgtcgtcgttagcgttgtactcgagcaaggaccgcgtacggccctacgtccccgtgtcgtcctaggtactacacgttacctacgtaagaacgaccgttacccgaggtacccggtccctacggtacgttacccgttaccccgtaggccgtacgttactttccgtccgtaccggttacctacccgttaacgtaccgggtaaccgtaaacgaccgtaaccgtccctaaccggttacctaccgtaaccgtcgtaccggtaacccgggcccgggtaaccctaggttaccttaacgggtacgtaccggtacgaaccggtcgtttaaaccggtaacttttaacggttacgtttacggtaacggttacgggtagggttaccggaacgtaccggtacgaagggtaccgggtacgggttacggtacgggacgggtaacccggacgtacggttacgtacccggtacccgtaacggtccggaccggtaccgacccgtaacccgg

SEQ ID NO: 28415 - DNA, 607 bp, Homo sapiens
  misc_feature: GYAE6OF02FOCDB.39.16.B05.1.454.CMB.1.raw
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggaggtcttggtccgaggcccgggggggtccctggagactctcctgtgcagcctcgtggactttccccttagtagttatggctggagtcgtgggtccgcgaggctccgagggtaggggtgaggtgggnggaccaanagtaaacgcaaagagtaggaagtcggaaagagtatcgtagactctgtaggacggggtccgtacgacctatcgaccgagacgaacgacgaccaagtaaccgtccgtgcatctagacaaatagaacgtagtcgtagagtacgacgacgacgacgtcttacgttacgttagcgtcgacggtagaacgggaagtacggtacgggtaccgtttacggacgtacgggtacgggtacccggaacgggacccgtggtaccccg

SEQ ID NO: 28416 - DNA, 577 bp, Homo sapiens
  misc_feature: GYAE6OF02HX9PZ.39.16.B05.1.454.CMB.1.raw
  modified_base (185)..(185): a, c, t, g, unknown or other
  misc_feature (185)..(185): n is a, c, g, or t
  modified_base (274)..(274): a, c, t, g, unknown or other
  misc_feature (274)..(274): n is a, c, g, or t
  modified_base (462)..(462): a, c, t, g, unknown or other
  misc_feature (462)..(462): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
  modified_base (503)..(503): a, c, t, g, unknown or other
  misc_feature (503)..(503): n is a, c, g, or t
  modified_base (547)..(547): a, c, t, g, unknown or other
  misc_feature (547)..(547): n is a, c, g, or t
tcagtcgcactagtcacgaccggtgctcgatttagagctcacgtattgggtttgaggtctcagagaggagccttagccctggactccaaggccctttccacttggtgatcagcactgagcacagaggactcaccatggaattggggctgagcttgggttttccttgttgcttattttagaaggtntccagtgtgaggtgcagctggtggagtcgtgggggaggtcttggtccaggccgtggggggtcccctggagacctctcctgtgcagcctntggacttcacctttaggaactgttggatgaggtttcgggtccgccgaggctggcgaggggaaggggctgggaggtgggtcggccaagataggaggtagagtaggaagagaagaaatacgtatggtgacttcgtgtagggaaggtccgtactcacctatccgtacagacgacacgacaagattcacttntattaacaatanaacgacncgtgagacgaccgagacacgtntagttatactagtggtacggaacgggaaggggtcaggtggcggnggtaccgtggtcgggaccgtaaccccgggg

SEQ ID NO: 28417 - DNA, 873 bp, Homo sapiens
  misc_feature: GYAE6OF02GS878.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattgggctgagctgggtttcctgttgctatttagaaggtgtccagtgtgaggtgcagcgtggtggagtcgtgggggagtcgttggtccaggccgtggggggtccctgagactctccgtgtgcagcctctggtacttcaccgtttaggaacttagttggaattggtaaggtttcggggtaccccggacccgaagggtccgttggaccggtaacggggggaaacggggtccgttaggggaggttgggggtaccgggacccgaaaaccgtaaggttaaggaagggttaaggtaaggttaaggggaaaacggtaagggaaaggtaaaaacttaaaccgttaagttagggttacggtaaccgttccgttagggtttaacggggaaacgggggtacccgttaacgtttaccctaacccgtaactttccccgtaaccgaacggtaacggaaaccgtaaacccgggaaccctaaaagggtaaactttaccgtaaccgtttaacgtttaaacttttaaacctaaaagttacgtaaaaccgtacggtacccgttaaggaacgggtaccgtaccggaaacgggtaaccgtaaccggttcgtaacggtttacgttaacgtttaacggtttgggtaaccgggttacgggggtaaaacggggggggtacgtaaggggttacgggtaccgggttcggggtaacccgttaccggggttaccgggggaaccccggttaaaccccccgggggg

SEQ ID NO: 28418 - DNA, 661 bp, Homo sapiens
  misc_feature: GYAE6OF02H95QX.39.16.B05.1.454.CMB.1.raw
tcagtcgcactagtcacgaccggtgctcgatttagagctcacgtaaggggcgtgggcctcaggaagcagcatcggaggtgcctcagccatggcatggatccctctcttcctcggcgtccttgcttactgcacaggactccgtggcctcctatgagctgtctcacgccacgctcagtcgtccgtcgcccgttttttacggacgagacacgccagacactaccaccgtcgtctacgtaacggtaaactacgtaagttaggaagtaaattaaattaatggtccgttacgtcgtaggtactacgagacgaagaacggaccggacggccgtaccgttcccgtgtcgtcgtagtactctactacttatacaagtactaaccgaacggccgcccgtacgacggtacgtaccgtacggacgtacgtacgttccgtcgtacgtcctactacgtacgacgactacgacgtaccgtactcgtacgaccgtacgtacggacggaccggtccgaacgtacgttacgacgtaggactacgtacgttagtaacttcgttaagtgtacggtagtagggttacgagtacgaggtagacgggttacggtcggtacgggacggtacggactaccgggtctaccgggaccgttcggtaccgggactccggaccgtaccggg

SEQ ID NO: 28419 - DNA, 888 bp, Homo sapiens
  misc_feature: GYAE6OF02JKACA.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttcttgttggtatttagaggtgtcagtgtgcggtgcagttggtggagtcgtgggggagcgttggtccgaggtccggggggggtccctggagtactcgtcctgtgcagcctcgtggtacttccccttagagttattggctgagcgtcgggtccgcctaggcctccgaggggtaaggggttggagggtgggtcggaccgaaacgtaagtaaaaggcaaggtacgtaggaaacggttacgggaaaagtagttaacgtcgtacgggtaacttcggttaggtaggggaacgggggttccccggtttaccgaaccgtacgttccgtacccgtaaggaacgaaaccgtaaaccgacccgtaaaaccggtaacccgtttcccgggtaacgtccctaaacgttccggtacgaaaccgtaaaacgttaccggaaaaccgtacgggttaacccgttaagggaacggaacccgggaaccccggtaagggggtaaaccccgtaacccggggggttacttttaagggttttttaacccgttaaaccggttcgggtaacccgggtaccgggggttaaaaggacccgggggaaaacggggttaccggtttacgggggggggtttaaccccgtttttaaccggggtaaacccggttaacccggggttcccggggggtaaaccccggtaaccgggggttaaacccccggtttcggggttaaccccggtacccccggttttaccggtcccccgg

SEQ ID NO: 28420 - DNA, 643 bp, Homo sapiens
  misc_feature: GYAE6OF02JB5MW.39.16.B05.1.454.CMB.1.raw
  modified_base (397)..(397): a, c, t, g, unknown or other
  misc_feature (397)..(397): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtggaggtgcagctggtggagtcgtgggggagcttggtccagccgtggggggtccctgacgactctcctgtgcagccgtcgtggacttccacctttaggaactattggatgagttcgggtccgcgaggctgcgagggaagggctgggaggtgggtcggaccaacgtagtaggaggtaagagtagggaagagaagtaaatagtatggtagtacncgtggtagaacgggtccgtatacacagtctccgagacgaacgaaccgaccgaaagtacttacgtacttagttaactttaaactaaatcgaaaccagtaccgtaggacgacggtaaccgacggaaccgtaacgtcgtacgttattacgttaacgtttggtacggtaaccgggaagggggtacgtagggttacgggacgttcggggacgttacgggtaccggggaccggaacccggggtaacccccgg

SEQ ID NO: 28421 - DNA, 559 bp, Homo sapiens
  misc_feature: GYAE6OF02HM0OS.39.16.B05.1.454.CMB.1.raw
  modified_base (306)..(306): a, c, t, g, unknown or other
  misc_feature (306)..(306): n is a, c, g, or t
  modified_base (408)..(408): a, c, t, g, unknown or other
  misc_feature (408)..(408): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcttggtccaggccgtgggggggcccctggagactctcctgtgcagcctctggattcacctttaggaactattggatggagttgggtccnccaggctgcgagggaggggctgggagtggggtggaccaacatatagggtagatgggaagagagaaatactagtgtggactgtgtaggacgggcatcacatcncagagacaacgacaagacttcactgttaattaacaaatgaacagacctagagacgccgagactacgtactgacttacgttagtttggtaggacgggaaggggggtcagggttggcgtgggctacgggtcgggaccgacggggtaaccccgg

SEQ ID NO: 28422 - DNA, 561 bp, Homo sapiens
  misc_feature: GYAE6OF02GCCGB.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttgggtccagccgtggggggtccctgagactctcctgtgcagcctctggattcacctttaggaactattggatgagttgggtccgccaggctgcgaggggaaggggctgggagtgggtggccaagagtagaggtagagtggaagagagaaatacatgtggactcgtgtaggagggcgattcaccatctcagacgaacaacgaccaagaattacactagttattaacaaatagaaacagaccctagacgagaccgaagacacgtctagtactactagttgacggacgggaagggggcaaggtcgggcgtgggaccgtacggtcggggaccgtaacccgggg

SEQ ID NO: 28423 - DNA, 711 bp, Homo sapiens
  misc_feature: GYAE6OF02IAI91.39.16.B05.1.454.CMB.1.raw
  modified_base (187)..(187): a, c, t, g, unknown or other
  misc_feature (187)..(187): n is a, c, g, or t
  modified_base (363)..(363): a, c, t, g, unknown or other
  misc_feature (363)..(363): n is a, c, g, or t
  modified_base (376)..(376): a, c, t, g, unknown or other
  misc_feature (376)..(376): n is a, c, g, or t
tcagtcgcactagtcacgaccggtgctcgatttagagctcacgtattgggtttgagtctcagagaggagccttagccctggactccaaggcctttccacttggtgatcagcactgagcacagaggctcaccatggaattgggctgagctgggttttcctgttgctattttagaggtgtccagtgtgnggtgcagctggtggagtcgtgggggagcttggtccagccggtgggggtccctggagtacctctccgtggtcgcacgtcctcgtggtacttcctaccgtttaggaactagttggattaggagttcgggtccgccgaggtcctggcgaggggaagggtctgggagtgggtcgaccaanagtacggagtagngtaaggaacgagaacgtaaatactgtagtacggacttcgtggtaacgggacgggtaccgtagttacccgaaccgtagtcccgtacgacggtaacgaaccgtaaccgaaccgtaaacgtaacgtttaaccgtaacgtttacgtttaaacgtttaaactaaactacggtaaacctaacggtcctaaggaacggtacggacccggaacggtacccacgttacgttagtaacgttaaccgtttagtcgggtaccgggaacggggtaaccggggggtataacgggttacggcgggtacgggtacccggtagggttacccggggtacccgaaccccggggg

SEQ ID NO: 28424 - DNA, 841 bp, Homo sapiens
  misc_feature: GYAE6OF02G2FCQ.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattgggctgagctgggttttccttgttgctattttagaaggtgtccagtgtgaggtgcagcgtggtggagttcgtgggggacggcgtttggtccgagtcccggtcgggggggtccctgacgacctcctccgtgtgctacggccttcgtggtactttaccgtaaccgttttaaggaacttagtttagggattagggaggttttcggggacccgtcccgaagggtccgttggaccggaagggggaaggggtcgtaggggacgggtgggggtacgggacccgaaacgtaaggtaaggtaacgggttaggaacgtaaggggaaaaggtaaggaaaagtaaaaacgtttaccgtaggttaggtaggttaaccgttcggttagggtaacgggaacggggtacccggttagttaccgaaccctaatcccgttaccgaaggaaacgaaccgaaaccggaaccaaaggttaaactttaaccgtaacgttagtttaaacctttaaacgtaaaacgtacgaaacgtaaccggtcctaacgggaacggtaacgggcccggtaaagggtaacctaaccggttcgttacggttaacttaacgtttacggttagggttaacgggtaagggggaaacggggggtaccgtaacggggttaccgggttcgggtacgggtaccggttaacgggtcccgggggtaccggtaaacccccggggg

SEQ ID NO: 28425 - DNA, 619 bp, Homo sapiens
  misc_feature: GYAE6OF02IA6C7.39.16.B05.1.454.CMB.1.raw
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (377)..(377): a, c, t, g, unknown or other
  misc_feature (377)..(377): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccaggccgtggggggtccctgagctctctgtgcagcctctggtatccacctttaggaacttattggatggagttgggccgccaggctgcgagggagggctggagtgggngccanatagagtagagtggaagagagaaaatctagtgtgacttctgnggaacgggcattccgaccatctaccgagacgaacaacgcaaagtaacttcagttagttactttaacaaatagaacgacgtaccgtaggaacgacgacccggaagaccgacgttacttagtaacttacttaggtttcggtcggtaaacggggaaacggggggtccgtaagggttcgggacggttcggggtaccgttaaccggggttcggggggacccccgtaacgggggttaaacccccccgg

SEQ ID NO: 28426 - DNA, 599 bp, Homo sapiens
  misc_feature: GYAE6OF02IIZCG.39.16.B05.1.454.CMB.1.raw
  modified_base (457)..(457): a, c, t, g, unknown or other
  misc_feature (457)..(457): n is a, c, g, or t
  modified_base (494)..(494): a, c, t, g, unknown or other
  misc_feature (494)..(494): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaggtgtccagtgtgaggtgcagctggtggagtcgtgggggagcttgggtccaggccgtggggggtcccctggagctctcctgtgcagtcctctagggtattcctacctttaagggaaccttagtttaggattggtaaggtttcgggggttcccgccgaaggggtcctggtcggagggggaaggggtctggggagtggggtcggaccaacgagtaggaggtagagtgggaagagaagaaagtactagtgaggtactgtgtggacggcgattaccacgatccncagacgacacgacaagaatcatgtattacaatcgaanagctagagacgccgaaggacctagtactagtactacgttagttgtggacgggtaagggggcagggtacggcggtcgggacgtacggtcgggaccgtaacccgggg

SEQ ID NO: 28427 - DNA, 806 bp, Homo sapiens
  misc_feature: GYAE6OF02HQOKT.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagtcgttggtccagtccgtggggggtccctaggagactctcctgtcgcagccctcgtggtacttcgtacctttaggaacttattcggaatggtaggtttcgggtacccgccgtaggtccgtggaccgaagggggaacggggcgttggggaaggttcgggggtagggaccccaaacgtaaggttaaggaggggtaagtaggtaaggggaaaggaaggaaaggtaaaacttacgttaagtagggttacggtacctttacggtggtaagggaaacggggtcccgttaagtttacccgaaacccgtaacgttcccctaacccgtaaggaacggtaaacccgaaaccggaaccctaaaaggtaaaccttaccgtaaccgtttaaggtttaaactttaaaccgtaaaataccggtaaacacggtaaccctaggaacgacgggacccgggtaagaaccgtacgttacggtagttacgttaaccttaagttttcgggaacgggtacggggtaaaacggggggtcgttagggttacgggccggttacgggggtacttaaccgggggtccggggacccggtaacccgggttaaccccccgggg

SEQ ID NO: 28428 - DNA, 659 bp, Homo sapiens
  misc_feature: GYAE6OF02JVDTH.39.16.B05.1.454.CMB.1.raw
  modified_base (145)..(145): a, c, t, g, unknown or other
  misc_feature (145)..(145): n is a, c, g, or t
  modified_base (150)..(150): a, c, t, g, unknown or other
  misc_feature (150)..(150): n is a, c, g, or t
  modified_base (163)..(163): a, c, t, g, unknown or other
  misc_feature (163)..(163): n is a, c, g, or t
  modified_base (189)..(189): a, c, t, g, unknown or other
  misc_feature (189)..(189): n is a, c, g, or t
  modified_base (211)..(211): a, c, t, g, unknown or other
  misc_feature (211)..(211): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (366)..(366): a, c, t, g, unknown or other
  misc_feature (366)..(366): n is a, c, g, or t
  modified_base (409)..(409): a, c, t, g, unknown or other
  misc_feature (409)..(409): n is a, c, g, or t
  modified_base (533)..(533): a, c, t, g, unknown or other
  misc_feature (533)..(533): n is a, c, g, or t
tcagtcgcactagtcacgaccggtgctcgatttagagctcacgtattgggtttgaggtctcagagaggagccttagccctggactccgaaggcctttccacttggtgatcagcactgagcacagaggactcaccatggaatgggntgagntgggtttctgtgntatttagaggtgtccagtgtgagtgnagctgggtggagtcgtgggggngtcgttcggtccgagcccggtcgggggggtcccctggtaacgccgtnttccnggtcgcgaacgtcctccgtggtacttccgtaaccgtttaggaactagttcggatcggtaggttcgggccacgaggtctggacggacggggaagggtctagggngtcggggtcgactaagagttaaggaggtagacggttagggaanaggaacgtaaattacggagtaggttagacgttacgttggacggtaacgggtccgacttacacaaggttcaccggagtaaccaacgaacgttacaaaggttctacacggtattaaagttacaaancgaaacgtcgacgttgacgtaacggcgttaagcgtagtaagttcataggttacttcgaacgggtacggggaaaggtccaacgggttggccgtaacgggtcgtaagggtccgggaacggtacccggg

SEQ ID NO: 28429 - DNA, 974 bp, Homo sapiens
  misc_feature: GYAE6OF02ITN35.39.16.B05.1.454.CMB.1.raw
tcagtcgcactagtcacgaccggtgctcgatttagagctcacgtaaggggcgtgggcctcaggaacgcagcatcggaggtgcctcagccatggcatggatccctctcttcctcggcgtccttgccttactgcacaggactccggtggcctcctatgacgtctgtctcacgcccacgctcgtagtgtccgtcgtccccagggaccagacacgccaacgcacgtcctaccgtgccgttacgtacggaaactacgtaacgttaagggactaattaaacgttagtcggtacttacggtacgttcgggttaacttacgacgtaacgaacggtaacggacccgaacgggtaccccgttaccggttcccccctttagggtaccggtacggtacggttaaccttacgtaacgtttaccgtaacgtaaaccgtaaacgtaacccgtaacccgtaaaccggtaccccggtcccgtaaacggaaccggttacccgtacccgtaggtaacgtaccgttaacgtttccgtacggttccgtacccttaccgaaccgtttaccgggtaacggaaccgtaaccgaccgtaaccccgttaacgtcccgttaaccggaaccttaaccggtccggtaaacccgggtacccggggtaccccgtaagggtaccggttaaacggttacggtaaaccggtacggtaaccgggttaaccgttacgttaaaccggttttaacgtttaaccggtttacgggtaaacccggggttacgggttaacgggggttaacggaaacccgttacgggggaaccgtaaaccggggttacgggggtaaaacggggggtttcggggtaaacccgggggttaaacccgggtaccggggggtaaaacccggttaaccggggttaacccggttaacccgggtaaccccgggggttaaccgtttaaccccgggggtaaccggttaaccccgggttaaccccggtaacccggggg

SEQ ID NO: 28430 - DNA, 623 bp, Homo sapiens
  misc_feature: GYAE6OF02I761D.39.16.B05.1.454.CMB.1.raw
  modified_base (440)..(440): a, c, t, g, unknown or other
  misc_feature (440)..(440): n is a, c, g, or t
  modified_base (537)..(537): a, c, t, g, unknown or other
  misc_feature (537)..(537): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgtgggttttccttgttgctattttagaaggtgtccagtgtgaggtgcagctggtggagtcgtgggggagcttggtccagccgtggggggtccctgagactctcctgtgcagtcctgtggactttcctaccgtttaggaacttattggatgtaggttcgggtcccgccgtaggctggcgagggggagggctgggaggtggggtcggaccaagtagtaggaggtagagtaggaaggagaagtaaatactagtggtaggactgtaggtacgaacggggtcctattccaactntacctaccgagaacacaaccgaccaaagtattaccacttgttaactttaacaaagttacgaaacacgtctaggaagacgaccggacgacctacggtntagttacttagttagttcggtaggaacggggtaaggggctagggtcggcggttcggacggtacgggtcgggacccgtaaccggggg

SEQ ID NO: 28431 - DNA, 821 bp, Homo sapiens
  misc_feature: GYAE6OF02JBDUY.39.16.B05.1.454.CMB.1.raw
tcagtcgcactagtcacgaccggtgctcgatttagagctcacgtagttgggtttgaggtctcagagaggagccttagccctggactccaaggcctttccacttggtgatcagcactgagcacagaggactcaccagtggaagttgggctggagtcgttgggtttttccttggttgtctttaagtttttaggaagggttcgtccgtagtggtggaggtgcaggtcgtggtggagtcggtggggagtcgttcggtccacggtccggtgggggtccctgacgtctcgtccgtggtcgcgtacgccttcgtagtacctttacgtaaccgtttacggaacttagttaggtagttgggttacgttccgggtcccgtccggtaacgggtcgttacgggcggaaacgggggaacgggtcggtaggggtacgggttcgggtaccggactaaacggtaaggtacggtaaggtaggtaaggtaagggaacgaaagtaaacggtaaaagttacgttaaggtaggtacgtaggttacgtagggtaaagggtaccggaccgttaaacttaccgtaacgttaacgtaccgtaacgagtaaaccggtaccaaacccggtaacgaaaggtaacccttacttaccgtttaacgttaaacgtttaacaaacgttacgtaaaccgaacgttacgtaacggaacgtacggaccgggtaagtaccgtaccgttaggttaacgtacgttaacgttacggttggtaaacccgggagggggtaacggtacggtacggtacggtcggtacgggtacccggtcgggtaccgggtacgtaaccccgggg

SEQ ID NO: 28432 - DNA, 819 bp, Homo sapiens
  misc_feature: GYAE6OF02GCVHN.39.16.B05.1.454.CMB.1.raw
tcagtcgcactagtcacgaccggtgctcgatttagagctcacgtattgggtttgaggtctcagagaggagtccttagccctggacctccaaggcctttccacttggtgatcagcactgagcacagaggactcaccatggaattggggctgagcttgggttttccttgttgctattttagaaggtgtccagtgtgaggtgcagctggtggagtcgtgggggaggtcttggtccaggcccgtggggggtccctgagacctctcctgtgctacgccctgtggacttcctaaccgtttaagggaaccttagttgggacttgtaggtttacggggtccccgccgtaagggtcctggaccggaaggggggaacggggtcgtaggggaaggttgggggtacggaccctaaacgagtaaggtaagggtagaagttacgggaaaggaaggtaacggtaaaattacgtagtaggtacggtacctttacgtgggttaacgggaacggggtacccgtatttacccgaacctaacgttcccgtaccgtaaggaaccggaaaccgtaaaccccggaaccgaaaacggttaaacttacccgtaacggttagtttaaactttaaacccgaaaagtttacccggaaacgtaccggttacccgtaagggtaaccggaaccggttaacccggaacggtaacccgtaacgggttaccttaggttaactaacgtttaaggtttcgggtacggtaacgggggaaacggggggttcaagggttcgggtacggttacggggtaccgttacggggtaccggggaccccggtaaacccccggggg

SEQ ID NO: 28433 - DNA, 705 bp, Homo sapiens
  misc_feature: GYAE6OF02JI1AH.39.16.B05.1.454.CMB.1.raw
tcagtcgcactagtcacgaccggtgctcgatttagagctcacgtattagggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcttgggtccaggccgtgggggggtccctggagactctcctgtgcaggcctgtggattcacctttaggaacttattggatggtaggttcggggtccgccgagggccttggcgagggggtaacggggcgtacggggagggtggggtacggtcccaaacgagttaacgggaagggtagacggtaggggtaaagaagggtaaagtaaaacgtcgttaagtaggtagggacgttcgtggttagggaacgggccggtaacgtttaccgaccgtaactccgtacgagaacgaacgaacgaccaaagtatactactagttattaacaaatacgaaacgacgtaccgtagaacggtacgaccggtacgggaaccgtacgtacgacgttacttacgttacgttggtaacgggtaacgggtaacgggggtacgacgggttacggggtcggtcggggtaccggtacgggttacggggacccggtaaccccggggg

SEQ ID NO: 28434 - DNA, 772 bp, Homo sapiens
  misc_feature: GYAE6OF02G04HC.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagcgttgggttttccttgttgcttattttagaggtgtccagtgtgaggtgcagctgggtggaggttcggtggggggaggtcgtttcgggtccgacggcccggttcgggggggtcccttggacgaccttcttccgtggtcgcacggtcccgttcgtaggtacttaccgtaacctttaaggaaccttagttgggagttggtacgggttcgggtccgtaccgaggtcgtggacggaaggggaaggggtcgtaggggagggtggggacggtaccaacgaggtaagggaggtaggagtagggaaaggagaaagtaaagttactaaggtggtacggactcggtaggtacgggaacgggtcgtacgtcgaacctacgtctaccgaagaacgtaaccgaacgaacccgaaagtaactacgtacgttaacgttaatttaaacgaaattacgaaaccgtaacgtaccgtaacgacggaacggtaacggaccggtaacgtacggttaccgtaagttaacgttacttaaggttcgggtaacgggacgggtaaacggggggtaccgtaacgggttacgggaccgggttcggtaccggttaccggggtacgggtacccggggaacccggggtaacccccggg

SEQ ID NO: 28435 - DNA, 621 bp, Homo sapiens
  misc_feature: GYAE6OF02GUTF8.39.16.B05.1.454.CMB.1.raw
  modified_base (177)..(177): a, c, t, g, unknown or other
  misc_feature (177)..(177): n is a, c, g, or t
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (214)..(214): a, c, t, g, unknown or other
  misc_feature (214)..(214): n is a, c, g, or t
  modified_base (309)..(309): a, c, t, g, unknown or other
  misc_feature (309)..(309): n is a, c, g, or t
  modified_base (334)..(334): a, c, t, g, unknown or other
  misc_feature (334)..(334): n is a, c, g, or t
  modified_base (451)..(451): a, c, t, g, unknown or other
  misc_feature (451)..(451): n is a, c, g, or t
  modified_base (504)..(504): a, c, t, g, unknown or other
  misc_feature (504)..(504): n is a, c, g, or t
  modified_base (515)..(515): a, c, t, g, unknown or other
  misc_feature (515)..(515): n is a, c, g, or t
  modified_base (575)..(575): a, c, t, g, unknown or other
  misc_feature (575)..(575): n is a, c, g, or t
  modified_base (582)..(582): a, c, t, g, unknown or other
  misc_feature (582)..(582): n is a, c, g, or t
tcagtcgcactagtcacgaccggtgctcgatttagagctcacgtattggggaggtctcagagaggacgccttagccctggactccaaggcctttccacttggtgatcagcactgagcacagaggactcaccatggaattggggctgagcgtggtttctgtaggctatttagaaggtntcagtgtgaggtgcagctggtggagtcgngggggngnttgggccagccgtgggggtccctggaacgctctcctgtcgctacggcctctggtactctaccgtttaggaactagttgatagtaggttcggaccncgaggcttacgcgaggggacggtcnggggtagtgggtggaccaagagtaggagagtagtagggagagaagaaatactaagtcgtaacggtactagtaggttaggaaccggggtctaacgttccgaaccctaggtttaacccncgtaaaggcgttaaacgactaccgaaagtacttcgaacctttattattaaaanaacgtagacgntacgagagccacggtaagcctagacgttagtactacgtagttggaacggacgggacgggntacgggngtcggtcggtacgtcggaccgggtcggtaaccgggcccc

SEQ ID NO: 28436 - DNA, 780 bp, Homo sapiens
  misc_feature: GYAE6OF02JDGQ0.39.16.B05.1.454.CMB.1.raw
  modified_base (564)..(564): a, c, t, g, unknown or other
  misc_feature (564)..(564): n is a, c, g, or t
tcagtcgcactagtcacgaccggtgctcgatttagagctcacgtattgggtttgaggtctcagagaggagccttagccctggactccaaggcctttcacttggtgatcgagcactgagaccacgaggaggacctaccaaccgtagtaggtaaggttggggctaggagtcggtttcgggtttttccttgttcgtacttttaagttttaaggaagggttcgtaccgtaggttgtgggaggtgcaggtcggtgggtaggtcggttcggggtagggggcgtcgttaccggacgacggtccggggtccgggggtacctggacgtcctccgttcgtcggtcgctaccgtcctcggtagttacttcccgtaacgttacggaacttgtcggagttggtaggttccgggcctacggagtgtcgaacgggaggggtaacgggtcgaagggtcggggtagggtaccgaacgaacgtaggtacggaggtaagaggtaggaagacgaagtaactagtgtaggcgtacgtgtaggaagaccgggtcctctacacgttcacggtacgagaacggtaacncccgtaacgtaagttacttacctaagttaccgttaataaacctaggtaacgaacctaccgtagaccggtaagaccggtacggaacgtaccgttaccgggttactaagtttacgaaatttccggtgggaacccggttaaggggggaacgggtacttaggggtacggtcgggtaacccggtggtttacccggggccgggtaaccgtacccccgggggg

SEQ ID NO: 28437 - DNA, 799 bp, Homo sapiens
  misc_feature: GYAE6OF02G8RV7.39.16.B05.1.454.CMB.1.raw
  modified_base (194)..(194): a, c, t, g, unknown or other
  misc_feature (194)..(194): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgnggtgcagctggtggagtcgtgggggaggcgttggtccagccggtcggggggtccctggacgactcctccgtggtcgcacgcctcgtggtattcctaaccgtttaaggaacttagttggattggtaggttgggtcccgccgaggctggacggaggggaacggggcgtagggaggttggggtcggtacaaacgtagtaggaggtagagtaggaaagtagaagtaaaatactagtgtaggactcgtaggtacgggaacgggtccctaagttcccaacgtacgttcccgtaccgaaggaaacgtaacccgaaaccggtacccgtaaaaggtaaaccgttttaaccgtaacccgtttaaggtttaaaaccttttaaaaccgtaaaaacgttaacggaaaacccttaaccgggtacccgtttaaagggaaacggttaaccgggacccgggaaacgggttaaccctaacccggttacgtttacgttaacgtttaacccgttaggtttacgggaacgggtaacggggggtaaaacggggggccttaaggggtcgggttaccgtaggggtacccgtttaacggggcccgggggtaaccccgtaaccccgggggg

SEQ ID NO: 28438 - DNA, 941 bp, Homo sapiens
  misc_feature: GYAE6OF02GPJMY.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaggtgtcagtgtgaggtgcagctggtggagtcgtgggggaggcgttggtccaggtccggtcggggggtcccctggacgtacctctcctggtgcacgtcctcgtggtactttcctacctttaggaaccttaggttgggtaacgttggagggtttaccgggggtcccggtccggtaagggccgttcgggaccggaaaggggggtacgggggtacgtaggggtacgggttacgggggttccgggacccggtaaaacgtaaggttaaggtaaagggttaggaaggttagggaaaggaaggaaaggttaaaaactagttaacgttggtacggtacgtacggttcgggtaagggaacggggtcccgtaacgttacccgaaccgtaccttacccgtacgaacggtaacggaaaccgtaaacccggtaaccaaacggttaaaacctttacccgtaacggtttaactttaaaccgtttttaaaacgaaaagtttaacccggtaaaacgtaaccgggtacccgtttaaacgggtaacgggaaccgggttaacccggaaacgggttaaacccgtaccgggtttaccgttaacggttttaaccgttttaaccgtttaaacggttttaggggttaaccggggtaaccggggggttaaaacccggggggggtacgttaaaccgggggttccgggggttaaccgggtttaccggggtaaaccggggttttacccgggggttacccggggggaacccccggggttaaacccccccggggggg

SEQ ID NO: 28439 - DNA, 807 bp, Homo sapiens
  misc_feature: GYAE6OF02GJWY6.39.16.B05.1.454.CMB.1.raw
  modified_base (181)..(181): a, c, t, g, unknown or other
  misc_feature (181)..(181): n is a, c, g, or t
  modified_base (722)..(722): a, c, t, g, unknown or other
  misc_feature (722)..(722): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaagttgggctgagtcttgggttttccttgttgcttattttagaaggtntccagtgtgaggtgcagtcgtggtcggagtcggtgggggagtcgttcgggtaccgacggtcccggttcggggggttcccctaggtacgtaccgttcccgtccgttaggtcgccgtacgtccttcgaggttcttacctaacggttttaagaactttaggttaggagttggtacggtttccggtaccccgcgacggtcgttacgggcggtaaacggggggacggtcggtacggggtacggttcgggtaccggtaaccgtaaacgtaaagtaaacgggtaccggaaagttaggtaagggggtaaaccgttaacggggaaaaagttacggttacgttacggttacggaacccgttgggtacgggtacggggtaacgggtcccgttacccgactacgttcccgtacgaaaggtaccaaccggtaaacgctaaaccgggtacctccgtagaccgtacttcgtaacgactaaaggtcgaaactgtacggagtaacgccgtaacggccgtaacgtccggtagtttttaccgagtccgtcggaaacgggngttaaacgggcggtaaacggttccgggttaacggtccggttaaccggacgtaccgggtacccgggaaccggtcgtttaaccccgg

SEQ ID NO: 28440 - DNA, 755 bp, Homo sapiens
  misc_feature: GYAE6OF02IL7GJ.39.16.B05.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (321)..(321): a, c, t, g, unknown or other
  misc_feature (321)..(321): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaagttggggctgagtcgttgggttttccttgttgcttattttagaggtgtcctagtgtgaggtgnagcgtgggtggnggtcggtgggggagtcgttcggccgacggtcccgggttcggggggtaccctggacgtaccttcctcgtgtgctacggtcctgtgtacttccgtacgttagaactgttaggntggtaggttcgggtaccgccgtaggtcgtggacggaggggagggtcgtaggggcggtaggggtccggaacaacggtagtacggtaggtaacggtagtagggaaagacggtaaagtaaactagtaggtacggtacggtacttggtacggtagggtaaaccggtcgtttaacgtaccgtaaccgtaccgttccgaaccggtaacgaaaccggaacccgtaaacggtaacccgtaaaagtttaaccgttaaccgtaacgttaacgtttaaacttaaacgaacgtaaccgaacgtacgtacgtaggacgtacgacgtaacggtacgtacgtactacgtaattacgtagttcgggtaacgggaacggggaggggtactcggggtacggtccggtacgggtcggtaaccgggtccgggaccgggtaaccccggtcccggg

SEQ ID NO: 28441 - DNA, 884 bp, Homo sapiens
  misc_feature: GYAE6OF02JXIT0.39.16.B05.1.454.CMB.1.raw
tcagtcgcactagtcacgaccggtgctcgatttagagctcacgtatgggaggtctcagagaggagccttagccctggactccaaggcctttccacttggtgatcagcactgagcacagagactcaccatggaattgggctgagcgtggtttcctgtgcttatttagaggtgtcagtgtgaggtgcagctggtaggaggtcgtagggggagcgttgggtccaggtccggttgggggggtccctggacgtacctcgtccgtgtcggccacgccgtactggtaattccgaaccgtttaaggaacttagttgggaagttgtaggttacgggtccgccgaaggtcctgacggaaggggaacggggtcgtagggtgggttcgggcggtacccaaaggtacgttaacgggaggttaacggaagttacggggaaaggaacgtaacggtaaaagtacggtagtaggtagggtaccctttaggtaggtaacggtaaacggggtccgtaaccgtttaccgaaccgtacgtttaccctacggaacgtaaaccggtaaacctaaaccccgggaaccgtaaacgggttaaaccgttaccgtaaacccggtttaaagggtttaaccttttaaaaacgtaaacgtttaaaccgggaaaacgttccggtaaccccgtttaggggaaacccgttaaccgggaacccgggtaaacgggtaaccccggttaaggttaccccgttaagggttaaccggtttaccgtttaagggttccgggttaacgggtaaaaccggggggttaaacgggggtaccgttaacggggtaaccgggtttcggacggggtttaaccgtacggggggttacccgggttaccccggggtaacccgggttaaccccccggg

SEQ ID NO: 28442 - DNA, 729 bp, Homo sapiens
  misc_feature: GYAE6OF02JW009.39.16.B05.1.454.CMB.1.raw
  modified_base (254)..(254): a, c, t, g, unknown or other
  misc_feature (254)..(254): n is a, c, g, or t
  modified_base (364)..(364): a, c, t, g, unknown or other
  misc_feature (364)..(364): n is a, c, g, or t
  modified_base (417)..(417): a, c, t, g, unknown or other
  misc_feature (417)..(417): n is a, c, g, or t
  modified_base (519)..(519): a, c, t, g, unknown or other
  misc_feature (519)..(519): n is a, c, g, or t
tcagtcgcactagtcacgaccggtgctcgatttagagctcacgtaaggggctgggcctcaggaagcagcatcggaggtgcctcagccatggcatggatccctctcttccgtcggcgtcccttgcttactgcacgaggactccgtggcctcctatcgagtctgtctcacgccacgtctcgtagtcgtaccgtcgtccccaggacacgacacgccagcatccgacctcgctacgaagaaacttacgagttaagganaattaaatacgtcgtcgttacgcgttaggtactacggtacgacgtaaggaaccggcctaacggacccttacgggtcccctagtcgtactaggtactacgccttaacgtanacgtaaaccgtacgtaaccgaccggtcgtacccgtaggtaccggccttaccgnggtagtccttacgtcgtcgtacgtacctactaacggtcggacgtaacctctacgtaccctacggtacctacgacctaggtaacccggcgaaccggtaccggngttaacgtacgacggttacgacgtacggtccttaacgttccgttaagtttacggtacggtacgttacggggtacggtaaccgtacgaccgggtaacgtaacgggtacgggttacggggtacccggttagggaaccgggtaacggtcccggtagtacccggttacggtacccgggttaagaccggtaccggtacccgggaacgttaccggg

SEQ ID NO: 28443 - DNA, 886 bp, Homo sapiens
  misc_feature: GYAE6OF02FHKGU.39.16.B05.1.454.CMB.1.raw
  modified_base (825)..(825): a, c, t, g, unknown or other
  misc_feature (825)..(825): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattgggctgagctgggtttccttgttgctattttagaagtgtccagtgtgaggtgcagtctggtgagtcgtgggggagcgttcggtccaggtcccggttcggggggtccctaggacgtaccgttccgtcccgttggtacgtccgacggtccttacgtcggtaactttccgaaccgttttttaagggaacctttagtttacgggacttacgggtacggttttaccgggggtccccgtaccggtaacggtcccgttacggtaaccggtaacggggggtaaaccggggtcgttacgggggtaacgggtttcgggggtaccgaccccgttaaacgtaacggtaacgggtaagggtaacgtaacggtacggggaaaggtaaacggaaagtaaaaaccgttacggttaaaggttcgggtaacggtaccttaggtcgggtaacgggaaccggggtaccgttaacgtttaccgaacccgttaaccgttacccgtaccggaaccggtaaaccggtaaacccgtaaaccggtaacctaaacggtttaaccgttaccggtaaacctttaggttaaacctttaaacgtaaaacgtaacggtaaaccttacgggtaccgttaggaaccggtaacggaccggaaacggtacgtaccgtcttacgtaccttacgttagttcggtaacggtacgggtaacgggggtntaggttacggtacggtacgggtccgttaacgggcgggtaccggtaacccggtaaccccggg

SEQ ID NO: 28444 - DNA, 785 bp, Homo sapiens
  misc_feature: GYAE6OF02IKITZ.39.16.B05.1.454.CMB.1.raw
  modified_base (254)..(254): a, c, t, g, unknown or other
  misc_feature (254)..(254): n is a, c, g, or t
  modified_base (343)..(343): a, c, t, g, unknown or other
  misc_feature (343)..(343): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccagtggaattggggctgagcttgggttttccttgttgcttattttagaaggtcgtccagtgtgaggtgcagcgtggtggagtcggtgggggagtcgttggtccgagccggttgggggtcccnggagactcgtccgtgtcgactcgcctcgtggtacttaccgtaccgtttaaggaacttagttaggtatggtaggttccgggtccgaccgnggtcgtaggcggaaggggacggggtcgagggtaggtcgggtacggaaccaagagttaagggaggttaacggtaagacgggaagaaggtaaacgtaaagtttaacgtagtaggggtaacgtaccggttagtagggttacgggaacggggtacctaggtttaccaaacccgtcgttaccgaccgaaggtaaccgaaaccgtaaccgaaaccaagttaccttaccgtacgttaagttacttaaataaaccgtagaaacgtaccgtacgaacgtagggtaacccgaccgggtaacggaaccgtacgttaccgtaaggttaccttaagttacggttaacgggtacggggtaacggggtaaaacggggggccgttaaggggtcgggttacggtaccgggggtaacccggtaccggggtaccgggggtaccccggtaaaccccgggggg

SEQ ID NO: 28445 - DNA, 934 bp, Homo sapiens
  misc_feature: GYAE6OF02IQZEK.39.16.B05.1.454.CMB.1.raw
  modified_base (126)..(126): a, c, t, g, unknown or other
  misc_feature (126)..(126): n is a, c, g, or t
  modified_base (358)..(358): a, c, t, g, unknown or other
  misc_feature (358)..(358): n is a, c, g, or t
tcagtcgcactagtcacgaccggtgctcgatttagagctcacgtattgggaggtctcagagaggagccttagccctggactccaaggcctttccacttggtgatcagcactgagcacagaggactnaccatggaattggggctgagcttgggttttccttgttgcttatttttagaagggttgtccaggttgtgaggtgcagctgggtggagtcgtgggggagcttcggtccagccggttggggggtcccctggacgccttcctccgtggtgccgacgtccttcgtggtactttaccgtacccgttttaagggaaacctttagtttagggacttagggtaggtttcgggggttacccnccccgtaagggtcccgttaggaccggaggggggtaaacggggggcctttgggggaagggtttcgggggtccgggaacctaaaacgtagttaacgggaggggttaacgaaggttaaggggaaagggacggtaaaaggtaaaactttaacggttaaagttacgggttaagggttaaccttacgtttaggggagggtaaccgggtaacccggttaacttaaccccgtaaccgttaagttcccccgtttaaccggaaacgtaaccggtaaacccgtaaacccggtaaaccccgtaaaaggtttaaaacccgtttccaaacgtttttaacgtttaaaagttttaaaactaaaacggttacggtaaaccgtaaccgttccggttaaaaggtaggggaacccgtaaccgggaaccgggttaaactaccccggtgttaaccggtttaaactttcggtaaacgttttaggggtaacccggggtaaggggggaaaccgggggtcttaacggggtttcgggtaggttccggggtaaccgtttacggggcgggggtcccccgtaaacccgggggtttaacccccccgg

SEQ ID NO: 28446 - DNA, 763 bp, Homo sapiens
  misc_feature: GYAE6OF02H54PB.39.16.B05.1.454.CMB.1.raw
  modified_base (173)..(173): a, c, t, g, unknown or other
  misc_feature (173)..(173): n is a, c, g, or t
  modified_base (204)..(204): a, c, t, g, unknown or other
  misc_feature (204)..(204): n is a, c, g, or t
tcagtcgcactagtcacgaccggtgctcgatttagagctcacgtaagggctgggcctcaggaagcagcatcggaggtgcctcagccatggcatggatccctctcttcctcggcgtccttgccttactgcaccaggactccggtggccctcctatgagctgtctcagccacgcncagtcgtccgtgtccccgaggaccagaaccncggaccagcgtaatccgaccttgctacttaggaaaactacgatttaggagtaaactaaagtcttggtcttaggtcgttaggttacacggtagacgaacgtacggacccgaacgggcctaaccggttcccccgttaggtcgccgtaagacttccataccgtacttacgaaacgtactaaaccgacggtcccggtaccgtacgacgggtacctacccgtagaccgggtactacttccgtcgtacgtacctacccgtataccggtacggaacctacggccctaacctccgttaccaaggaccccgttagacccggacggaccgggtaaccgtcgtaccgttagacgggtaacttacgggaactacgtacggttactaaggttttaccgacgtacgggtttaaacggtcgggtttaaccggacgaacgggtaacgtacggtaaacggggttaccggggtttaccggtgggggaacccgttaacggggaacccgtacggttaccggtacccggtaacccggtttacggtaaaccggggtctaacccggtccccggtaaccgggg

SEQ ID NO: 28447 - DNA, 904 bp, Homo sapiens
  misc_feature: GYAE6OF02HA6IB.39.16.B05.1.454.CMB.1.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctggttttccttgttgcttattttagaaggtgtccagtgtgaggtgcagctggtggagtcgtgggggagtcgttggtccagccgtcgggggtccctggagactctcctgtcgcacgtcctcgtggtactttcctaccgtttaaggaaccttagttggaattaggtaggtttcggggtaccccgccgacgggtccgtaggaccggaaggggggaacggggtcgttaggggagggttcggggtacggaccccgtaaagtacggtaaggtaacgggttagaacggtaagggaaagaacgggaaagtaaaacgttacgttaagtggtacggtacgttacggtagggtaacggaaccggggtaccgtacgtttaacccgaacctaacgttacccgtaaccgtaaggaaaccggaaacccgtaaacccggaacccgttaaaaggttaaactttacccgttaaacgtttaaacggtttaaaacttttaaaccgtaaaaagttaccgtaaaaccggtaccggtaacccggttaaggaaacgggtaaccgggtaaccccgggaaacgggtaacccggttaaacccggttacgtttaacggttaaccgtttaaacgtttaacgggttttaacggggtaacgggtaaaccgggggggtaaaaccggggggttccgtaagggggttacccgggttaaccgggtccgggggtttaacccgttaccgggggtacccgggggtacccccgggttaaacccccggggggg

SEQ ID NO: 28448 - DNA, 810 bp, Homo sapiens
  misc_feature: GYAE6OF02FLLR9.39.16.B05.1.454.CMB.1.raw
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
  modified_base (378)..(378): a, c, t, g, unknown or other
  misc_feature (378)..(378): n is a, c, g, or t
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgctattttagagtgtccagtgtgaggtgcagctggtggagtcgtgggggaggtcgttcggtccgagtccgtgggggggttcccctggacgactcgtcctgtgcacgtcctgtggtacttcacctttaggaactagtgtatgtagtgggtccncgaggctcgngaggggaacggggctaggggtaggtcggggtcggacccgaacgtaagtaagggngggtaacgtagtagggaaggaaaggaaaggtaaagttacgtaagttacggtagggtacttcgttagggtacgggtaacggggcccggttaagttaccgtaaccgtaccttaccgtaacccgagtaaccggtaaacgaaccgtaacccgaaagttaacgttacctaaccgttaacgttaacttttaaaccgtaaactaacggtaaaccgtaacggtaccgttacggaacggtaccggaacccgggtaacggaacccggttaaacgttacccgttaagtaaacgtttaacctttaaggtttaccggttaacgggtaaccgggggtaaaacgggggggtaaccggtaggggtttacgggtaccgggttagggtaacccgggtttaccgggtaacccggggggtaccccggtaaccgggggttaaacccccccggg

SEQ ID NO: 28449 - DNA, 884 bp, Homo sapiens
  misc_feature: GYAE6OF02I7O70.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggaggcttggtccagccgtggggggtccctgacgactctcctggtgctacggccttcgtgggactttccgtaaccgttttaagggaaaccttagttaggaattggtaacggttttcgggggtaccccgacccgtagggtccgttaggaccggtaaaggggggaaacgggggtccgttaggggtaacgggttggggggttacggaccccgtaaaacgtaggttaaaggtaaggggttaaacgtaagggttaggggaaaacggtaggtaaaggtaaaaaacgtttaccttaaggttagggttacggtaaacgtccgttaggtagggtaacggggtacccgtagtttaacccgaacccgtaattaccgtccgtaaacgacgtaaaccgaacgtaacccgaaagtaaacctttaacgtaaccttaggttaaactttaaaccgtaaaagtaacggtaaaacgaacggttacccgtaagggtaaccggtaacgggtaaccccggtaaagggtaaacccggtaacgttaacggttacgttaaaccgtttaacgttaacgttaacgggttgggttaaacggggaaaacgggggggtaccgtaacgggttacgggtacgggtacggggttaacgtaccggggtaccgggggtaacccggaaccgggggttaaccccccggg

SEQ ID NO: 28450 - DNA, 690 bp, Homo sapiens
  misc_feature: GYAE6OF02GE0DJ.39.16.B05.1.454.CMB.1.raw
  modified_base (199)..(199): a, c, t, g, unknown or other
  misc_feature (199)..(199): n is a, c, g, or t
  modified_base (521)..(521): a, c, t, g, unknown or other
  misc_feature (521)..(521): n is a, c, g, or t
  modified_base (562)..(562): a, c, t, g, unknown or other
  misc_feature (562)..(562): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcttattttagaaggtgtccagtgtgcggtncagttggtggagttcgtgggggaggcttgggccacgggcccgggggggtccctgacgcttctccgtgtcgcaggcctcgtcggtactttccccgttaagacgttttagtggtctggagtcgttacggggcccgcgcggtccgtaccggaagggggtaggggttgggaggtgggtacggacccaaagaagtaaagcaaagtggtagggtaaggtacggaaaaggtagttacgtacgtggtaactcgtggtagggcggggttccgtaccacctagtcctaccgaaggaacaaccgaaaccgacgtaaacggaaccttcggtacncgaattcgagaactaaagtagaaccgtatcgacggaaacgnggacccgggaagaccgtacggttattttattacgtagcgacgtcggaaggtaggtaacggagttcgggtccggtttacgaccgttcgggtcccgggaaccgtccggggtaaccgtcggccccgtaccg

SEQ ID NO: 28451 - DNA, 903 bp, Homo sapiens
  misc_feature: GYAE6OF02JPQCS.39.16.B05.1.454.CMB.1.raw
tcagtcgcactagtcacgaccggtgctcgatttagagctcacgtattgggaggtctcagagaggagccttagccctggacctccaaggcctttccacttggtgatcagcactgagcacagaggactcaccatggaattggggctgagctgggttttccttgttgctattttagaggtgtcagtgtgaggtgcgtagcgtgggtggagttcgtggggggaggtcgttggtaccgaggtcccggttggggggggtccccttaggacggtaccgttccgttccgttggtcgtccacggtcccgttcgtcgggtacttaccggtaagggttttacggtcggtaaccggtcccgttaggggtaacttaaaaccggttcgggggtaccccggtaccggtaacgggtccgttacccggaaggggggtaaacggggtccgttaggggaacggttacgggggtccgaacccgaaaacgttaaacggtttaaaaaggaaaaggtacggtaacggggtaaacggtaacgggaaaaacggtaaaaaaccgttaggttacgggtacgggtaaccttacggttaggtaaccggggtaacggggtaccccggtttttaaacccagttaccccgtaaccgggaacggggttaaaccaaaccggtaccctaaaggtcgaacgtttaacggtttaaacgacttaacttttaacgttaacggtaaaacctaaaaacgtaaaccgttaaggtttacgagggtaaacgaccgggtaacccgggagtaaacccggcggttaccttaactaacgtacctaccgtgtaacgtcggtaccgccgggttagggacctacgttaaggtcgtaaccggttcgggttacggggaaccccgtaaggggtaccccgttacggccccttaaccgg

SEQ ID NO: 28452 - DNA, 716 bp, Homo sapiens
  misc_feature: GYAE6OF02JNAZ8.39.16.B05.1.454.CMB.1.raw
  modified_base (279)..(279): a, c, t, g, unknown or other
  misc_feature (279)..(279): n is a, c, g, or t
tcagtcgcactagtcacgaccggtgctcgatttagagctcacgtattgggtttgaggtctcagagaggagccttagccctggactccaaggcctttccacttggtgatcagcactgagccacagaggactccaccatggaattggggctgagctgggttttccttggttgcttattttaggaaggttgtccagttgtggaggtgcagcgtgggtggagtcgtgggggagcgttggtccagtccgtgggggtcctagacgactcgtcctgtcgcagcctntcggtattcaccgtttaggactacttggaatgacgttgggccgacagcctgcgagggaacgggctagggagtgggtaggccctaaacgtagtaggtacggtagaacggttaggggaaagtaggaaacgtaaacgtaacgttaaagttaccgggtaggtaacgttaccgtgggttacggaacggggacgtacgtttccgaaccgtgttacccacggtaacgaaaggtaaccaaccgtaccgtaagtaacttacgaaccgtttagaaccttttaacgaaagttaccgaaacggtataacccggtaagtaacggtaacggtccgggttaaacggaccgtttacggacgttaacggtaacttacgttacggtgtttaccggaaggtacggggacgtaggtcggtacgtcgggtagtaaccggtcgggccgtaaacccgggg

SEQ ID NO: 28453 - DNA, 817 bp, Homo sapiens
  misc_feature: GYAE6OF02G47ET.39.16.B05.1.454.CMB.1.raw
  modified_base (189)..(189): a, c, t, g, unknown or other
  misc_feature (189)..(189): n is a, c, g, or t
  modified_base (216)..(216): a, c, t, g, unknown or other
  misc_feature (216)..(216): n is a, c, g, or t
  modified_base (402)..(402): a, c, t, g, unknown or other
  misc_feature (402)..(402): n is a, c, g, or t
tcagtcgcactagtcacgaccggtgctcgatttagagctcacgtattgggaggtctcatagaggagccttagccctggactccaaggcctttccacttggtgatcagcactgagcacagaggactcaccatggaattggggctggagcgttgggttttccttgttgctattttagaggtgtcagtgtgngtgcagcgtggtggagtcggtgggggngtcgtttggtcccgagtcccggttggggggtcccctggaacgtccttccgttccgtgtcgccgacggtcctcgtggtactttcctaaccgttttaaggaacttagttaggatggtaggtttcgggtcccgcgacggtcgtcggacggaaggggaacgggtcgtggggacggttggggcgaccgaanagtagaggtagagtaggaagaagaagtaaagttactaggttagaggtacttagtacggtaggaacgggcgtaacgttaccgaaccctcgttacctccgaacaacgtaaacccgaaacgtaacccgaaacgtacgtttaaccgtaacgtttaacgttaaacgttttaaactaaaacggttaacgaaacgaccggtacccgtaaggtaacgacggaccgggtaaccgggtaacctaccggttacgtttaacgggttaactttaccgtttaaaggttttagggaacccggggttaacgggggtaaaaccgggggggtccggtacggggtttaacggggaccggggtttacggggaccgggtttaacccggggaccggggggtaacccccgggtaaaccccggggttaaaccccccggg

SEQ ID NO: 28454 - DNA, 722 bp, Homo sapiens
  misc_feature: GYAE6OF02ILNOZ.39.16.B05.1.454.CMB.1.raw
  modified_base (256)..(256): a, c, t, g, unknown or other
  misc_feature (256)..(256): n is a, c, g, or t
  modified_base (298)..(298): a, c, t, g, unknown or other
  misc_feature (298)..(298): n is a, c, g, or t
  modified_base (457)..(457): a, c, t, g, unknown or other
  misc_feature (457)..(457): n is a, c, g, or t
  modified_base (667)..(667): a, c, t, g, unknown or other
  misc_feature (667)..(667): n is a, c, g, or t
  modified_base (676)..(676): a, c, t, g, unknown or other
  misc_feature (676)..(676): n is a, c, g, or t
tcagtcgcactagtcacgaccggtgctcgatttagagctcacgtattgggaggtctcagagaggagccttagccctggacctcccaaggcctttccacttggtgatcagcacgtgagcacagagacctcacctagtggaagttgggctagaggtcgtttgggttttcctggttgactttagttttaagacggttgtccgtaagttgtggaggtgctagtcgtgggtgtcggtcggtggggggtctcgtttcggacncgggtccggttcggggtcctaggactccgtctcgttgcgacncgtcctgtagtacttcctacgttaaggacttggtagcgtaggtacggttcccggcgtacgaggtcctaggtaccggaaggggtacggttgcggggtaggtcggggtacaacggtaagtacgtagggacgtaagcgaaagggatacggaaagtaaacttnaggttacggcgttagtacgtaggtagggaaccgtcgtacgtactactacggtacacggtaaggaacgtaaccgtaaccgaccgtaaaggtaccttaacgttacgttactttaagtaactaaagtacgaaacgttaccgtcgtaacggacgaccgacgtaacgtacgtaccgttatagttacctagttacgtcggtagggcggtaacgggnggttaacgngttacggtagacggtacccggtacgggacccgtaccgggtaccccg

SEQ ID NO: 28455 - DNA, 741 bp, Homo sapiens
  misc_feature: GYAE6OF02GDATB.39.16.B05.1.454.CMB.1.raw
tcagtcgcactagtcacgaccggtgctcgatttagagctcacgtaaggggctgggcctcaggaagcagcatcggaggtgcctcagccatggcatggatccctctcttcctcggcgtccttgcttactgcaccaggatccgtggcctccgtatgagtctgtctcgagcccacgctcagtcgtccttgtaccccaggtacagaacacgccagctatccacctgcctacgtaggaaactactagttacggaagtactaaatataggtctgtacgtaggttactcgaagctagaaccgccgaacggtccgtaccggtacccctagtcgtacgtacgatccgtacttcgtacgtacaagtaaccgtaaccgacggcccgtaccccgtagacccgggttacctcccggtacggacgtaccgttacgtttcccgtacgtacggtaccctaccgtaccgtacgtaacgggtaccaacggaccgtcccttaaacgtcccgtacgtaccgacggtcgaacccgggtcccgggtacccgacgggttaccgtaaggttacggtaccgtaacgtaggtaccccgttataacccgtttaagttccggttaacgttccgggtaacgggtacgttcggaaccgtttaggaaccgtacgggttaaccggaagggttcgggtcgggtaaccgggaaccggaacgttagggtacccgaggttacccggaccgtaacgggtccctacggacccgtaccggg

SEQ ID NO: 28456 - DNA, 658 bp, Homo sapiens
  misc_feature: GYAE6OF02ISYQS.39.16.B05.1.454.CMB.1.raw
tcagtcgcactagtcacgaccggtgctcgatttagagctcacgtattgggaggtctcagagaggagccttagccctggactccaaggcctttccacttggtgatcagcactgagcacagaggactcaccatggaattggggctgagctggttttccttgttgctatttagagtgtccagtgtgaggtgcagctggtggagtcgtgggggaggtcgttggtccagtccgtgggggtcctgagactcgtcctgtgcacgcctcgtggtattctacctttaggaacttagttggtatggtaggttcgggtccgccgaggcgtgcgtaggggaagggcgtagggaggtggggtacggaccgaatagtaggtaggtagaagtagggaagagaagaaatacgtagtggtcgattcgtaggtaggacgggtccgtattccgacctatcctaccgagaacgacgaaccgacaagtaacttacacttagttattaactaatacgtaacacgtaccgtaggaagacgaccggaacggtacgtacgtcttacgtaattacgttagtttcggtaaggtaccggggaaaggggggtcgtacgggtacggtcggttacgggtaccggttacgggtaccgggggtacccggtaacccggggtaaccccccggg

SEQ ID NO: 28457 - DNA, 520 bp, Homo sapiens
  misc_feature: GYAE6OF01D3TDT.39.6.A06.1.454.CMB.1.raw
tcagtcgcactagtcacgaccggtgctcgatttagatctactgacagggtggaaggagactgggtcatctggatgtcacatttggcacctgggagccagagcagcaggagccccaggtgccaaatgtgacatccagatgacccagtctccttccaccctgtctgcatctgtaggagacagagtcaccatcacttgccgggccagtcagagtattagtagctggttggcctggtatcagcagaaaccagggaaagtcccaaacctcctaatttataaggcgtcgatttagaaagtggggtcccatcaaggttcagcggcagtggatctgggacagaattcagtctcacatcagcagcctgcagccctagaagtattttgactaactttattactgacaacagtataatttattcccgtatacttttgccgtagggaccaagctggacgtctacaaacgaactggtagctgcaccattcgtgttcttcactccttccccgcctaacttctacgtactggtcg

SEQ ID NO: 28458 - DNA, 577 bp, Homo sapiens
  misc_feature: GYAE6OF01AXGEZ.39.6.A06.1.454.CMB.1.raw
  modified_base (231)..(231): a, c, t, g, unknown or other
  misc_feature (231)..(231): n is a, c, g, or t
  modified_base (401)..(401): a, c, t, g, unknown or other
  misc_feature (401)..(401): n is a, c, g, or t
tcagtcgcactagtcacgaccggtgctcgatttagatctactgacaacgtacggacaaggggggaggaactcgctccacgtttaggacccgagacggaaccatggaagcccccagcgcgagcttctctttccgtccctcgcgtactctggctcccaggatacctactggagaacgtagtgatagacgctagtctccgagccaccctgtcctcgtgtctccacggggaaagngccacccctctcctgccagggcccagtccagactattagcagcaacttagcctggtaccagcaaaacctggccagactcccaggctcctcatgtatggtgcgtccaccagggcccactggtactccccagccaggttcagtggcagtgggtctgggacagagttcagtcncaccatcagcagcctgccagtctgaagtattttgtactttattactgtcagcagtatgattaccgtcggtcctcactacgttttcggccgtacggggaccctagggttcgggacggattacgaaaaccggtaacgttggttacgggtcttacgggacccaaccctacgtccgttcg

SEQ ID NO: 28459 - DNA, 799 bp, Homo sapiens
  misc_feature: GYAE6OF01AY3WP.39.6.A06.1.454.CMB.1.raw
  modified_base (208)..(208): a, c, t, g, unknown or other
  misc_feature (208)..(208): n is a, c, g, or t
tcagtcgcactagtcacgaccggtgctcgatttagatctactgacaacgacacaagggggagaactgctcagttaggacccagacggaaccatggaagccccagcgcagcttctcttcctcctgctactctggcctcccagataccactggagaagtagtgatgacgcacgtctccagcccaccgtgtctgtgtctccgaggggaaancgccaccctcgtccgtgccgagggccagtcagactagtacgcagctaacttgcctaggtaccagtaccaaaacgttggaccacgacctcccgacggtcctaccgtacgtagtacgtagtcggtcggtccggtacccgaccggtacgggcccgtacgttacggttaactacccggtacggacccggttacggttaccgacggtacggacgtagggttacggggtaccggttacgggaacgtagggtacggttacgtaacggttaccgtaccgaaccgtaacgtaccgtacggtaccctaacggcccgttaggacctaacgttacggtacgttaacggtttaactttttacggtttaaaccttttacgtttaaccggttcgttaacgtaacggtacgtaacggtttaacgttaaccgggtaaccctttaccggttccggtaaccccttacgttaacccggttacgtttacccggggacccggtaacggggggtaaacccgtacggggtttacgggaagtaacccgttaacggtaaaaccgggtacggttaggttacgggtacctacggtaccgtaccttacgtcgtttaaccg

SEQ ID NO: 28460 - DNA, 814 bp, Homo sapiens
  misc_feature: GYAE6OF01EBDDJ.39.6.A06.1.454.CMB.1.raw
  modified_base (215)..(215): a, c, t, g, unknown or other
  misc_feature (215)..(215): n is a, c, g, or t
tcagtcgcactagtcacgaccggtgctcgatttagatctactgacaacacacgaagggggaggaactgctcagttaggacccagacggaaccatggaacgccccagcgcagcttctcttcctcctgctactctggcctccagataccacgtggagaagtagtgatgacgcgagtctccagccacctgtctgtacgtctaccggaaggggtaaacncgccctacccgtctccgtggcgacgggtccagtccaagtactagttacgacaacgacctaaacgttacgtacccgtacggtaaccaacgaaaccctaaaaaccgtcggtacccaacgtacccgtacccgaacggtccttaccctactaagttcggttacggttcgggtaccggcccgtaacccggacccggtacgggtacccctaacgggttaccgggttaacccacccgaaccgggtacccgttaggggttacgacggggttcgggaacgtacggggtttgggtacggtacggggtaactagggtttacgttccgtacgttaacccgtccgtaacgtaacgttcgacgtaccgaacgtcctacggcgtaacggttacgtaaagttaacgttttaactttttacggtttaactttaacgttacgtacggtaactacgtagttaacttacggttacgaccgttacccgtacggttacctaccgttaacggttaccggttcggaaccgggttacggtacgggtaacgggtagtacgtaaacgtaacggtaaacgtacggtcgtaccggtactacccgtaactaaccgttgttccgttaccg

SEQ ID NO: 28461 - DNA, 877 bp, Homo sapiens
  misc_feature: GYAE6OF01A6CZ3.39.6.A06.1.454.CMB.1.raw
  modified_base (94)..(94): a, c, t, g, unknown or other
  misc_feature (94)..(94): n is a, c, g, or t
  modified_base (107)..(107): a, c, t, g, unknown or other
  misc_feature (107)..(107): n is a, c, g, or t
tcagtcgcactagtcacgaccggtgctcgatttagatctactgacaggggtgaaggagactggtcatctggatgtcacatttggcacctggganccagagcagcagncccagtgaccaaatgtgacagtccagatcgacccagtcctaccgttacacccttgtctgactacgtgtacggttaggacgtacgaggtacgttaccaccgaattccgaacgttcggaccgggacctaaggttccaaggtaacttaagttagtacggtcgttagggttcggtaccttaggttactaccggagtaccgtaacggtaaaaccgtaagggtaaaacctaccctaaaaccgtttacccttaaaagtttaaccggtaacggtaccgttacggtaaccttttaaacggaagggttccggggttacccctaagtaccggttaaacgggtttccgaaaggtccgggtaacgttacgggttacggaacgttacccgttggggaaacctacgggtaacttccgaacggtttccgaacctaccgtaataccgtaacgaccggtaaccgtcctacggaaccggtaacgttaccccgttaaagggtaacggtttaccgtttacgtaaccgtaaaccgttttaacgttaaccgtaaccggtaaccttaaaacggttacgttaaactttaaccgtttaaccttacccggttaacctttacggttttacggacccggttaacgggaacctaacgacgttaggacgtaccgttaacgaaacgtacgttacggtacggacctaggtacctaccggttaagtcccgttacgtacggttactacccgttacccgggtaccctacccgtaacgttcccggtaacgtacgttaccggtaccgg

SEQ ID NO: 28462 - DNA, 772 bp, Homo sapiens
  misc_feature: GYAE6OF01C1DVX.39.6.A06.1.454.CMB.1.raw
  modified_base (251)..(251): a, c, t, g, unknown or other
  misc_feature (251)..(251): n is a, c, g, or t
  modified_base (333)..(333): a, c, t, g, unknown or other
  misc_feature (333)..(333): n is a, c, g, or t
  modified_base (580)..(580): a, c, t, g, unknown or other
  misc_feature (580)..(580): n is a, c, g, or t
tcagtcgcactagtcacgaccggtgctcgatttagatctactgacaacacacgaagggggaggaactgctcagttacggacccagacggaaccatggaacgccccagcgcagcttctcttcctcctgctactctggcctccagactaaccacgtagggaagaaggttagtagtaacgtacggaccgctacgtcctaccacggccctacccgtgttccgtaggttccgtccgtaaccgggaaaggggaaacncccgtacccctacccttccgtccgtagaccggtacgggaccctagtcaacgtacttagtacgacgacgtactaacggttacnccgtacggtaccaacggaaacctaaacggtccgaaccacgtacccctccgacgtcctacgtacgtagtagtcggtcggtccgtacctaccggacggacgggtcctacggtacgtaccgtcccggaagtccggtaggtacggacgggtcgtacggttacgggggttgtacgggtaacgtacggttaagggtccctttagaccgtactaccgtacgatcgacgtaccgcgtaccgtcgtaacccgggtnttacgttaaacggttacttttcgtttaacgttttaacttccgttaacttcggtaacgtacggtactagttcgtacgttaccgtcttctccgtacttacgtcggtacgtacggtaacggtaccggttaggaccgttaacgtaacgaacggtaaccgtcgtacggtcgaccgtactacgtcgttcgttcgttcc

SEQ ID NO: 28463 - DNA, 542 bp, Homo sapiens
  misc_feature: GYAE6OF02HAG16.39.6.A06.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (400)..(400): a, c, t, g, unknown or other
  misc_feature (400)..(400): n is a, c, g, or t
tcagtcgcactagtcacgaccggtgctcgatttagatctactgacaacgacacaaggggaggaactgctcagttaggacccagacggaaccatggaagccccagcgcagcttctcttcctcctgctactctggctcccagataccactggagaagtagtgatgacgcagtctccagccacctgtctgtgtctccaggggaaangccaccctntcctgcagggccagtcagctattgcagcaacttagcctggtaccagcaaaaacctgccagactccaggctcctcatgtatcggtgcgtccaccgtagggccacgtggtactcccgagcctaggttcagtggcacgtgggtctgggacagagttcagtctcacatcacgcagcctgcagtcagaacgtntttgtactttattactgtcagtcctagtactagactaccgtggaccttcgactacgttttcgacctaggggtacctagggttcggaacgtacgtacgaacgtacttcgtacggtcttcggaccgtacctacgttcttaccgg

SEQ ID NO: 28464 - DNA, 486 bp, Homo sapiens
  misc_feature: GYAE6OF02FHCCX.39.6.A06.1.454.CMB.1.raw
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
  modified_base (472)..(486): a, c, t, g, unknown or other
  misc_feature (472)..(486): n is a, c, g, or t
tcagtcgcactagtcacgaccggtgctcgatttagatctactgacagggtggaaggagactgggtcatccagactgacccagtctccttccaccctgtctgcatctgtaggagacagagtcaccatcacttgccgggccagtcagagtattagtagctggttggcctggtatcagcagaaaacccaggggaaagtcccaaaacctcctaatttactaaggcgtcgactttagaaagtggggtccccatcaaggttcagcggcagtggatctgggacagaattcagtctcaccatcagcagcctgcagcctgaagattttgcaacttattactgccaacagtataattattcccgtacacttttggccaggggaccaagctggagctcaaacgaactgtggctgcaccatcctgtctcatccttccgcatcngaactagtncgactgagtcgggcttggcaaggcgcatacgnnnnnnnnnnnnnnn

SEQ ID NO: 28465 - DNA, 745 bp, Homo sapiens
  misc_feature: GYAE6OF02JQ4YW.39.6.A06.1.454.CMB.1.raw
  modified_base (205)..(205): a, c, t, g, unknown or other
  misc_feature (205)..(205): n is a, c, g, or t
tcagtcgcactagtcacgaccggtgctcgatttagatctactgacaacacacaggggaggaactgctcagttagacccagacggaaccatggaagccccagcgcagcttctcttcctcctgctactctggcctcccagatacccactggagaagtagtgatgacgcagtctccagccaccctgtctgtctctccgaaggggaaangcccacccgttaccgtgcgacggcctagtcacgactacttagcagtccaactagtcctcggtacacgacaaaaaccgtcgaccgagacctacccgaggaccctccgtccattactacgtggtcggacgtacccgaccgccgggacctacgttacggtactaccccgtacgcctaacggttcaacggtcgggtacgtcggttacggggtcccgtaggggtaacgtacggtacggtttacctaacggtccgttacccgaaccgtacgttaccgggacttacccggaacgtccccggtttagaccgttaccggttaagtacgggttaaacgtttccgtttttaagttaacccgtttttaacgttaacccgttgggttacctaacggaccgtttaaggtttacgtacggtacctttaaccgtcggttacccttcgtaaacgtttccgttaacgggtaccgacgggtacgttacgggttcgaacgggttactacccggaaagtacgtacggtcgtacgccgttaactaccgtattcccgttaacg

SEQ ID NO: 28466 - DNA, 746 bp, Homo sapiens
  misc_feature: GYAE6OF02H3P9K.39.6.A06.1.454.CMB.1.raw
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
tcagtcgcactagtcacgaccggtgctcgatttagatctactgacaacgacacaagggggaggaactgctcagttaggacccagacggaaccatggaagccccagcgcagcttctcttccctcctgctactctggctcccagataccactggagaagtagtgatgacgcagtctccgagccaccctgtctgtgtctcgaggggaaancgccacctcgtcngcagggctagtcagactattagcagcaacttagctacggtaccagaccaaaaccgtcgaccgaacgaccgtcccaggtacctacctcctagtcgttagtgtacgcggttaccaccgcgggacctacgtacggtcgtaccgacgccgtaggttacgaggttggactaggtcggggttcgtacgggaacgtagtacgttacacgtttacccgactaaccctaacgttccgaacgtaccgaaccgttaccgtcggtaccgtaggtttacccggttaggtaaaggttttaccgttttttaacggtttaaccctttttaacgtttacgttaccgttaactagtaccggtagtttaacgtacggttaaaccgttccgtacgtccctttaagtacccgtttacggttttacgggaccggtaccgggtaaccgggtttggggtaacggtcggtttaaacgtaccgggtaacccttaagggtcggttccggttaacccggtcggttaaccctaccggttaccgtgtttaacccgg

SEQ ID NO: 28467 - DNA, 663 bp, Homo sapiens
  misc_feature: GYAE6OF02G68R6.39.6.A06.1.454.CMB.1.raw
  modified_base (209)..(209): a, c, t, g, unknown or other
  misc_feature (209)..(209): n is a, c, g, or t
  modified_base (408)..(408): a, c, t, g, unknown or other
  misc_feature (408)..(408): n is a, c, g, or t
tcagtcgcactagtcacgaccggtgctcgatttagatctactgacaacgacgacaagggggaggaactgctcagttaggacccagacggaaccatggaagccccagcgcagcttctcttcctcctgctactctggctcccagataccacgtggagaagtagtgatgacgcagtctccagccaccctgtctgtgtctccgaggggtaacngccacctctcctgccagggccagtccagacctatagcagctaactagccgtggtacacgacaaaaccgtggaccagacctcccgagcctcctcagtgtagtggtcgaccgtaccaccgagggtccacgtggtaccgtcccacgtccgaggttcgaggtcggcgtacggttgggtacgtacgggatacggagtttaccgngttacctcaaccgtgtaccgaacgtctaaccggccgttcgacgtagtacgtacgtaaagttacgttttagttaacttttattacgttcgtcacggtactagtagtacgtaactcgtaccgtacgttaccgtaccgttacggtttacggaccgtttacggggaccgttgggttacggaacgtaacggttaaccgtaaccggtacgttacgggtacggttacccgcgttacccgaacccgttagtcccgtttaaccg

SEQ ID NO: 28468 - DNA, 600 bp, Homo sapiens
  misc_feature: GYAE6OF02FUSKR.39.6.A06.1.454.CMB.1.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (588)..(588): a, c, t, g, unknown or other
  misc_feature (588)..(588): n is a, c, g, or t
tcagtcgcactagtcacgaccggtgctcgatttagatctactgacaacgacacaagggggagaactgctcagttaggacccagacggaaccatggaagccccagcgcagcttctcttcctcctgctactctggctcccagataccactggagaagtagtgatgacgcagtctccagccaccctgtctgtagtcnccaggggaaancgccaccctntccctgctagggccaggtcagctattagcagcaacttgcctgtacaggacaaaacctggccagtactcccaggtcctccttacatcgattgtcgcgtccaccgacgggcctagtggtactcccagcctaggttcaggttcggactaggttcggggtcgtaggggtacacggtaagtttccagggttcctaccggacctagttcgaagccacggtacctggcctagttccgtagtaagtctttttaggtacttttacgttagtcgttcgagtccgtaatcgtacgtacttaccgtcggtccttagaccttacggtttgaccgtcgggtacctagggttaggacgtactacgaaacgtacgtttggcgtctgacnctagtcttacgg

SEQ ID NO: 28469 - DNA, 779 bp, Homo sapiens
  misc_feature: GYAE6OF02FX4TN.39.6.A06.1.454.CMB.1.raw
  modified_base (311)..(311): a, c, t, g, unknown or other
  misc_feature (311)..(311): n is a, c, g, or t
tcagtcgcactagtcacgaccggtgctcgatttagatctactgacaacacacgaagggggaggaactgctcagttaggacccagacggaaccatggaagccccagcgcagcttctctttcctcctgctactctggcctcccagataccactggagaagtagtgatgacgcagtcctccagccctaccctgtctgttgtccgtaccgaaggggaaagacgcccaccccgttctcccgtggcgacgggccaggtcaggacttagtagccagactaacttagcctgtaccagaccaaaaccgtggccgagaccncccaggcctccgtcatgtatcggtgtccgtccgaaccgacggaccctacgtacgggtaacctaccccgacgtaccgtacgggtttacgaggtcggacgtacggttacggggtcgtacggggaaccgtaagggttacgttaccgtacgttaccgtaccgaaccctagttaccacggacccgtacggtcctacggtacccggtaacggtaccgttaacggtaaacgtttaggtttttaacgtttaaccgttttaccgtttaaccgttcggttaacctacggtaccttaaggttaacgttaccggttaacccgtttaccgtccggttacccgttaaccgtaaccgtttacgtttacggacccggttaacggggtacccgttaagggttacggtaagtaacggttaacccgtaaacgttaccggttagggttaccgtcggtacgtacccgtacgttaccgttcgttaacccg

SEQ ID NO: 28470 - DNA, 906 bp, Homo sapiens
  misc_feature: GYAE6OF02IZT2W.39.6.A06.1.454.CMB.1.raw
  modified_base (881)..(881): a, c, t, g, unknown or other
  misc_feature (881)..(881): n is a, c, g, or t
  modified_base (901)..(901): a, c, t, g, unknown or other
  misc_feature (901)..(901): n is a, c, g, or t
  modified_base (904)..(904): a, c, t, g, unknown or other
  misc_feature (904)..(904): n is a, c, g, or t
tcagtcgcactagtcacgaccggtgctcgatttagatctactgacagggtggaaggagactgggtcatccagatgacccagtctccttccaccctgtctgcatctgtaggagacagagtcaccatcacttcgccgggccagtcagagtattagtagcgtggttggcctaggttatcagacaagaaaaccgaaggggaaactaccccgaaacctaccttaaaatttaataacggcgtaccgtacttttaaaggaaacggttcggggtacccctaagtaccgtaaagggtttccaacggtccgggtaccagggtttacggaagttcccggtaggggtaaccgtaggtaaaactttccgtaaacggttaccttaccgaaacccgtaacgttaccgtaaaggaccctaaccgtacccggtaggtaacccacggtaaccccgttaggtaaaacgtaacgttttttccggaaaccttaaaaccggttttaacttaaccggttacgaaacccctaaaagttaaacgtttaaatttaaaacgttttaaccgttttacccccgttaaaaccgttttaaaccggttttacgggaacccccggttaagggggtaaaacccctaagggtacccggttaggggtaaccctaaaccggtacccgtaaaacgggttaaccgtcggtacgggtaacgtaaccggtacccaaacgtaactttaccgtttacggtttacccttacccgtaacgtttccttacccccgtacctaaccttaccgttaacggtaaaccttacggtaccgttacggaacgttaccggggaacggtaccggggttaccgttaacggggacctaaaccggggtcaacccgttaagtaacgtacgacgtaggactnaattacgatggcaagtatcncanag

SEQ ID NO: 28471 - DNA, 752 bp, Homo sapiens
  misc_feature: GYAE6OF02GWA7G.39.6.A06.1.454.CMB.1.raw
  modified_base (155)..(155): a, c, t, g, unknown or other
  misc_feature (155)..(155): n is a, c, g, or t
  modified_base (209)..(209): a, c, t, g, unknown or other
  misc_feature (209)..(209): n is a, c, g, or t
  modified_base (334)..(334): a, c, t, g, unknown or other
  misc_feature (334)..(334): n is a, c, g, or t
tcagtcgcactagtcacgaccggtgctcgatttagatctactgacaacgacacaagggggaggaactgctcagttaggacccagacggaaccatggaagccccagcgcagcttctcttcctcctgctactctggcctcccagataccacgtgganaagtagtgatgacgcagtctccagcccaccctgtctgtctctccgaaggggaancgtcccacccttctcctgccgtacgggccagtacagtacttaatagcaagactaacgttacgccgtaggttaccaagtaacctaaaaccgtggaccctaggtaccctccgacgtaccgtccctanagttcgtacgttggtccgtaccgtacccctaacggtccggacctacgttaggtcccaccctaacgcggtacgttcgtagggtcgtctacggtgggttcgtacggacgtaggtacgttcgtaaggttccctaccaaccgtagtccgacgtacgaccgtacgttcgcgttacgtacgttaggtaaacgtttcgttttagtttaaccgttttacgttaacgttccggtactaacggttacgtaaggttaacttggttacccgtttaaccgttccgtaccgttaaccgttaccgtttaccggttttacgacccgggttaaccgggtaccgttagggttaaccggtacggtaacgtaaacccgtaacggtaacgttaccgtacggtaccttaccggaccgttaaccgttaccgtcgttaaccg

SEQ ID NO: 28472 - DNA, 736 bp, Homo sapiens
  misc_feature: GYAE6OF02HIDS6.39.6.A06.1.454.CMB.1.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
  modified_base (527)..(527): a, c, t, g, unknown or other
  misc_feature (527)..(527): n is a, c, g, or t
  modified_base (717)..(717): a, c, t, g, unknown or other
  misc_feature (717)..(717): n is a, c, g, or t
tcagtcgcactagtcacgaccggtgctcgatttagatctactgacaacgacacaaggggaggaactgctcagttaggacccagacggaaccatggaacgccccagcgccagcttctcttcctcctgcttactctaggcctacccagtactaccctacgtggagaagttacgtgattggaaccgtcaagttcctccaaggtcccacccttgtctgttcgtactaccggaaggggaancgccctacctntccngccgtacggctagtcagtactagttacgctacgacgtaacttcgccgttaggtaccaaggaacctaaaaccgtggccaacggtccaccgtatccgtctacgngtcttagtcggtacnccgttacaccggtacgtcctcgtcgtacctaccgcgtaccgtagttcgacggtagcgttagggtcgtcgtagggactacggtcgttacgacttccggtacctacggtactacgacgggtcaccgtacgtgaccgttaacgtcgttaggttaaacgtttntttacgggttaaaccttttcgtacggtttatacccgtagttaaccgtgtttaaacggggtccttaacccgttacggtacccgttacccgtaacgttacgttaccggttaccgggccgtaagggttacccggtagtaccgggtaactacgttaaccgaacccgttagtcgacccggttcacccggttaacnccgttacgatttaccccgg

SEQ ID NO: 28473 - DNA, 789 bp, Homo sapiens
  misc_feature: GYAE6OF02FOHLH.39.6.A06.1.454.CMB.1.raw
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (779)..(779): a, c, t, g, unknown or other
  misc_feature (779)..(779): n is a, c, g, or t
tcagtcgcactagtcacgaccggtgctcgatttagatctactgacaacacgacaagggggaggaactgctcagttaggacccagacggaaccatggaagccccagcgcagcttctcttcctcctgctactctggctcccagactaccactggagaagtagtgatgacgcagtctcagccacctgtcngtntctcgaggggaatcgccacccgtntccgtgcgacgggcctagtcgaagactaattcgacagtctaacgttacgacctacggtaccaacgtaacgaaaaaccgtggaacccagaccgtacccgaggccctaccgtactagtcgtaagtcggttacaccgtacgaaccgtcggacctacgtcggtaccttacccgaacggtaccgtaaggttcgtacggtacgggtacgtaggtacgggtacgtacggggtacaacggtacgttacgtccggttaactccgtaaacctagtacgacgtacgtacggttaccgtacggtaccttaggtaccgttaaggtaaaccgttttagttttaaccgttttaacgttttaacgttaaccgttagttaccggtaacgtaccgttaaggttaacgttacgttaacccgttaccgttaccggtaccctttaaccggtaaaccgttttacccggtttaaaccgggaccgggttaaccgggtaccggttacgggttaaacgggtacggtaaaccgttaaccgaaaacggttaccgttaggacggttacgtaccggtaaccgtaacttaccggtntttaacccgg

SEQ ID NO: 28474 - DNA, 167 bp, Homo sapiens
  misc_feature: GYAE6OF01CAJS9.46.89.I01.1.454.CMB.1.raw
  modified_base (165)..(167): a, c, t, g, unknown or other
  misc_feature (165)..(167): n is a, c, g, or t
tcagactagcagtacacgaccggtgctcgatttagtatgctagtatcgcggggtgttcggcggaggaccaaactgaccgtcctaggtcagcccaaggctgcccctcggtcactctgttcccaccctcctctactgctagtctgagcggctggcaaggcgcatagnnn

SEQ ID NO: 28475 - DNA, 221 bp, Homo sapiens
  misc_feature: GYAE6OF01EN30T.46.89.I01.1.454.CMB.1.raw
  modified_base (56)..(56): a, c, t, g, unknown or other
  misc_feature (56)..(56): n is a, c, g, or t
  modified_base (161)..(161): a, c, t, g, unknown or other
  misc_feature (161)..(161): n is a, c, g, or t
  modified_base (167)..(221): a, c, t, g, unknown or other
  misc_feature (167)..(221): n is a, c, g, or t
tcagactagcagtacacgaccggtgctcgatttagtatgctagtatcgcgggggtnttcggcggaggaccaaactgaccgtcctaggtcagcccaaggctgccccctggtcactctgttcccaccctcctctactgctagtctgagccggctggcaaggcncatagnnnnnnnnnnnnnnnnnnnnnnnnnnnnnnnnnnnnnnnnnnnnnnnnnnnnnnn

SEQ ID NO: 28476 - DNA, 172 bp, Homo sapiens
  misc_feature: GYAE6OF01CJSLZ.46.89.I01.1.454.CMB.1.raw
  modified_base (170)..(172): a, c, t, g, unknown or other
  misc_feature (170)..(172): n is a, c, g, or t
tcagactagcagtacacgaccggtgctcgatttagtatgctagtatcgcgggatgggttttggcggagggaccaagctgaccgtcctaggtcagcccaaggctgcccctcggtcactctgttcccaccctcctcacgcactcgtctgagcgggctggcaaggcgcatagnnn

SEQ ID NO: 28477 - DNA, 170 bp, Homo sapiens
  misc_feature: GYAE6OF01C68M2.46.89.I01.1.454.CMB.1.raw
  modified_base (170)..(170): a, c, t, g, unknown or other
  misc_feature (170)..(170): n is a, c, g, or t
tcagactagcagtacacgaccggtgctcgatttagtatgctagtatcgcggggggtgttcggcggagggaccaaactgaccgtcctaggtcagcccaaggctgccccctcggtcactctgttcccaccctcctctactgctagtctgagcgggctggcaaggcgcatagn

SEQ ID NO: 28478 - DNA, 171 bp, Homo sapiens
  misc_feature: GYAE6OF01EN7LO.46.89.I01.1.454.CMB.1.raw
  modified_base (171)..(171): a, c, t, g, unknown or other
  misc_feature (171)..(171): n is a, c, g, or t
tcagactagcagtacacgaccggtgctcgatttagtatgctagtatcgcgggggggtgttcggcggagggaccaaactgaccgtcctaggtcagcccaaggctgccccctcggtcactctgttcccaccctcctctactgctagtctgagcgggctggcaaggcgcatagn

SEQ ID NO: 28479 - DNA, 167 bp, Homo sapiens
  misc_feature: GYAE6OF01A775O.46.89.I01.1.454.CMB.1.raw
  modified_base (167)..(167): a, c, t, g, unknown or other
  misc_feature (167)..(167): n is a, c, g, or t
tcagactagcagtacacgaccggtgctcgatttagtatgctagtatcgcggggtgttcggcggagggaccaaactgaccgtcctaggtcagcccaaggctgcccctcggtcactctgttcccaccctcctctactgctagtctgagcgggctggcaaggcgcatagn

SEQ ID NO: 28480 - DNA, 607 bp, Homo sapiens
  misc_feature: GYAE6OF01BA2GU.46.89.I01.1.454.CMB.1.raw
  modified_base (57)..(57): a, c, t, g, unknown or other
  misc_feature (57)..(57): n is a, c, g, or t
  modified_base (603)..(603): a, c, t, g, unknown or other
  misc_feature (603)..(603): n is a, c, g, or t
tcagactagcagtacacgaccggtgctcgatttagtatgctagtatcgcggggggtnttcggcggagggaccaaactgaccgtcctaggtcagcccaaggctgcaccctggtcacgtctgttcccaccgtccgtctactggcctagtcctggacgccgggcttcgggccaaacgggtccgcctacgttacggctacgacgtcgacgtacgacgtacgacgtccgtacgtacgtcgaccgtacgcgtacgcgtacgtacgcgtacgacgtcgtcgcgcgtacgcgtacgcgacgtcgacgcgtcgtcgtacgcgtaccgcgtacgcgtcgacgtcgacgtacgtcgtcgtacgcggtacgtacgcgtacgtacgtcgtcgacgtcgtacgtcgacgtcgcgtacgacgtcgtacgtcgagtcgtcgacgtcgacgtagtcgtaccgtcggtacgtcgtacgcggtacgtacgcgtacgtcgtacgcgtcgtcgtcgtcgtcgcgtgtcgcgtacgtcgcgtcgtcgtcgtcgtacgcgtcgtagacgtcgcgtacgacgtcgcgtcgtacgtcgtcgtcgcgtcgcgtgcgtcgcgtgcgtcgngtcg

SEQ ID NO: 28481 - DNA, 171 bp, Homo sapiens; identical to SEQ ID NO: 28478
  misc_feature: GYAE6OF01D6J7M.46.89.I01.1.454.CMB.1.raw
  modified_base (171)..(171): a, c, t, g, unknown or other
  misc_feature (171)..(171): n is a, c, g, or t

SEQ ID NO: 28482 - DNA, 177 bp, Homo sapiens
  misc_feature: GYAE6OF01B225D.46.89.I01.1.454.CMB.1.raw
  modified_base (175)..(177): a, c, t, g, unknown or other
  misc_feature (175)..(177): n is a, c, g, or t
tcagactagcagtacacgaccggtgctcgatttagtatgctagtatcgcggggggggtgttcggcggagggaccaaactgaccgtcctaggtcagcccaaggctgccccctcggtcactctgttcccaccctcctctactgctagtctgaggcgggctggacaagggcacaatgnnn

SEQ ID NO: 28483 - DNA, 168 bp, Homo sapiens
  misc_feature: GYAE6OF02F7SZW.46.89.I01.1.454.CMB.1.raw
  modified_base (167)..(168): a, c, t, g, unknown or other
  misc_feature (167)..(168): n is a, c, g, or t
tcagactagcagtacacgaccggtgctcgatttagtatgctagtatcgcggggtgttcggcggagggaccaaactgaccgtcctaggtcagcccaaggctgcccctcggtcactctgttcccgccctcctgtactgctagtctgagcgggctggcaaggcgcatagnn

SEQ ID NO: 28484 - DNA, 169 bp, Homo sapiens
  misc_feature: GYAE6OF02GRXR6.46.89.I01.1.454.CMB.1.raw
  modified_base (169)..(169): a, c, t, g, unknown or other
  misc_feature (169)..(169): n is a, c, g, or t
tcagactagcagtacacgaccggtgctcgatttagtatgctagtatcgcggggggtgttcggcggagggaccaaactgaccgtcctaggtcagcccaaggctgcccctcggtcactctgttcccgccctcctctactgctagtctgagcgggctggcaaggcgcatagn

SEQ ID NO: 28485 - DNA, 168 bp, Homo sapiens
  misc_feature: GYAE6OF02IZH3O.46.89.I01.1.454.CMB.1.raw
  modified_base (168)..(168): a, c, t, g, unknown or other
  misc_feature (168)..(168): n is a, c, g, or t
tcagactagcagtacacgaccggtgctcgatttagtatgctagtatcgcgggggtgttcggcggagggaccaaactgaccgtcctaggtcagcccaaggctgcccctcggtcactctgttcccgccctcctctactgctagtctgagcgggctggcaaggcgcatagn

SEQ ID NO: 28486 - DNA, 171 bp, Homo sapiens
  misc_feature: GYAE6OF02GIRF5.46.89.I01.1.454.CMB.1.raw
  modified_base (169)..(171): a, c, t, g, unknown or other
  misc_feature (169)..(171): n is a, c, g, or t
tcagactagcagtacacgaccggtgctcgatttagtatgctagtatcgcgggggtgttcggcggagggaccaaactgaccgtcctaggtcagcccaaggctgccccctcggtcactctgttcccaccctcctctactgctagtctgagcgggctggcaaggcgcatagnnn

SEQ ID NO: 28487 - DNA, 174 bp, Homo sapiens
  misc_feature: GYAE6OF02HM9DT.46.89.I01.1.454.CMB.1.raw
  modified_base (170)..(174): a, c, t, g, unknown or other
  misc_feature (170)..(174): n is a, c, g, or t
tcagactagcagtacacgaccggtgctcgatttagtatgctagtatcgcggggggtgttcggcggagggaccaaactgaccgtcctaggtcagcccaaggctgccccctcggtcactctgttcccaccctcctctactgctagtctgagcgggctggcaaggcgcatagnnnnn

SEQ ID NO: 28488 - DNA, 170 bp, Homo sapiens
  misc_feature: GYAE6OF02GAZSV.46.89.I01.1.454.CMB.1.raw
  modified_base (170)..(170): a, c, t, g, unknown or other
  misc_feature (170)..(170): n is a, c, g, or t
tcagactagcagtacacgaccggtgctcgatttagtatgctagtatcgcggggggtgttcggcggagggaccaaactgaccgtcctaggtcagcccaaggctgccccctcggtcactctgttcccgccctcctctactgctagtctgagcgggctggcaaggcgcatagn

SEQ ID NO: 28489 - DNA, 171 bp, Homo sapiens
  misc_feature: GYAE6OF02H7J2C.46.89.I01.1.454.CMB.1.raw
  modified_base (170)..(171): a, c, t, g, unknown or other
  misc_feature (170)..(171): n is a, c, g, or t
tcagactagcagtacacgaccggtgctcgatttagtatgctagtatcgcggggggtgttcggcggagggaccaaactgaccgtcctaggtcagcccaaggctgccccctcggtcactctgttcccaccctcctctactgctagtctgagcgggctggcaaggcgcatagnn

SEQ ID NO: 28490 - DNA, 174 bp, Homo sapiens
  misc_feature: GYAE6OF02IFM4J.46.89.I01.1.454.CMB.1.raw
  modified_base (170)..(174): a, c, t, g, unknown or other
  misc_feature (170)..(174): n is a, c, g, or t
tcagactagcagtacacgaccggtgctcgatttagtatgctagtatcgcgggatgggttttggcggagggaccaagctgaccgtcctaggtcagcccaaggctgcccctcggtcactctgttcccaccctcctcacgcactcgtctgagcgggctggcaaggcgcatagnnnnn

SEQ ID NO: 28491 - DNA, 223 bp, Homo sapiens
  misc_feature: GYAE6OF02I5P0H.46.89.I01.1.454.CMB.1.raw
  modified_base (57)..(57): a, c, t, g, unknown or other
  misc_feature (57)..(57): n is a, c, g, or t
  modified_base (160)..(160): a, c, t, g, unknown or other
  misc_feature (160)..(160): n is a, c, g, or t
  modified_base (165)..(223): a, c, t, g, unknown or other
  misc_feature (165)..(223): n is a, c, g, or t
tcagactagcagtacacgaccggtgctcgatttagtatgctagtatcgcggggggtnttcggcggagggaccaaactgaccgtcctaggtcagcccaaggctgcccctggtcactctgttcccacctcctctactgctagtctgagcggctggcaaggcncatgnnnnnnnnnnnnnnnnnnnnnnnnnnnnnnnnnnnnnnnnnnnnnnnnnnnnnnnnnnn

SEQ ID NO: 28492 - DNA, 271 bp, Homo sapiens
  misc_feature: GYAE6OF02FD7N3.46.89.I01.1.454.CMB.1.raw
  modified_base (62)..(62): a, c, t, g, unknown or other
  misc_feature (62)..(62): n is a, c, g, or t
  modified_base (183)..(185): a, c, t, g, unknown or other
  misc_feature (183)..(185): n is a, c, g, or t
  modified_base (187)..(187): a, c, t, g, unknown or other
  misc_feature (187)..(187): n is a, c, g, or t
  modified_base (189)..(192): a, c, t, g, unknown or other
  misc_feature (189)..(192): n is a, c, g, or t
  modified_base (198)..(198): a, c, t, g, unknown or other
  misc_feature (198)..(198): n is a, c, g, or t
  modified_base (201)..(271): a, c, t, g, unknown or other
  misc_feature (201)..(271): n is a, c, g, or t
tcagactagcagtacacgaccggtgctcgatttagtatgctagtagtcggtcggggggggtnttcggcggagggacccaaactcgaccggtcctaggtcagtcccaaggtctgcccccctggtcactctgttcccaccctcctctactgctagtctggagcgggctggcaaggtcgcatagtnnngntnnnnctgacngtnnnnnnnnnnnnnnnnnnnnnnnnnnnnnnnnnnnnnnnnnnnnnnnnnnnnnnnnnnnnnnnnnnnnnnn

SEQ ID NO: 28493 - DNA, 174 bp, Homo sapiens; identical to SEQ ID NO: 28490
  misc_feature: GYAE6OF02GOSRO.46.89.I01.1.454.CMB.1.raw
  modified_base (170)..(174): a, c, t, g, unknown or other
  misc_feature (170)..(174): n is a, c, g, or t

SEQ ID NO: 28494 - DNA, 172 bp, Homo sapiens
  misc_feature: GYAE6OF02G1VJW.46.89.I01.1.454.CMB.1.raw
  modified_base (171)..(172): a, c, t, g, unknown or other
  misc_feature (171)..(172): n is a, c, g, or t
tcagactagcagtacacgaccggtgctcgatttagtatgctagtatcgcgggggggtgttcggcggagggaccaaactgaccgtcctaggtcagcccaaggctgccccctcggtcactctgttcccaccctcctctactgctagtctgagcgggctggcaaggcgcatagnn

SEQ ID NO: 28495 - DNA, 170 bp, Homo sapiens; identical to SEQ ID NO: 28477
  misc_feature: GYAE6OF02F3NQP.46.89.I01.1.454.CMB.1.raw
  modified_base (170)..(170): a, c, t, g, unknown or other
  misc_feature (170)..(170): n is a, c, g, or t

SEQ ID NO: 28496 - DNA, 174 bp, Homo sapiens
  misc_feature: GYAE6OF02GO974.46.89.I01.1.454.CMB.1.raw
  modified_base (171)..(174): a, c, t, g, unknown or other
  misc_feature (171)..(174): n is a, c, g, or t
tcagactagcagtacacgaccggtgctcgatttagtatgctagtatcgcgggggggtgttcggcggagggaccaaactgaccgtcctaggtcagcccaaggctgccccctcggtcactctgttcccaccctcctctactgctagtctgagcgggctggcaaggcgcatagnnnn

SEQ ID NO: 28497 - DNA, 182 bp, Homo sapiens
  misc_feature: GYAE6OF02JKKXI.46.89.I01.1.454.CMB.1.raw
  modified_base (170)..(173): a, c, t, g, unknown or other
  misc_feature (170)..(173): n is a, c, g, or t
  modified_base (175)..(182): a, c, t, g, unknown or other
  misc_feature (175)..(182): n is a, c, g, or t
tcagactagcagtacacgaccggtgctcgatttagtatgctagtatcgcgggggggtgttcggcggagggaccaaactgaccgtcctaggtcagcccaaggctgccccctggtcactctgttcccgccctcctctactgctagtctgagcgggctggcaaggcgcatagnnnntnnnnnnnn

SEQ ID NO: 28498 - DNA, 499 bp, Homo sapiens
  misc_feature: GYAE6OF01E1050.52.53.E09.1.454.CMB.1.raw
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcgagtgggcaacgtacacctacgccatcgcatggcatcagctgcagccagagaagggccctggtacttgatgaggctcaacagtgatggcagccacagcgagggggacgtatccctgatcgcttctcaggctccggctcgtgggactgagcgctacctcaccatctcagcctcagtctgaggacgaggtgactattactgtcagacgtgggacacgtggctagtttgggtgttcgggcggagggacctaaggttcgaccgtcgtaggtcaggcccaaggctcccgg

SEQ ID NO: 28499 - DNA, 557 bp, Homo sapiens
  misc_feature: GYAE6OF01DSHZF.52.53.E09.1.454.CMB.1.raw
  modified_base (556)..(557): a, c, t, g, unknown or other
  misc_feature (556)..(557): n is a, c, g, or t
tcagcgcagtacgacacgaccggtgctcgatttagagagagtgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccacaaggcccatcgtcttcccctggcaccctcctccaagagcacctctggggcacacgcggcccgtgggctcgtccgtcggtacaacggtacttaccttccctaactaccgtatccgcgttagacggcgggctggacgacggacgcaatgnn

SEQ ID NO: 28500 - DNA, 623 bp, Homo sapiens
  misc_feature: GYAE6OF01BJJNS.52.53.E09.1.454.CMB.1.raw
  modified_base (387)..(387): a, c, t, g, unknown or other
  misc_feature (387)..(387): n is a, c, g, or t
tcagcgcagtacgacacgaccggtgctcgatttagagagagtgtgttggggtttggggagagctctggggagtctgcaccatggcttggaccccactcctcttcctcaccctcctcctccactgcacagggtcctctctcccagcctgtgctgactcaatcgccctctgcctctgcctccctgggagcctcggtcaagctcacctgcactctgagcagtggcactacacctacgccatcgcatggcatcagctgcagccagagaacggccctcggtactgatgaggctacaacagtgatggcagccacagcggagggggacgtacgtcccgtgacgtcgtcttcgcgacgggtctccggtctcgtgggactggacgccgacctaccncgaccctatccgtaccacgtccctaccgtacgtccgtaggtacgggtacggtaggggttcgtaacttacgtttacgtaggtaccgtaaggtaccggttacgggactaccgtcgggtccgtaggtttcggggtacggttacggggacggggtacggggaacccgtaagggttaccggacccggttaccggttacgggtacgaccgggaccccggtaaagggtcccgttacccccggg

SEQ ID NO: 28501 - DNA, 523 bp, Homo sapiens
  misc_feature: GYAE6OF01AZTEU.52.53.E09.1.454.CMB.1.raw
  modified_base (381)..(381): a, c, t, g, unknown or other
  misc_feature (381)..(381): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctggtacttgatgaggctcaacagtgatggcagccacagcgagggggacgtatccctgatcgcttctcgaggctccggctcgtgggactgacgcgctacctcacccgatccnccagccctccgagtctggacggacgagggtgaacttattacgtgtacgagtacggtgggacacgtggctagtttgggtcgttcgggcggagggacctaggttcgaccgtccgtaggttccaggcccgaaggtccgtacccgg

SEQ ID NO: 28502 - DNA, 609 bp, Homo sapiens
  misc_feature: GYAE6OF01AS4XR.52.53.E09.1.454.CMB.1.raw
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaacggccctggtacttgatgagctcaacagtgatggcacgccacgagcggagggggacgtactcccgtgactcgtcttcgtcgacggtctcccggctcgtcgggactggacgccgacctacctcaccctatccctacccacgtcccctccgtacgttccgtacggaacgggtaccggagggttcgtaacgttacgttaccgtggtaccgtaaggtaccggtagggtaccacggtcggtacgttagggtttcggggtacgggttccgggacggggtacgggaccgttaaggttccggtaccgttaccggtacggtacgaccgggaccctaacgggtccgtcccccggg

SEQ ID NO: 28503 - DNA, 636 bp, Homo sapiens
  misc_feature: GYAE6OF01DVG5I.52.53.E09.1.454.CMB.1.raw
tcagcgcagtacgacacgaccggtgctcgatttagagagagtgtgttgggtttgggggagagctctgggggagtctgcaccatggcttggaccccactcctcttcctcaccctcctcctccactgcacagggtctctctcccagcctgtgctgactcaatcgccctctgcctctcgcctcccgtgggacgcctcggtcaagctcacctgcactctgagcagtggcactacacctacgccatcgcatggcatcagctgcagcagagacggcctggtactgatgagctacaacgagtgagtgacacgaccacgaggacggacggggggacgtactcccgtagacgtcgtcttcgacgacggtccgtccggcttcggtacgggactggacgccgtacctacctaccaccctactcctaccgacgtccctacgtacgtacgtaggaacgggacggtagggtactacgttaagtttacgtacggtaccgagggaaccgggttagggaaccttacggtacggtacgttacgggttttcggggtaggttaccgggggaacgggtaagggaaccgttaaagggttaccggacccggttaccgtagggtacccaaccggtacccgtaagggtccttacccccggg

SEQ ID NO: 28504 - DNA, 580 bp, Homo sapiens
  misc_feature: GYAE6OF01B6R56.52.53.E09.1.454.CMB.1.raw
  modified_base (211)..(211): a, c, t, g, unknown or other
  misc_feature (211)..(211): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgccctccctgggagcctcggtcaagctcacctgcactcngagcaggtggcactacacctacgccatcgcatggcatcagctgcagccaggacggaacgggtcccttacgggtacttgacgtggacggctacgaacagtgagtcggcacgccaacgtaggacgggacgggggacgtactcccgtgactcgcttcgacgacggccgtcggctcgtagggactggacgccgtcctaccgtccacctactcctccgacgtccctacgacgtcgtaggacggtacggtaggtacgtacgttacttacgtcgtacgaggtaccggtaggactacggtgtacgttaggttcgggtggtcgggacggtacggacgtacggtcgtacgtcgtacgacacgaccgacgtcgtaccccg

SEQ ID NO: 28505 - DNA, 703 bp, Homo sapiens
  misc_feature: GYAE6OF01DPXJ5.52.53.E09.1.454.CMB.1.raw
  modified_base (296)..(296): a, c, t, g, unknown or other
  misc_feature (296)..(296): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctcccgtgggagcctcggtcaagctcacctgcactctgagcagtggcactacacctacgccatcgcatggcatcagctgcacgcagacggaacggcctcggtactgagtgacggctcaacgngtgagtggacacgccgacgaggacggacggggacgtacgtccgtgactcgtcttcgtacgacggtccgtccggtccgttcgtacgggacgtaggaccggtccggtacccttaaccgtccctaacccgtacttacccggtacccaccggtccccgtaccgtaacgttccggtacggaacggggtaacggtaggggttacctaacgtttaacgttaccgtacggttaccgaagggtaccgggttcgggtaacctacgggttcgggtacgtttaagggtttcggggttcgggttccgggggtaacccggggtaacggggttaacccgtaagggtttacccgggtacccggttaccggttacgggacccgtaacccgggtaccccggtaaacggtcccgtaccccccgggg

SEQ ID NO: 28506 - DNA, 770 bp, Homo sapiens
  misc_feature: GYAE6OF01ALG8L.52.53.E09.1.454.CMB.1.raw
  modified_base (266)..(266): a, c, t, g, unknown or other
  misc_feature (266)..(266): n is a, c, g, or t
  modified_base (769)..(769): a, c, t, g, unknown or other
  misc_feature (769)..(769): n is a, c, g, or t
tcagcgcagtacgacacgaccggtgctcgatttagagagagtgtgttgggtttgggggaggcttggtaaagcggggggggtatctgagactctcctgttcagtctctggattcaccttaaataactatggcatgagctgggtccgccaggctccgaggggaaggggctggagtgggtctcatttatcagtggtactggtggtagcacatactacgcagactccgtgaagggccgttcaccatctaccaaagacaattccaagaacncgctgtattacaaatgaacagcctgagagcgaggacacggccgtatattactgtgtagaaagtactctacctaccgtcctcccgtccccccgttggtaccgttgggttttaactttccggaccgttcccggtcgggggacccgtaacggggtaaccccttaggtaaccggtcccgttcccttacccgtcgaaccgtcccctacccgaacccggaaccgggtcccctaacgttccccgggtccccctttccccccggttacgggacccctacccccttacccgtacccgaacggacccgcccctacccgtccgggtaccgggggaccaaccggtaccgggccccgggtccccggtcgggggtcccttaccgggtcccgttacgggtacccgtaaccgggtacccctttacctttacccgtagtaacccggtacgtccggtaccggtcgggaacgggtcccggggccggttacgggaccggtaacggggcccacggaagtacggnc

SEQ ID NO: 28507 - DNA, 788 bp, Homo sapiens
  misc_feature: GYAE6OF01CXL09.52.53.E09.1.454.CMB.1.raw
  modified_base (145)..(145): a, c, t, g, unknown or other
  misc_feature (145)..(145): n is a, c, g, or t
  modified_base (332)..(332): a, c, t, g, unknown or other
  misc_feature (332)..(332): n is a, c, g, or t
tcagcgcagtacgacacgaccggtgctcgatttagagagagtgtgttgggtttgggggaggcttggtaaaggcgggggggtatctgagactctcctgttcagtctctggattcaccttaaataactatggcatgagctgggtccnccaggctccgagggaaggggcttggagtgggtctctatttatcagtggtactggtggtagcacatactacgcagactccgtgaaggccggttcacatctaccaaagacaattcaagaacacgctgttattacaaatagaacagctagagagccgaggcacggcgtatattacgtgtagtagaaagtntctaccgtacgtccgtccgcccccgttaggaccgttaggtttactttccgtaaccgttcccggttggggaccccgaacggggtaaacccttaggtaaccgtcccggttcccttaccgtaccgtacgccccgttaaccccgaacccggtaaaccgggtcccctaacgtttccccgggtttaccccgtttacccccccgtacgggttaccccttaaccccggttacccctttaacccgaaacgtaacccggtaccccgtaaccccgtttacgggtcccggggggtaccaacccggtaaccggtccccggggtacccccgttggggtacccgtccgggttacccgttacgggttaccgttaaacgggtccctttaaccgttcccgttaccggtaaccgttccgccggtcgtacgggacggtccggggccgttacggacggaacgggccagactagcgag

SEQ ID NO: 28508 - DNA, 819 bp, Homo sapiens
  misc_feature: GYAE6OF01C6LLX.52.53.E09.1.454.CMB.1.raw
  modified_base (212)..(212): a, c, t, g, unknown or other
  misc_feature (212)..(212): n is a, c, g, or t
  modified_base (817)..(817): a, c, t, g, unknown or other
  misc_feature (817)..(817): n is a, c, g, or t
tcagcgcagtacgacacgaccggtgctcgatttagagagagtgtgttgggtttgggggaggcttggtaaaggcgggggggtatctgagactctcctgttcagtctctggattcaaccttaaataactatggcatgagctgggtccgccaggctccgaggggaaggggctgggaggtcgggtctctatttatcgaggtggtactgggtggtancacatactacgcaagacctccggtaggaacgggtccgttacaccaatcctaaccaaaagtactaaacgttaccaaaagaaccacgtcttagttaatttaacaaattacgaaacacgcctaggaagaccggaccgaacggtaccaacggggacccttaattactttacgtggtgtaagaaagtcttacctaccacgttcctcccgtccccgttaggtacgttaggtttactttaccggtacttcccgggtaggggtacccgtaacgggtaaaccccgtaggtacgtccccggtccttcccacgtaccgtccccgtacccgaaaccggacccgggtacccgtacgttcccggttacccccgtttcccccgtacggtacccctaccccttacccgtaaccgaaccggtacgtacccgtacccggtccgggtaccggggactaccggaccggccccgggtcccggtcgggtccgtccgggacccgttacgggtacgtaaaccgggttacctacccgtttaccgtaacgtaccggtacgtccggtaccgtaggggacgggtccggggtaccggtacggggaaccgaacgggggtccctaggtaccgtagngc

SEQ ID NO: 28509 - DNA, 679 bp, Homo sapiens
  misc_feature: GYAE6OF01AXKIU.52.53.E09.1.454.CMB.1.raw
  modified_base (332)..(332): a, c, t, g, unknown or other
  misc_feature (332)..(332): n is a, c, g, or t
  modified_base (679)..(679): a, c, t, g, unknown or other
  misc_feature (679)..(679): n is a, c, g, or t
tcagcgcagtacgacacgaccggtgctcgatttagagagagtgtgttgggtttgggggaggcgttggtaaaggcgggggggtatctgagactctcctgttcagtctctggattcaccttaaataactatggcatgagctgggtccgccaggctccgagggaaggggctggagtgggtctcattttatcagtggtactggtggtagcacatactacgcagactcgtgaagggccgttcaccatctaccaaagacaattccaagaacacgctgtatttacaaatgaacagcctgagagccgaggacacggccgtatattactgtgtagaaagtntccgtccacgtctccgtcccccgttggacgttagttacgtttaccgacttcccgtggggacccaacggggtaaaccccttaggtaacggtcccgttccgtacccttacgaccggtcccttaacccgaaccgaaccgggcccctaacgttccgggttcccctttacccccgttcggcccctaccccttccctaacccgaacgacgaccctacccgtaccggtcgggggaccacgacggcccggacccgtgggcctccgtccgtacggtaccaacgggtaccttaccgttcctacgtacgtacgtcgtacgtcgacgggccggcgtacggacgacggcgagactagcgn

SEQ ID NO: 28510 - DNA, 571 bp, Homo sapiens
  misc_feature: GYAE6OF01CT0BF.52.53.E09.1.454.CMB.1.raw
  modified_base (267)..(267): a, c, t, g, unknown or other
  misc_feature (267)..(267): n is a, c, g, or t
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (430)..(430): a, c, t, g, unknown or other
  misc_feature (430)..(430): n is a, c, g, or t
  modified_base (569)..(569): a, c, t, g, unknown or other
  misc_feature (569)..(569): n is a, c, g, or t
tcagcgcagtacgacacgaccggtgctcgatttagagagagtgtgttgggtttgggggaggcttggtaaagcgggggggtatctgagactctccgtgttcagtctctggattcaccttaaataactatggcatgagctgggtccgccaggcctccaagggaaggggctggagtgggtctcatttatcagtggtactggtggtagcacatactacgcagactccgtgaaggccgttcaccatctaccaaaagacaagttccaagaacncgctgtatttacaaatgaacagctganagccgagacacggccgtatattactgtgtanaaagntctccacgtctccgccccttgacttgttacttcgactcgtgggccaggacctgacgcctctcncgacncctccacgacggcccagtccggtcctccccgngacctaccctccgtaccaagcgaccaccgtcgtacgggaccacgacgccggcccgtggctcgccgtggtacaacggtcctacgttccctacgtacctgccgtcgtggacggcggctcgggaccgtaaggcgacgagtgnag

SEQ ID NO: 28511 - DNA, 720 bp, Homo sapiens
  misc_feature: GYAE6OF01CVNAB.52.53.E09.1.454.CMB.1.raw
  modified_base (263)..(263): a, c, t, g, unknown or other
  misc_feature (263)..(263): n is a, c, g, or t
  modified_base (322)..(322): a, c, t, g, unknown or other
  misc_feature (322)..(322): n is a, c, g, or t
tcagcgcagtacgacacgaccggtgctcgatttagagagagtgtgttgggtttgggggaggcttggtaaagcggggggggtatctgagactctcctgttcagtctctggattcaccttaaataactatggcatgagctgggtccgccaggctccagggaaggggctgggagtgggtctcatttatcagtggtactggtggtagcacatactacgcagactccgtgaagggccgttcaccatctacaaagcaattccaagaacncgctgtatttacaaatcgaacagcctagagacgacggaggacacggccgtatattacgngtgtagaagatctccactcgtacctccccgtggacttggttactttcgactccgtggggaccaacgggtaaccctagtacgtcccgtcctcgtcgacgccctaccaccgtaacgggcccctaacgttccgggttacccctttcccccgtcggtaccctaccccttaccccgtacgaacgacgacccgtaacccgtcggttcgggggcccaaccggtaccgggaccgggtccccggttacgggggtcccgttaccggtcccggttcgggtaccggtaacgggtacccttaccgtttacccgttaacctaaccggtccgttaccggcccggttaggtacccggggtccgggacggttaccgggaccgggtaacgggcccgtaaccggaagtaaggtccga

SEQ ID NO: 28512 - DNA, 718 bp, Homo sapiens
  misc_feature: GYAE6OF01ANT3T.52.53.E09.1.454.CMB.1.raw
  modified_base (186)..(186): a, c, t, g, unknown or other
  misc_feature (186)..(186): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctccagcctgtgctgactcaatcgccctctgcctctcgcctccgtgggacncctcggtcaacgctcacctgcactctgacgcaggtcggcactaccacctacgccacgtcgcatggacactcgagctgcacgcgagacggaacggtccgtcggtacgttgacgtcggacggtctacgaacgtaggtacgtacgtcggacgacgaccgacgacgggacgggacggggtacgtaccgtccgtagacgtcgtcttacgtaccgtacggtcccgtccggtccgtcggtacgggacgtcgacggtccgtacctacccgtacctacccgtaacgttcccgtaccgtaccgtccgtaccgtacggtcgtacgggaaccgggtacgggtacgggtaccgtaacgtttaacgttacgtacgtaccggtacggttacgggtacgggtaaccgtacgtcggttacgttaccggtttacggggtaccggttacgggacgggtaccgggtaaaccggttcggttacccgggttacccggttaccggttacgggtacccgtaaccggtcccggtaaacgggtcccgttacccccggg

SEQ ID NO: 28513 - DNA, 686 bp, Homo sapiens
  misc_feature: GYAE6OF01EN080.52.53.E09.1.454.CMB.1.raw
  modified_base (188)..(188): a, c, t, g, unknown or other
  misc_feature (188)..(188): n is a, c, g, or t
  modified_base (206)..(206): a, c, t, g, unknown or other
  misc_feature (206)..(206): n is a, c, g, or t
  modified_base (535)..(535): a, c, t, g, unknown or other
  misc_feature (535)..(535): n is a, c, g, or t
  modified_base (684)..(685): a, c, t, g, unknown or other
  misc_feature (684)..(685): n is a, c, g, or t
tcagcgcagtacgacacgaccggtgctcgatttagagagagtgtgttgggtttgggggaggcttggtaaaggcggggggggtatctgagactctcctgttcagtctctggattcaaccttaaataactatggcatgagctgggtccgccaggctccgaggggaaggggctggagtgggtctcatttancagtggtactggtggtancacatactacgcagactccggtgaacgggccgttcaccatcctaccaaagacaattccaaagaacacgctagttattaacaaatgaacagcctgagagccgaggacacggccgtatattactggtgtagaaagactctcctacgtctccgtcccccgttggaccttggtttactttcgaccttcccggtcgggggacccgaacggggtaaaccccttacggtacgtcccgttacctcccgttacacgtccctacccgaacccgaacgggtcccctacgtcccgggttcccttccccccgtggccctaccccgtccctacccaagtaccncctacccgtccggtcggggccaccgcggcccgggcccgtcgggcctcggcccgttgggtaccgaacggtaccttacccttaccgtaacgttaccgacgttccgcgtggacgggccgggtccgtagggaccgtacggacgacgtaagtgnng

SEQ ID NO: 28514 - DNA, 794 bp, Homo sapiens
  misc_feature: GYAE6OF01C2JN9.52.53.E09.1.454.CMB.1.raw
  modified_base (792)..(792): a, c, t, g, unknown or other
  misc_feature (792)..(792): n is a, c, g, or t
  modified_base (794)..(794): a, c, t, g, unknown or other
  misc_feature (794)..(794): n is a, c, g, or t
tcagcgcagtacgacacgaccggtgctcgatttagagagagtgtgttgggttgggggaggcttggtaaaggcggggggggtatctgagactctcctgttcagtctctggattaccaaccttaaataactatggcatgagctggggtccgccgaggcctccggaagggggaagggggcgtgggaggtcgggtctctatttatcgaggtggtacgtgggtggtagcaacaatacctacgcgaagaccgtccggtagggaaccggggtccggttaccaacctactacctaaccaaaaagacctaaacttacccaaaagaacctacgtcttaagttaacttaaactaaagtacgaaccacgtacgaggaacggacggacggaacggacgacggtaccgttaatacgttacgtagtagaagaaacgtctacctaccgtaccgttcccgtcccgtccccggttagtacggttacgtttacgttacgtaccgtccgggtcgggaccggtaaccggtaaccggtacgtaccgtccgtacctccgaccgtaccgacctacccgaccggaaccggaccgtaccgtcccggttccccttcccggtacgaccctacccctacccgaaccgtaacgaccgaccgtacccggtcggaccggggacaacggccgggtccggcccgtcgggtccgtccgtaccggtacggtaacgaaccgtaccgttaccttaactacgtaccggtacgtacccggtcggtaggacgggtccgggtcgaccgggaacgaccggacgtaacgaggtagngn

SEQ ID NO: 28515 - DNA, 582 bp, Homo sapiens
  misc_feature: GYAE6OF01B0CDI.52.53.E09.1.454.CMB.1.raw
  modified_base (565)..(565): a, c, t, g, unknown or other
  misc_feature (565)..(565): n is a, c, g, or t
  modified_base (577)..(577): a, c, t, g, unknown or other
  misc_feature (577)..(577): n is a, c, g, or t
  modified_base (581)..(582): a, c, t, g, unknown or other
  misc_feature (581)..(582): n is a, c, g, or t
tcagcgcagtacgacacgaccggtgctcgatttagagagagtgtgttgggtttgggggaggcttggtaaagcggggggggtatctgagactctcctgttcagtctctggattcaccttaaataactatggcatgagctggggtccgccaggctccgagggaaggggctggagtgggtctcatttatcagtggtactgggtggtagcacatactacgcagactccgtgaacgggccgttcaccatctaccaaagacaattccaagaaccacgctagtatttaacaaatgaacagcctgagacgccgaggacacggccgtatattactgtgtagaagatctccacgtcctccgtccccgttgacttggttacttcgactcgtcggggccaggaaccctagtcgccgtctcctcacgcctccaccgacggccctatccggtcccttccccgtggccctacccctcctaccgaacgacgccaccgtcggcggggccacgacggccggccgtgggcctcgtccgtggtacacggacttactccgtataccgagtcgctggacgcgggtcngggcgacggcanatgnn

SEQ ID NO: 28516 - DNA, 699 bp, Homo sapiens
  misc_feature: GYAE6OF01AGQ1G.52.53.E09.1.454.CMB.1.raw
  modified_base (697)..(697): a, c, t, g, unknown or other
  misc_feature (697)..(697): n is a, c, g, or t
tcagcgcagtacgacacgaccggtgctcgatttagagagagtgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatcctaccaaaagacaattccaaagacacgctgtatttaacaaatgaacagcctgagagccgaggacacggccgtatacttactgtgtagaaagatcctcctacgtcctccgtccccgttggaccttggtttactttccgaccgttccgtggggaccgaacgggtaacccctaggtacgcccgtcctccgtcacgtccctacccaaccgaaccgggccctacgttccggtccccttcccccgtcggccctacccctccctaccgaacgaccgtccgacccgtcggtacgggggccacggtaccgggcccgggtcccgtcggggtacccttccgggtccgttacgggtaccgtaaaccgggttccttaaccctttcccgtaagttacccgtacgttcccggtcgttacgggaccggggtccgggtaccggtcggtaaccggaaccgggcgacgtagtagncg

SEQ ID NO: 28517 - DNA, 808 bp, Homo sapiens
  misc_feature: GYAE6OF01CCRWS.52.53.E09.1.454.CMB.1.raw
  modified_base (272)..(272): a, c, t, g, unknown or other
  misc_feature (272)..(272): n is a, c, g, or t
tcagcgcagtacgacacgaccggtgctcgatttagagagagtgtgttgggtttgggggaggcttggtaaaggcgggggggtatctgagactctcctgttcagtctctggattcaccttaaataactatggcatgagctgggtccgccaggctccgagggaagggctgggagtgggtctctatttatcagtggtactgggtggtagcacatactacgcagactccgtggaacgggtccgttcaccatctaccaaagacaacttccaaagaacncgtcttagttaactttaacaaaatagaacacgacctaggaaggacggaccggacggaccaccgggtaccgttaattactttacgttggtggtaaggaaacgtacttacctacccgtaccgttcccgttacccggtccccccgtttgggtaaccgtttggtttaacgttttaccgtaccgttcccgggtacgggggacccgtaaccggggtaacccgttacggtacgtcccgtccttacccgtccgacgtcccctacccgaaccggaaccgggccccttaacgtttccccgggttcccctttccccccggtcggtcccctaccccgttaccctacccgaaacgccgtacccgtaccccgtcgggttaccgggggacccacgtacccgggcccggtaccccggttggggcccgttaccggtccggttacgggtaaccgaacggtacccgtttaacccgttacctaaccgtacgtaccgtcggtacgttcgggacgggtcccgggcggtacggaccggaacgggcgaacgtacgcgtgc

SEQ ID NO: 28518 - DNA, 764 bp, Homo sapiens
  misc_feature: GYAE6OF01AT7XY.52.53.E09.1.454.CMB.1.raw
  modified_base (516)..(516): a, c, t, g, unknown or other
  misc_feature (516)..(516): n is a, c, g, or t
  modified_base (566)..(566): a, c, t, g, unknown or other
  misc_feature (566)..(566): n is a, c, g, or t
tcagcgcagtacgacacgaccggtgctcgatttagagagagtgtgttgggtttggggagagctcgtgggagtctgcacatggcttcggaccccactcctccttcctccaccctccctcctccactgcacgaggtctctcctcccacgccttgtgcgtcgtacctacaacgtcccgccccttcttcgcccttccgttccgccccgttaccccgggtgggtaccggtcccttcgggttaccaacgtcctcctacctccgactacctcgtaggacggtccgagggtcgggacctaacctaccctacccgtaccgccacgtccggactggtcggactacttcgacgcgtaggacccaacggcccggtaaggacggtaccggtccgttacggtactggacgtggacgacctaagacgttaggcgacgtcgggaccaacggccgtaaggaccgggtacggggggaacgggtacgttaaccctcgggaagttccggtctacccgtgaccggcggtccgtcggnttcggacggtagcggacgtactaccgtaccgacctcctaccgtacgtccnccgtaccgtaccgtcgtacggtacggtacgggtacgtacgggtactacggttacgttacggtcgtacggtaaccggtcggacgtcggtcgtacggttgttcggttcgggtcgggtacgggacggtaaccgggtaggttacgtaccgggttaccgaccggttacgacgtacccggccggtaaccggtcccggtacccgg

SEQ ID NO: 28519 - DNA, 710 bp, Homo sapiens
  misc_feature: GYAE6OF01ANSMJ.52.53.E09.1.454.CMB.1.raw
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctcgcctccctgggacgcctcggtcaagctcacctgcactctgagcagtggcactacacctacgccatcgcagtggcatcagctgcacgccagagaacgggccctcggtacttgatgagctcaacagtgatggcacgccgacgacggcggacgggggtacgtacgtcccgtgactccggtaccttcgtcgacggtccgtccggtcgtcggtcgggtaacctggacggtccgtaccttacccgtcctaaccccgtacttcccgtacccgtaaccggtcccctacccgtacgggttacccgtacgggaacgggtaccggtaggggttaccgtaacgtttaaccgtttaacggttcggtaccggtacggtaaccgggttcggggtaacctacggttccgggtacgttacgggttttcggggttacgggttacccggggtacggggtaaccggggtaacccggttaagggttacccgggtaaccccgttccggttaacgggtcccgaaccggtaccccggtaaacgggtcccgttacccccggg

SEQ ID NO: 28520 - DNA, 731 bp, Homo sapiens
  misc_feature: GYAE6OF01C0YYG.52.53.E09.1.454.CMB.1.raw
  modified_base (108)..(108): a, c, t, g, unknown or other
  misc_feature (108)..(108): n is a, c, g, or t
  modified_base (206)..(206): a, c, t, g, unknown or other
  misc_feature (206)..(206): n is a, c, g, or t
tcagcgcagtacgacacgaccggtgctcgatttagagagagtgtggttgggtttggggagagctcgtggggagtctgcaccatggcttcggaccccactcctcttccnccaccctcctcctccactgacacgagggtcctctcctaccacgccgtgtcgctacgactacaactccgccctcgtcgtcctcgtccgcccgtcccggnggaccgtcccgttacggtacaacgtcctaccgtaacctcgactaccgttcgacggaagccgtaaggcggaacctaacctaaccaaccgacacagtaccgactagtacgactacgtcgagtacgacgacgacggacgaaggacggtaccggtcctaggtactgacgtaggacacgtacgaacgtagtagacgtacgcgaacgtacgacggacgggacggggaacgggtactaccgtccgagtaccgtcgtcgtacgacggacgtccggtacggtcgtaggacggttaacgcggacacccgtaccgtaccgtaacctacttaccgtacgtaccgtacgacccgtaggacgtacgggtaacggaacgggtaacgtagggtacctaacgtttacggacttcgggaactacggacgggtacgtacgtgggtaccgtaggttacgggtcggtacgaacgggtaacggacgtaaacggtccgtacggacccgttacgcggtaaccgtaccgaccggtacgtccccgtcccgg

SEQ ID NO: 28521 - DNA, 700 bp, Homo sapiens
  misc_feature: GYAE6OF01BBAJK.52.53.E09.1.454.CMB.1.raw
  modified_base (697)..(697): a, c, t, g, unknown or other
  misc_feature (697)..(697): n is a, c, g, or t
tcagcgcagtacgacacgaccggtgctcgatttagagagagtgtgttgggtttgggggaggcttggtaaaggcggggggggtatctgagactctcctgttcagtctctggattcaaccttaaataactatggcatgagctgggtccgccgaggctccgaggggaaggggcgtgggagtgggtctctattttatcagtggtactggtggtagcacatactacgcagacgtccgtaggaacgggccgttcaccatctaccaaagacaataccaagaacacgcttgtaattaacaatagaacagcctgagacgccgaggacacggtaccgtataattacttggtagtagaaagtactctacctaccgtcgtcccgtccccgttggtacttggtttacgttccgacgttccggtcggggaccgaacggtaacccgtagtcggtcccgttctccctcgaccgtccctacccgaaccgacgggtcccctacggtccgttccccgttcccccgtacggcccctaccccgtcctacccgaacgccgccaccggtcggtccggggaccaccgacgggcccggtcccggtacgggtccgtcgggtccgtacgggtaaccgtaacgtaccttaccgttacctacgtaccgtagtaccgtcggcggacgggccgggtacggtagggtacccggaggaccgtacgagtgngac

SEQ ID NO: 28522 - DNA, 703 bp, Homo sapiens
  misc_feature: GYAE6OF01B615X.52.53.E09.1.454.CMB.1.raw
  modified_base (193)..(193): a, c, t, g, unknown or other
  misc_feature (193)..(193): n is a, c, g, or t
  modified_base (544)..(544): a, c, t, g, unknown or other
  misc_feature (544)..(544): n is a, c, g, or t
tcagcgcagtacgacacgaccggtgctcgatttagagagagtgtgttgggtttgggggagagctcgtggggagtctgcaccatggcttggaccccactcctcttcctcaccctcctcctccactgcacagggtctctcctccagcctgtgctgactcaatccgccctctcgcctctcgccctcccgtgggacnccgtcggtacaacgcctccacctgcctactcgtgacgcgaggtcggaccaacctaccaccgtaccgccacgtccgcagtcggactactcgacgtcgtcgacgacgacgaaggacggaccggtcccgtacggttacgttggagtacggacgtccacgaacgtaggtacgagtcggacacgaaccgaacggtacggggacgggggaacggggttaccttaccgtcccgagtaccgttccggttaccgttctacgggtaccggtcccgtcggttaccgtcgggtacgggtacccgtacgggcccgtaccgtacccgttacccctaccgtaaccctccgtcccgtacccggaccncccgttacacggtcgtagacgggacgtcgtactaacgttcgtactacggcgtacgggcgttagacgtcggtcgtgttaggtttcgggacggtacgggacgggttacggacgtacggtcccggtacgtacggtcgtacgacgtaccgcgggtcctcccgg

SEQ ID NO: 28523 - DNA, 579 bp, Homo sapiens
  misc_feature: GYAE6OF01BAMIJ.52.53.E09.1.454.CMB.1.raw
  modified_base (578)..(578): a, c, t, g, unknown or other
  misc_feature (578)..(578): n is a, c, g, or t
tcagcgcagtacgacacgaccggtgctcgatttagagagagtgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtacgccgtctcctcagccctccaccaggcccatccgtcttccccctggccaccctcctaccaacgacgcaccctcgtggggcacgacgcggcccgtgggcctcggcccgttcggtccaagggaccttaccgttcctacttaaccgatccgcgttggacggccgggctcgggaccaaacgggccgacgatgnc

SEQ ID NO: 28524 - DNA, 522 bp, Homo sapiens
  misc_feature: GYAE6OF02IH26L.52.53.E09.1.454.CMB.1.raw
  modified_base (388)..(388): a, c, t, g, unknown or other
  misc_feature (388)..(388): n is a, c, g, or t
  modified_base (521)..(521): a, c, t, g, unknown or other
  misc_feature (521)..(521): n is a, c, g, or t
tcagcgcagtacgacacgaccggtgctcgatttagagagagtgtgttgggtttgggggaggcttggtaaagcggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaagcaattccaagacacgctgtatttacaaatgaacagcctgagagccgaggacacggccgtatattactgtgtgaagatctccacgtctcgccccttggactggttattcgactctgggccagggaaccctagtacgcgtctcncagcctccacaggcccatcggtctcccctgcaccctcctccagacgcactcgtcggggcacgacgcggccctgggctcgcctggtcaaggactactcctatacgatcgctgagcggctggcaggccgcatagnc

SEQ ID NO: 28525 - DNA, 538 bp, Homo sapiens
  misc_feature: GYAE6OF02H6F9V.52.53.E09.1.454.CMB.1.raw
  modified_base (293)..(293): a, c, t, g, unknown or other
  misc_feature (293)..(293): n is a, c, g, or t
  modified_base (475)..(475): a, c, t, g, unknown or other
  misc_feature (475)..(475): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctcgtctcccagcctgtgctgactcaatcgccctctgcctctgcctccctgggagcctcggtcaagctcacctgcactctgagcagtgggcactacacctacgccatcgcatggcatcagctgcagccagagaagggccctggtacttgatgaggctcaacngtgatggcagccacgagcgagggggacgtatcccgtgatcgcttctcgagtctcggctcgtgggactggacgcgctacctcacctatccgtcacgccctccagttctggaaggacgtagggtacacttagttaccgtgtacgaaggtacggtacgggacacggtggacttaggttttggggngttcgggcggtaacggactaaggttcgaccgtcgtaggtccacggacccgtaggccctcccgg

SEQ ID NO: 28526 - DNA, 516 bp, Homo sapiens
  misc_feature: GYAE6OF02F5NCN.52.53.E09.1.454.CMB.1.raw
  modified_base (307)..(307): a, c, t, g, unknown or other
  misc_feature (307)..(307): n is a, c, g, or t
  modified_base (338)..(338): a, c, t, g, unknown or other
  misc_feature (338)..(338): n is a, c, g, or t
  modified_base (410)..(410): a, c, t, g, unknown or other
  misc_feature (410)..(410): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccanagcgagggggacgtatcccgtgatcgcttcncgaggcctccggctcgtgggactgagcgctacctcaccatcctccagccctccagtctggaggacgagggtnactattactgtcagacgtgggaccacgtggctagtttgggtgttcgggcggtaggacctaaggttcgacccgttcgtacggtccacggcccgtaaggcctacccgg

SEQ ID NO: 28527 - DNA, 543 bp, Homo sapiens
  misc_feature: GYAE6OF02JGL67.52.53.E09.1.454.CMB.1.raw
  modified_base (542)..(543): a, c, t, g, unknown or other
  misc_feature (542)..(543): n is a, c, g, or t
tcagcgcagtacgacacgaccggtgctcgatttagagagagtgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctgggccagggaccctagtagccgtctcctcagcctccaccaaggcccatcggtcttccccctggccaccctcctcccaacgacgcacctctcgggggcacgacgcggccctgggcctcgcctggtcaaggactacttcctatacgatcgctgagcgggctggcaaggcgcatagnn

SEQ ID NO: 28528 - DNA, 525 bp, Homo sapiens
  misc_feature: GYAE6OF02HWLS0.52.53.E09.1.454.CMB.1.raw
  modified_base (185)..(185): a, c, t, g, unknown or other
  misc_feature (185)..(185): n is a, c, g, or t
  modified_base (345)..(345): a, c, t, g, unknown or other
  misc_feature (345)..(345): n is a, c, g, or t
  modified_base (387)..(387): a, c, t, g, unknown or other
  misc_feature (387)..(387): n is a, c, g, or t
  modified_base (406)..(406): a, c, t, g, unknown or other
  misc_feature (406)..(406): n is a, c, g, or t
  modified_base (421)..(421): a, c, t, g, unknown or other
  misc_feature (421)..(421): n is a, c, g, or t
  modified_base (453)..(453): a, c, t, g, unknown or other
  misc_feature (453)..(453): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggancctcggtcaagctcacctgcactctgagcagtgggcactacacctacgccatcgcatggcatcagctgcagccagagaagggccctggtacttgatggaggctcaacagtgagtggcagccaacgagcggagggggacgtactcccgtgactcgtcttcncgaggtctccggctcgtgggactggacgtcgctacctcaccntcctccacgccctcagtcnggacggacgagggtnacttattacgtgtacagacgtggacacgtggntgtttgggtcgttacgggcggtagggacctaggttcgaccgttcgtacggtccacggaccgacggctcccgg

SEQ ID NO: 28529 - DNA, 629 bp, Homo sapiens
  misc_feature: GYAE6OF02JBDSU.52.53.E09.1.454.CMB.1.raw
tcagcgcagtacgacacgaccggtgctcgatttagagagagtgtgttgggtttgggggaggcttggtaaagcggggggtagtctgagactctcctgttcagtctctggattcaccttaaataactatggcatgagctgggtccgccaggctccagggaaggggctggagtgggtctcattttatcagtggtactggtggtagcacatactacgcagactccgtgaagggccggttcaccatctccaaaagcaattccaagaacacgctgtatttacaaatgaacagcctagagagccgaggacacggccgtatattactgtgtagaaagatctccaacgtctcgccccttggactggttacttcgactcctggggccacgggaaccctagtagccgtctacctcacgcctaccaccgaacgggccctagtccgggtcctttccccccgtggacccgtacccttacccgtacccaaacgaaccggctaaccccgttcggtccggggccaaccacggccgggcccctgggggcctggcccgttacggtccgaaggtaccttaccgttaccctagttacccgagtccggcttcggacgtcgggactggaccgaaggccgataacgtgacgtg

SEQ ID NO: 28530 - DNA, 605 bp, Homo sapiens
  misc_feature: GYAE6OF02FZ2SW.52.53.E09.1.454.CMB.1.raw
tcagcgcagtacgacacgaccggtgctcgatttagagagagtgtgttgggtttggggagagctctggggagtctgcaccatggcttggaccccactcctcttcctcaccctcctccactgcacagggtctctctcccagcctgtgctgactcaatccgccctctcgcctctgcctccctgggacgcctcggtcaagctcacctgcactctgagcagtggcactacacctacgccatcgcatggcatcagctgcagccagagaagggccctcggtacttgatgaggctacaacagtgatggcagccacgagcggagggggacgtatcccgtgactcgtcttctcgacggcctccggctcggtcgggacgtggcgcgcctaccctcaccctatcctaccacgtccctcctagtctggaacgggacggagggtcgtaacttacgttacgtgtaccgtaacggtacggtagggacctacggtacggtaccgttaggtttcgggttacgggtttcgggaccgggtaacggggtaacctaaagggtttccggaaccggttccgtaaggtccgaaccggacccggtaacggtccgttcccggtaccccccgg

SEQ ID NO: 28531 - DNA, 510 bp, Homo sapiens
  misc_feature: GYAE6OF02FT2DK.52.53.E09.1.454.CMB.1.raw
  modified_base (441)..(441): a, c, t, g, unknown or other
  misc_feature (441)..(441): n is a, c, g, or t
  modified_base (457)..(457): a, c, t, g, unknown or other
  misc_feature (457)..(457): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaacgggccctcggtacttgatgaggctcaacagtgatggcagccacgagcgagggggacgtatccctgactcgcttctcgaggctccggctcgtgggactggagccgctacctcaccatcctccagccctccgagtctggacggacgagggtcacttattactgtacaggacgtggacncgtggctagtttgggngttcgggcggaggacctagttcgaccgtcgtaggtcacggcccaggcctccgg

SEQ ID NO: 28532 - DNA, 563 bp, Homo sapiens
  misc_feature: GYAE6OF02H3LR3.52.53.E09.1.454.CMB.1.raw
tcagcgcagtacgacacgaccggtgctcgatttagagagagtgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggcgtatattactgtgtgaaagatctccacgtctccgcccccttgactggttattcgactccgtgggccacgggaaccctagtacgccgtctcctcacgcctccaccgaacgggcccagtccgtcctccccgtgccaccctcctccaagacgcctaccgtcgtcggggcacgcgccggccctgggctcgcctggtacaggtactactctatacgactcgctggacgccgggtctcggacgacggtccgactagtgatcg

SEQ ID NO: 28533 - DNA, 685 bp, Homo sapiens
  misc_feature: GYAE6OF02JUCKR.52.53.E09.1.454.CMB.1.raw
  modified_base (185)..(185): a, c, t, g, unknown or other
  misc_feature (185)..(185): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggancctcggtcaagctcacctgcactctgagcaggtggcactacacctacgccatcgcatggcatcagctgcagccaggagaacgggccctacggtacttggactggaggctacgaactaggtgatggacacgccacgaggcgagggggtacgtactcccgtagactcgtcgttcgtacgacggtccgtccggtcgtccgtacggggtacctgtaccgggtaccgtccgttaaccccgttccgaacccgttaacttcccgtacccgtaacggtccccgttaccgaacggtttccgttacgggaacccgggaacgggtacggggttacgtaaccttaacgttaccggttacgttacgacgggtaccggttacggggaaccctagttcgggtaccgttaggttttcggggtacggttccggggcgggtaacgggtaccgttaagggttccgtaaccgggttccgttacgggaccgaaccggtcccgtaacggcccgttaccccgg

SEQ ID NO: 28534 - DNA, 536 bp, Homo sapiens
  misc_feature: GYAE6OF02G9JJL.52.53.E09.1.454.CMB.1.raw
  modified_base (536)..(536): a, c, t, g, unknown or other
  misc_feature (536)..(536): n is a, c, g, or t
tcagcgcagtacgacacgaccggtgctcgatttagagagagtgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaaggcccatcggtcttccccctggcaccctcctccaagacgcacctctggggcacagcggccctgggctgcctggtcaaggactacttcctatacgatcgctgagcgggctggcaggccgcatagn

SEQ ID NO: 28535 - DNA, 620 bp, Homo sapiens
  misc_feature: GYAE6OF02HFYPK.52.53.E09.1.454.CMB.1.raw
  modified_base (187)..(187): a, c, t, g, unknown or other
  misc_feature (187)..(187): n is a, c, g, or t
  modified_base (428)..(428): a, c, t, g, unknown or other
  misc_feature (428)..(428): n is a, c, g, or t
  modified_base (617)..(617): a, c, t, g, unknown or other
  misc_feature (617)..(617): n is a, c, g, or t
tcagcgcagtacgacacgaccggtgctcgatttagagagagtgtgttgggtttgggggaggcttggtaaagcggggggggtatctgagactctcctgttcagtctctggattcaccttaaataactatggcatgagctggggtccgccaggctccaggggaaggggctgggagtgggtctcatttancagtggtactggtggtagcacatactacgcagactccgtgaagggccggttcaccatcctaccaaaagaccaattccaagaacacgcttgtatttaacaaatgaacagcctgagagccgaggacacggccgtatattactgtgtagaaagatctccacgtctccgccccttggacttggtttactttcgaccttccggtcggggaccacgggtaaccctaggtacgtccgtctcctcgacncctcccacgacggccacgtcgtccctccctcggccaccctcctccaagcgcctaccgtcgtcggggcacgacggccggcccggtcgggtcctcggccgtcggtacgaacgggtaaccttaccttcctactacggtactccggcgttaggacggtccgggcgtacggcggaacggtccgacgaattacgnacg

SEQ ID NO: 28536 - DNA, 556 bp, Homo sapiens
  misc_feature: GYAE6OF02GENR9.52.53.E09.1.454.CMB.1.raw
  modified_base (554)..(554): a, c, t, g, unknown or other
  misc_feature (554)..(554): n is a, c, g, or t
tcagcgcagtacgacacgaccggtgctcgatttagagagagtgtgttgggtttgggggaggcttggtaaagcgggggggtatctgagactctcctgttcagtctctggattcaccttaaataactatggcatgagctgggtccgccaggctccagggaagggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactccgtgggccagggaaccctagtagccgtctcctcagccctccaccaacgggcccatcggtccttccccctcggccaccctcctcccaagacgccaccctcgtcgggggcacacgcgcccgtgggcctgcctggtccgaaggctacttccctcgtactgcgctgacggcgggctggacgaggcgcactagncg

SEQ ID NO: 28537 - DNA, 523 bp, Homo sapiens
  misc_feature: GYAE6OF02F1AEW.52.53.E09.1.454.CMB.1.raw
  modified_base (307)..(307): a, c, t, g, unknown or other
  misc_feature (307)..(307): n is a, c, g, or t
  modified_base (338)..(338): a, c, t, g, unknown or other
  misc_feature (338)..(338): n is a, c, g, or t
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaacgggccctggtacttgatgaggctcaacagtgatggcagccanaggcgagggggacgtatccctgatcgcttcncgaggctccggctcgtgggactggagcgctacctcaccatcnccagccctccagtcnggacggacggaggtgacttactactgtacgaggacgtgggacacgtggacctagtttgggtcgtcgggcgggtaaggtaccgtaaggttcggacccgtctacgggtcacggcccgaggccgtccccgg

SEQ ID NO: 28538 - DNA, 583 bp, Homo sapiens
  misc_feature: GYAE6OF02ID88X.52.53.E09.1.454.CMB.1.raw
  modified_base (344)..(344): a, c, t, g, unknown or other
  misc_feature (344)..(344): n is a, c, g, or t
  modified_base (575)..(575): a, c, t, g, unknown or other
  misc_feature (575)..(575): n is a, c, g, or t
  modified_base (582)..(583): a, c, t, g, unknown or other
  misc_feature (582)..(583): n is a, c, g, or t
tcagcgcagtacgacacgaccggtgctcgatttagagagagtgtgttgggtttgggggaggcttggtaaagcggggggggtatctgagactctcctgttcagtctctggattcaccttaaataactatggcatgagctgggtccgccaggctccaggggaaggggctggagtgggtctcattttatcagtggtactggtggtagcacatactacgcagactccgtgaagggccgttcaccatctaccaaaagacaaattccaaagaacacgctgttatttaacaaatgaacagctgagagccgagacacggcgtatattactgtgtgaaagatctccacgttcnccgtcccccttggacttggttactttcgactccgtgggccacgggaaccctagtacgccgtctcctcacgcctcccaaccgaacgggcccacgtccggtccttccccctggccaccctccctaccaagacgccacccgtcgtcggggcacgacggccggcccgtgggctcgccgtcggtcaaggctaccttactactacgactcgctggacggcggctggcgacggccgtnagtacgnn

SEQ ID NO: 28539 - DNA, 617 bp, Homo sapiens
  misc_feature: GYAE6OF02F3T7M.52.53.E09.1.454.CMB.1.raw
  modified_base (343)..(343): a, c, t, g, unknown or other
  misc_feature (343)..(343): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaacgggccctcggtacttgatgaggctcaacagtgatggcagccacgaggcgagggggacgtactcccgtgactcgcttcncgacggctccggctcgtgggactgagccgctacctcaccactcctaccacgccctaccgagtcgtaggacggacggtagggtacgtaacgttaacgttacgttcgtaccgaagggtaccggttaggggaacctacggttcgggtaccttaagggttttcggggtcggtttccggggacggggtaacggggtaacccgtaagggtttaccgtaacccgggttccgtaacggggttacccaaccgggtaccccgtaacggggtccctacccccggg

SEQ ID NO: 28540 - DNA, 590 bp, Homo sapiens
  misc_feature: GYAE6OF02GIFDG.52.53.E09.1.454.CMB.1.raw
  modified_base (308)..(308): a, c, t, g, unknown or other
  misc_feature (308)..(308): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgccctccctgggagcctcggtcaagctcacctgccactctgagcagtgggcactacacctacgccatcgcatggcatcagctgcacgccagagaacgggccctcggtactgagtgaggctacaacagtgagtggcngaccacaggcggagggggacgtactcccgtagactcgtcttcgcgacggctccggctcgacggctgacgcgcctactcaccactctccacgccctacgagtcgtgacggacggtaggtcgtaacttagttacgtcgtacgtaggtaccggtaggacctacggtcggtcgtacgggttttgggtcggttacggggacgggtaaccgggtaaccgtaaggttaccggtaccgttccggttaacggttaccgtaccggtaccccggaagggtcccgtaccccggg

SEQ ID NO: 28541 - DNA, 599 bp, Homo sapiens
  misc_feature: GYAE6OF02F8Y4S.52.53.E09.1.454.CMB.1.raw
  modified_base (355)..(355): a, c, t, g, unknown or other
  misc_feature (355)..(355): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctcgcctccctgggagcctcggtcaagctcacctgcactctgagcagtgggcactacacctacgccatcgcatggcatcagctgcacgccagaggaacggccctcggtacgtgatggaggctacaacgagtcgagtcggcacgccaacgaggacggacgggggacgtactccgtgactcgcttcncgacggcgtccggtctcgtggcgtgacgccgtcctaccctacaccctactcctaccgacgtccctaccgacgttccgtaggacgggtacggtagggtacgtaacgttagttacgttcgtacgaacggtaacgggtacggactacggtcgggtacgttaggtttggggtcggttcgggacgggacggtaccggtaacgttcggtaccggtcgtacggtccgacggtacccgtaggtccgtcccgg

SEQ ID NO: 28542 - DNA, 570 bp, Homo sapiens
  misc_feature: GYAE6OF02GWSXX.52.53.E09.1.454.CMB.1.raw
  modified_base (568)..(569): a, c, t, g, unknown or other
  misc_feature (568)..(569): n is a, c, g, or t
tcagcgcagtacgacacgaccggtgctcgatttagagagagtgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatccggtccttccccctggccaccctcctcccaacgcgccaccctcgtgggggccaccgacgccggccccgtgggccgtgcccgtggtccaacgggtacctacgttcctataccgactcgctgacggcgggctcggcaaggccgcagtagnng

SEQ ID NO: 28543 - DNA, 539 bp, Homo sapiens
  misc_feature: GYAE6OF02F38ZP.52.53.E09.1.454.CMB.1.raw
  modified_base (455)..(455): a, c, t, g, unknown or other
  misc_feature (455)..(455): n is a, c, g, or t
  modified_base (461)..(461): a, c, t, g, unknown or other
  misc_feature (461)..(461): n is a, c, g, or t
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
  modified_base (490)..(490): a, c, t, g, unknown or other
  misc_feature (490)..(490): n is a, c, g, or t
  modified_base (533)..(533): a, c, t, g, unknown or other
  misc_feature (533)..(533): n is a, c, g, or t
  modified_base (538)..(539): a, c, t, g, unknown or other
  misc_feature (538)..(539): n is a, c, g, or t
tcagcgcagtacgacacgaccggtgctcgatttagagagagtgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaaagacaattccaaagaacacgctgtatttacaaatgaacagcctgagagccgaggaccacggccgtatattactgtgtagaaagatctccacgtctccgcccccttggactggttatttcgactccgtggggccacgggaaccctagtacgccgtctcctcacgccctccaccgaaggccccatccggtcctcccctggccaccctccnccagcncacctcgnggggcacgngccgccgtggcngctgtcagctctctatacgatcgctgaggcggctggcaggcanatagnn

SEQ ID NO: 28544 - DNA, 684 bp, Homo sapiens
  misc_feature: GYAE6OF02FO097.52.53.E09.1.454.CMB.1.raw
  modified_base (258)..(258): a, c, t, g, unknown or other
  misc_feature (258)..(258): n is a, c, g, or t
  modified_base (321)..(321): a, c, t, g, unknown or other
  misc_feature (321)..(321): n is a, c, g, or t
tcagcgcagtacgacacgaccggtgctcgatttagagagagtgtgttggggtttggggggaggcgttggtaaacgcgggggggtatctggagactctccttgttcagtctctggattcaccttaaataactatggcatgagctggggtccgtcaggctccgagggaagggggtcctgggaggtgggtcttacgtatttactctagtggtacgtgggtggtagcacgatactacgcagacgtccgtgaagggcccgttnacctagtcctaccgaaagacaacttcccaagaaccacgctgtattacaatgaacagcctgagngccgaggacacggccgtactctactgtgtaggaaaggctcgtccacgttctccgtccccgttaggtacttggttactttcggaccttccgtacggggccctaacgggaacccttaggtacgtcccgtctcccgtcgacgtccctccaccgacgggacccacgtccggttaccttcccccgtcgccctaccccgtcctcccgaacgtacgtacacccgtcgtacggggcacgacggccggtccgcgggccgtcgtaccgtcggtacgtaacggtaccttacgttacccgtagtaccgacgtccggtacgtacggtaccggtccgggtcgtacggtccgtacgggtacgtacgtacgtagcgtcg

SEQ ID NO: 28545 - DNA, 667 bp, Homo sapiens
  misc_feature: GYAE6OF02FKJ8I.52.53.E09.1.454.CMB.1.raw
  modified_base (345)..(345): a, c, t, g, unknown or other
  misc_feature (345)..(345): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaacgggccctcggtacttgatgaggctacaacgagtgatggcagccacagacggagggggacgtacgtccgtgatcgctttcncgagccgtccggcttcgtgggtactggacgccgtcctaccctccgacctaacgttcctacccgacgtcccgtacctagttccgtagggaacgggaaccggtaggggtacgtaaactttaacgttacgtcgtaaccgaggtaacccgggttagggaacctacgtcggggtaccttaggggtttttacggggtacgggtttccggggaaacggggtaaccgggggttaaccctaaacggggtttaccgtaaccccggtttaccggttaaccggggttacccgaaccgggtaaccccccggtaaggggttcccccttcccccggg

SEQ ID NO: 28546 - DNA, 613 bp, Homo sapiens
  misc_feature: GYAE6OF02JHKHY.52.53.E09.1.454.CMB.1.raw
  modified_base (611)..(611): a, c, t, g, unknown or other
  misc_feature (611)..(611): n is a, c, g, or t
tcagcgcagtacgacacgaccggtgctcgatttagagagagtgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattccaagaacacgctgtatttacaaatgaacagcctgagagccgaggacacggcgtatattactgtgtagaaagatctccacgtctccgccccttggacttgttactttcgactccgtgggccagggaaccctagtacgcccgtctccctcacgcctacccaccgaacggacccacgttccgttcccttcccccgtcggcctaccccttccctacccgtaacgcgtacctacccgtcggtcggggacaccgaccggccggcccgtcgggcctcgtaccgttcggtacgaacggtaccttaccttacctacgtacgacgtcgtcgtacggcggcggcgtcggacgacggcgcacgtagntc

SEQ ID NO: 28547 - DNA, 660 bp, Homo sapiens
  misc_feature: GYAE6OF02IY9JD.52.53.E09.1.454.CMB.1.raw
tcagcgcagtacgacacgaccggtgctcgatttagagagagtgtgttgggtttgggggaggcttggtaaagcggggggggtatctgagactctcctgttcagtctctggattcaccttaaataactatggcatgagctggggtccgccaggctccagggaaggggctggagtgggtctcatttatcagtggtactggtggtagcacatactacgcagactccgtgaagggccgttcaccatctccaaaagcaaattccaagaacacgctgtaatttacaaatgaacagcctagagagccgaggacacggaccgtatattactgtgtagaaagatctccacgtcctccgcccccttggactggttactttcgactccgtggggtccaacgggaacccgtagtacgcccgtctccctcacgtcctacccacccaacggggcccctaagtccggttccctttccccctcgggccctacccccttcccgttacccaaacgtaccggaccctaacccgttccggtccgggggaccaccgaaccggtccgggccccgttcggggcctccggtcccgtcggttacgaacgggaacttacccgttacctaacgttaccgactcggtctaggacggacgggcgtacggacgaacggtccgcgaatgatg

SEQ ID NO: 28548 - DNA, 637 bp, Homo sapiens
  misc_feature: GYAE6OF02FWK7Z.52.53.E09.1.454.CMB.1.raw
tcagcgcagtacgacacgaccggtgctcgatttagagagagtgtgttgggtttggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaaagcaattccaagaacacgctgtatttacaaatgaacagcctgagagccgaggacacggccgtatattactgtgtgaagatctccacgtctcgccccttggactggttatttcgactccgtggggccacgggaccctagtacgccgtctcctcgagcctccaccgaacgggcccacgtcgtccttcccctggccaccctccctccaacgtacgaccaccgtcgtcgggggcctaaccgacggaccggcccgtacggggccttcggcccgttacgggttccgaaacgggtacccttaaccgttacccttaacgttaccgtacgtaccggtcgttacggaacggtcccgggtaccgttcgggaccgtaacggggccgtacgtacggttagagcg

SEQ ID NO: 28549 - DNA, 608 bp, Homo sapiens
  misc_feature: GYAE6OF02F62QT.52.53.E09.1.454.CMB.1.raw
  modified_base (264)..(264): a, c, t, g, unknown or other
  misc_feature (264)..(264): n is a, c, g, or t
tcagcgcagtacgacacgaccggtgctcgatttagagagagtgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactgggtggtagcacatactacgcagactccgtgaagggccggttcaccatctccaaagcaattccaagaacncgctgtattacaaatgaacagcctgagagccgaggacacggccgtatattactgtgtagaagatctcacgtctcgccccttggactggttattcgactccgtgggccagggaccctagtacgccgtctcctcgacgcctcccaccgaacgggcccagtccggtcttcccccgtggccacccctcctaccgaagcgcacctcgtcggggcaccgaggccgcccgtgggcctcggcccgttagggtccgaaacgggtaccttaaccttcccttaagtaccgtactccggtctacggacggccggggtacgtcgggaccgaacggggcccgacgtaagttagacgcg

SEQ ID NO: 28550 - DNA, 675 bp, Homo sapiens
  misc_feature: GYAE6OF02H101K.52.53.E09.1.454.CMB.1.raw
  modified_base (213)..(213): a, c, t, g, unknown or other
  misc_feature (213)..(213): n is a, c, g, or t
  modified_base (292)..(292): a, c, t, g, unknown or other
  misc_feature (292)..(292): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggacgcctcggtcaagctcactgcactctgancagtggcactacacctacgccatcgcatggcatcagctgcagccagacgaacggccctcggtacttgatgaggctacanacgtgatggcagccacgagcggaggggacgtcgtcctagactccgtcgttactcgacggtcctccggctcggtacgggtacttggacgtccgtacccgttacctccgaacctacgtcccacccgtacgtccccgttacctaacggttccgtagggaaccgggtacggtacgggtaccttaacgttaacgtttaccgtaggttacccgtaacggtaccggggttaaccggacctaaacgggtcggttaacgttttacgggttttcgggggttacggttcccgggggacgggtaaccggggtaaccttaagggttcccgaaccccgggttttccggttaacgggtaccgttacccgggaacccgttacgggtcccttcccccggg

SEQ ID NO: 28551 - DNA, 805 bp, Homo sapiens
  misc_feature: GYAE6OF02H6E2R.52.53.E09.1.454.CMB.1.raw
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgacctacaatccgccctctcgcctctcgccctcccgtagggacgccctcggtacaagctaccacctgacctactctagacgacgaggtgggaccaacttaaccaccgtacgccaagtccgactaagtcggactactacgacgtcctcgacgacgaccgaaggaacgggaccggtacccgttaggtaccttggaacgtggacggcctaaccgaacgtaggtacggagtacggacaccggaccaaggtacgggacggggtaccggggggtaaccttaccgtaccgtacgtacgttcctacgttacggcgtaacggtccgtccggtcgtacgggttacggacgtagtaaccggccggttaacctacccgtactaacccgtaccgttaccgtaccctacggttaccctacggtaccgtacgttaccggggaagggtaacgggtacgtacgtttaaacttaccggtttacggtacgtaaccgggttaacggacgggttaacgggtaccgtacggttacgggacgttttaacggggtttgggttacccgggttacgggggaccggttaaccggggtaacgtttaacggggttacccggtacccgttacggttaacgggacccgtaacccggtacccggtaccgtcccggttaccccccggg

SEQ ID NO: 28552 - DNA, 783 bp, Homo sapiens
  misc_feature: GYAE6OF02JY3KD.52.53.E09.1.454.CMB.1.raw
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
  modified_base (304)..(304): a, c, t, g, unknown or other
  misc_feature (304)..(304): n is a, c, g, or t
  modified_base (780)..(780): a, c, t, g, unknown or other
  misc_feature (780)..(780): n is a, c, g, or t
tcagcgcagtacgacacgaccggtgctcgatttagagagagtgtgttgggtttggggaggcttggtaaagcgggggggtatctgagactctcctgttcagtctcgtggattcaccttaaataactatggcatgacgcgtgggtccgcacggctccgaggggaaggggtctaggaggttgggtcctctatttttancgngttggtacgtggttggtacgcaacgactactacgcacgtactccggtagaacgggtccgttaccaaccatccgtaaccaaaaggactaaacttaccaaaggaaccncgtcctttagttactttaacaaaatacggaacaacgtccgtagacggacgacccggaaggaccgaccggtaccgtataagttacgttagtggtaaggaaaccgtatcccgtacctaacggttccctacccggttacccccggtttaggtaccgttacggtttacttcccgtacggtccggtcggggaaccctaaccgggtaacccttagggtaccctccgttccgtccctacgtaccgcccttaccgaccggtaacccggaccgtaccgtcccgttacccccgttcccggtaccgtaccctaaccccttcccgaacgaccgacccgtccacccgttcggccgggtacaccgtccggtccggcccggttgcccgtaccgtccgttggtaaccgacgttaccctaaccgttctaccgttaccgtgtccgtaaggtcgacggtcggacggtcgaaccggaggttccgaacgttcgacgngcg

SEQ ID NO: 28553 - DNA, 691 bp, Homo sapiens
  misc_feature: GYAE6OF02GVVMH.52.53.E09.1.454.CMB.1.raw
  modified_base (145)..(145): a, c, t, g, unknown or other
  misc_feature (145)..(145): n is a, c, g, or t
  modified_base (182)..(182): a, c, t, g, unknown or other
  misc_feature (182)..(182): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (265)..(265): a, c, t, g, unknown or other
  misc_feature (265)..(265): n is a, c, g, or t
  modified_base (295)..(295): a, c, t, g, unknown or other
  misc_feature (295)..(295): n is a, c, g, or t
  modified_base (671)..(671): a, c, t, g, unknown or other
  misc_feature (671)..(671): n is a, c, g, or t
  modified_base (687)..(687): a, c, t, g, unknown or other
  misc_feature (687)..(687): n is a, c, g, or t
tcagcgcagtacgacacgaccggtgctcgatttagagagagtgtgttgggtttgggggaggcttggtaaagcggggggggtatctgagactctcctgttcagtctctggattcaccttaaataactatggcatgagctgggtccncaggctccgagggagggctggagtgggtctcatttancagtggtactgggtggtacncanactactacgcagactccgtggaacgggtccgttcacatccacaaagctaattacaagacncgcttagtattacaatcgaacacgctgagngccgagcacggctatatacgtgtgtagaacgctcctactacgtcgtccgtccccgtaggtacttgttacttccgtacgtccggtggggtaccgtaacgggtaaccgttacggtacggtcccgttcgtacccgtacgaccgtccctaccggtaaccgacgggtaccccgtaggttcccggttaccccttccccgtggtacccctacccgtcccgtaaccggaacgaaccgtcccgtaacggtccgggtaccggggtaccacggtaaccggcccgggttaccggtcgggtactaccgccggttacggtacgtaacggtcctttaaacgtcctaaggtaccgtcgtacgtcggtagtccgggcgtacggcgtacccggnggtaccacgtacgtgntacg

SEQ ID NO: 28554 - DNA, 664 bp, Homo sapiens
  misc_feature: GYAE6OF02FJ5HN.52.53.E09.1.454.CMB.1.raw
  modified_base (238)..(238): a, c, t, g, unknown or other
  misc_feature (238)..(238): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatccgccctctgcctctcgcccttcccgtgggacgcccgtcggtcaagtcctcacctgcactctgagcaggtcggcactacnccgtacgcctatcgcagtcggacactcacgctgccacgccaggacggaacggtcctcggtacttgagtgacgtctacgaacagtgagtggacacgcctaacgaggacggacgggggtacgtacgtccgtagtacgtcgtcttacgtcggacggtccgtccggtcgtaccgtcgggtacgtaggacgtccgtacctacccgtccaaccgtactcccgtaacccgcgtccctaccgtcgtaccgagggaaccggacggtacgggtactaacgtaccgttacgttcggacgtaacggtacggtacggactacggtccgtacgttacggtttcggggtacgttaccggggcggtaacgggtaaccgtacgggttaccgtacccggttacgtacggtccgtaaccggtaccgtaacggtccgttaccccgg

SEQ ID NO: 28555 - DNA, 789 bp, Homo sapiens
  misc_feature: GYAE6OF02HNKSO.52.53.E09.1.454.CMB.1.raw
  modified_base (190)..(190): a, c, t, g, unknown or other
  misc_feature (190)..(190): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctccagcctgtgctgactcaatccgccctctgccctctcgccctcccgtgggacncccgtcggtacaacgcctacacctgacctactctgagcaggtcggcactaccacctacgcctancncagtcggcactcagctcgcacgacgaaggacgaccgggtccctacggttacgtaggtaagtcggaacggaccgtacgtaacgtacggtagtaacgtccgggacgaccgtacccgacggtaacgggtacggggtaacggggggtaaccttacccgttacccggtaggttaaccggttccgttaccgttcccgtaacggtcccgggttcccgttacccgggtccgtttacgggtaccgggtaccgtacggtaccggtaaccggttaccctacccgttacccgaaacccttaccgttaccctccgtacccgtacccgtacccgtacggtttaccgaggtaacgggtacggttacggtaccgttacttaaccgtttacgtcgtaaccgagggtacgttacgggaccgtacggcggttacgttacgggtttcgggttccgggtacgggtaccgggtaacgggttaaccgtacggttacccgggtaccgttacggtacggtaccggaaccgtacccggtaccggtcccgtaacccccgg

SEQ ID NO: 28556 - DNA, 659 bp, Homo sapiens
  misc_feature: GYAE6OF02FM8EC.52.53.E09.1.454.CMB.1.raw
  modified_base (189)..(189): a, c, t, g, unknown or other
  misc_feature (189)..(189): n is a, c, g, or t
  modified_base (253)..(253): a, c, t, g, unknown or other
  misc_feature (253)..(253): n is a, c, g, or t
  modified_base (297)..(297): a, c, t, g, unknown or other
  misc_feature (297)..(297): n is a, c, g, or t
  modified_base (337)..(337): a, c, t, g, unknown or other
  misc_feature (337)..(337): n is a, c, g, or t
tcagcgcagtacgacacgaccggtgctcgatttagagagagtgtgttgggtttgggggagagctctggggagtctgcaccatgggcttggaccccactccctcttcctcaccctcctcctccactgcacagggtctctctcccagcctgtgctgactcaatcgccctctgcctctgcctccctgggacncctcggtcaagctcacctgcactctgagcagtggcactacacctacgccatcgcatggcatcanctgcagcagagaacgggccctcggtactgctgacggctacaacnggtgagtggcacgccgacagcggagggggacgtctcccgngtatctccttcgtcgaccgtccgtacccggcgttcgggtacgggtactcggaacggtcccgtaccgtacccctcgtaacccgtaactcccggtacccacccggtccccgtaccggtacggtccgtaagggtaaccggggacgtacggggtaaccttacgtttaacgttaccggtcgtacgaaggtccgggtagtaccgtaccggtggtaccgttagggtttcgggtcgggttaccgggtacgggaacgggttaacgaacgggtttaccgaccggttacccggtaggtacccggacggtaccgtaccggtaccggtcccccgg

SEQ ID NO: 28557 - DNA, 672 bp, Homo sapiens
  misc_feature: GYAE6OF02HBEGQ.52.53.E09.1.454.CMB.1.raw
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctcccgtgggagcctcggtcaagctcacctgcactctgagcaggtggcactacacctacgccatcgcatggcatcagctgcagccagagaacgggccctcggtacttgatggacggctacaacaggtgagtggacagaccacgaggacggacggggggtaaccgtactcccgtaggtacgtccgtaccgtttccgtcgtaacgggtccgttacccgggccttacgggtacggggtacctgggaacggtcccgtacccgttaccctaccgaccctacgtcccttacccgacgtccccgtacctacggttccgtagggaacgggtacggtacgggttcgaacgttacgttacgtcggtacgaggtaccgggtacgggtaaccgacgtggtacgttaggtttcgggtcgggttaccgggacgggtacggtaaccggtaagttccgggtaaccgtcccggttaacgggtccgacggtacccgtacggtcccgttaccccggg

SEQ ID NO: 28558 - DNA, 605 bp, Homo sapiens
  misc_feature: GYAE6OF02G9N00.52.53.E09.1.454.CMB.1.raw
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
  modified_base (601)..(601): a, c, t, g, unknown or other
  misc_feature (601)..(601): n is a, c, g, or t
tcagcgcagtacgacacgaccggtgctcgatttagagagagtgtgttgggtttgggggaggcttggtaaagcggggggggtatctgagactctcctgttcagtctctggattcaccttaaataactatggcatgagctgggtccgccaggctccgagggaagggctggagtggtctcatttatcagtggtactggtggtagnacatactacgcagactccgtaggaacgggtccgttcaccatctaccaaaagactaattccaaagaacacgcttagttaatttaacaaatgaacanactgagagccgagacgacggaccgtaatattacgtgtacgtagaaagactcctccgacgtccgtcccgtacccccttggacgttggttactttcgacctccgtgggacccgacgggaacccctagtacgaccgtctcctcacgccctaccacgaacggcccatccgtcctccctgccaccctcaccagcgaccacctggcgggcacgcgccgcccgtggccgtcgtccgtcggtaaccaaggtaccttaccgtaccgtagaccgtacgtcgtctggcgcggcgtagacgacggcacgtactagntacg

SEQ ID NO: 28559 - DNA, 676 bp, Homo sapiens
  misc_feature: GYAE6OF02GBYGD.52.53.E09.1.454.CMB.1.raw
  modified_base (363)..(363): a, c, t, g, unknown or other
  misc_feature (363)..(363): n is a, c, g, or t
  modified_base (420)..(420): a, c, t, g, unknown or other
  misc_feature (420)..(420): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacaggtctctctcccagcctgtgctgacctcaatcgccctctcgcctctcgccctacccgtgggctccgtcgtacaagtcctacaccgtcgctactctgacgcagtcggcactacaccgtacgccatcgctatggctaacgtcacgtctcgaccgacgcccgaaggacggaaccggtcccgtacggttaacttgaacgtgggacggactacgaaacgtggtacgacgtacggaccgacnccgaacgacgggaccgggacggggtacgtacctccgtacgtacgttcgtccgttacncggtaccgtcgttacccggtcgtccggtaagggtcacgggtacgaccggtcctaaccgtacctactaccgtccctaccgtacgtcccttgccgtacgtacgggacggacggtacggtctaacttacgtacgtcgaccgagtcggacgtacgcgttacggtcgttagggttcgggttgtaccggggtcggtaaccggtcgttaaccggttacgacccgttacggacgtccggacgtccggtacggtccgtcccccgg

SEQ ID NO: 28560 - DNA, 854 bp, Homo sapiens
  misc_feature: GYAE6OF02F3B5M.52.53.E09.1.454.CMB.1.raw
tcagcgcagtacgacacgaccggtgctcgatttagagagagtgtgttgggtttggggagagctctggggagtctgcaccatggcttggaccccactcctcttcctcaccctcctcctccactgcacagggtctctcctccagcctgtcgctgactcaactccgccttcgtcgtcctcgtctccgtccggtcggacgtccgttcggtacaacgtcctacaccgtcgtactaccgtcgtacgacgcgagggtcggaacctacctaaccgtaccgtacgtacctacgtccgacgtcggtacgtacacgtcgtacgtcgtcgacgaacgaccgaacggggtaacgggtacccggttacccggttacggttaacgttacgggtacggtaccgggtaaccggtaaccgtaacgtaaacgggtacggtagggtaacggtacggaaccgaaccgaacccggtaacggacggggaacggggggtaaccggggttaacgtaccggttaccggtacgtaccgttaccgtacgttaccggtaccggtccggtccggtaccgggttacgtacgggtacgggtacgtacggtaccggtacctaccgtacccgtaccgtacccgtacgtaccgtaccgtacccgtccggtaccggtacggtacggaacgggtacgggtacgggtacggtacgttacgttacgtacgtacggtacgtaacgggtacgggtacgtacgtacggttacgttacggtttacgggttacggtacgggtcgggtaacgggttaacggtaccggttaccggttaccggttaccggttaccggtacggtaacccggtccggtacccggtaccggttaccgtacccgg

SEQ ID NO: 28561 - DNA, 835 bp, Homo sapiens
  misc_feature: GYAE6OF02HMYKG.52.53.E09.1.454.CMB.1.raw
  modified_base (835)..(835): a, c, t, g, unknown or other
  misc_feature (835)..(835): n is a, c, g, or t
tcagcgcagtacgacacgaccggtgctcgatttagagagagtgtgttgggtttgggggaggcttggtaaagcgggggggggtatctgagactctcctgttcagtctctggattcaccttaaataactatggcatgagctgggtccgccaggctccgaggggaaggggctgggaggtgggtctcgattttatactgtggtactgggtaggtagacactattaccgtacgcaagccgttccggtagggaacgggtccggttaccacctatacctaccaaaagacctaattaccaaagaaccacggccttagttaactttaaactaaattacgaaaccagccgtagacgaacgccggaaggaccgacgggtaccgtaattacgtttacgttggtagtaacgtaaaagtactccgtcctaccgttcctcccgtccccgttcgtacgttgttaacgtttccgacgtccggttccggggaccggtaaccggtaacccgttaggtaccgtccgttccttacctcgaccgtccctacccgaacggtaccgggacccgtcgttcccggttaccccttccccgaccggtcccgtacccctacccgtacccgaacgaccggtaccctacccgtacggggtccgggccgtaaccggccggacccgggtccgggtcccgggtccggtcccggtaccgggttaaccggttaaccggtaaaccggttaccgtttaacccgtttaccgttaaccgtacccgggttacctttacccgggcggttacgggaaccgggcccgggggtagtacccgggtacgggaaccgggtccgaaccggtttaggacggtcgn

SEQ ID NO: 28562 - DNA, 1027 bp, Homo sapiens
  misc_feature: GYAE6OF02HFWD8.52.53.E09.1.454.CMB.1.raw
  modified_base (189)..(189): a, c, t, g, unknown or other
  misc_feature (189)..(189): n is a, c, g, or t
  modified_base (226)..(226): a, c, t, g, unknown or other
  misc_feature (226)..(226): n is a, c, g, or t
  modified_base (957)..(957): a, c, t, g, unknown or other
  misc_feature (957)..(957): n is a, c, g, or t
tcagcgcagtacgacacgaccggtgctcgatttagagagagtgtgttgggtttgggggaggcttggtaaagcgggggggtatctgagactctcctgttcagtctctggattcaccttaaataactatggcaatgacgctgggtccgccaggctccgaggggaagggctggagtcgggtctacattttancgagtggtactgggttaggtagcacatacgtacgcanaccgtcgtaggaacgggtccgttcaacctatcctaccgaaaggtactaacgttaccgaaataacacgtcttaagtttaacttaaacaaagttaccgaaactacgtccttaagggaccgtacggtaccggaacggaccgaccgggtaccgttaacgttactttacgttggtaacgtaagggaaacctcgttacccgtacccgtaacccgttccgtaccccggttcccccgttttaaggtaccggtttaaggttttccgtttaacccgggtaacccggtttacccggggtcccggggtaaacccgggtaacccgggtttaaaacccccggttcggggtttaaacccgggtcccccgtttttacccgttaccccccggggttaccgtaaaccccggttacccccgtttaacccccgggtaaaccccggttaaacccccggggggtcccctttaaaccccggggtttaccccggtttttacccccccggtttcccccgggtttacccgtcccccggtttacccccgtaacccgttaaccccggtaaacggtaaccggttaaccccgtaccccgggttacccgggttacccggggcccgtaaacccgggtacccgggtccccggggtccggttaacccggggttcccggtccggttcccgggttacggttaaaccgtaacccgggtttacccgttaaccctttaaccgtaaccgggtaccgttacgttaccccggngttaccgggtacgggtcccgggtacggtaccgggaaccgggtacggtcccgaacggtaccgtcgacgacg

SEQ ID NO: 28563 - DNA, 695 bp, Homo sapiens
  misc_feature: GYAE6OF02GZ422.52.53.E09.1.454.CMB.1.raw
  modified_base (347)..(347): a, c, t, g, unknown or other
  misc_feature (347)..(347): n is a, c, g, or t
  modified_base (443)..(443): a, c, t, g, unknown or other
  misc_feature (443)..(443): n is a, c, g, or t
tcagcgcagtacgacacgaccggtgctcgatttagagagagtgtgttgggtttgggggaggcttggtaaagcggggggggtatctgagactctcctgttcagtctctggattcaccttaaataactatggcatgagctgggtccgccaggctccagggaaggggggggctggagtgggtctctatttatcagtggtactgggtggtagcacatactacgcagactccgtgaacgggccggttcaccatctaccaaagacaattccaaagaacacgctagtatttaacaaatgaacagcctgagacgccggaggaccacggtccgtattattactggtgtagaaagtntctaccacgtctcccgcccccttggacgttggtttactttccgaccgttccgtcggggacccaacggggtaaccctagtacggcccgtcctccctnaccggtcctacccaaccgaacggcccacgttccggtccctttcccccgtcggtcccaccccttccctacccgtaacgacgtccaccgtccgtacgggggtccaccgacggcccggtcccggtccgggtccgtcgcccggttacggtaccgtaacgtacccttaaccgttaccttacgttacgtacgtccggtcgttcggaacgggtccgggtaccgttcgggaccgaacgggtaccgaccgtaagtagtcag

SEQ ID NO: 28564 - DNA, 652 bp, Homo sapiens
  misc_feature: GYAE6OF02FVN55.52.53.E09.1.454.CMB.1.raw
tcagcgcagtacgacacgaccggtgctcgatttagagagagtgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactactcagactccggtagaacgggtccggttcaccgatcctaccaaaagcaattccaagacacgctagttattacaaatgaacagcctgagagccgaggacgacgccgtatattactgtgtagaaagctctcacgtctccgccccttggactgttattcgatccgtgggccagggaccctagtacgccgtctcctcacgcctccaccgaacggccctacgttccggtccttcccccgtggtaccctaccccgtaccctaccgaaacgcgtaccctacccgttcgggtacggggacctacggaccggccggtacccgttgggaccgtcgaccgttcgggtaccgaacggtaccttaaccgttaccgtacgttacgtacgtccgtcggtacggtacggtccgggtaccgttcgggaccgaacgggtcccgagtaacgttaccggatc

SEQ ID NO: 28565 - DNA, 751 bp, Homo sapiens
  misc_feature: GYAE6OF02JTSM7.52.53.E09.1.454.CMB.1.raw
  modified_base (745)..(745): a, c, t, g, unknown or other
  misc_feature (745)..(745): n is a, c, g, or t
tcagcgcagtacgacacgaccggtgctcgatttagagagagtgtgttgggtttgggggaggcttggtaaagcggggggggtatctgagactctcctgttcagtctctggattcaccttaaataactatggcatgagctgggtccgcaggctccagggaagggctggagtgggtctcattttatcaggtggtacgtggtggtagcacatacctacgcagactccggtaggaacgggtccggttcaccagttcctaccgaaaagaccaacgttaccgaaagaacaccgcttacgtaatttaacaagtacgaacaacgcctggaagacggaccgacggacgtacggaccgttaattacgttaacgtcggtagtaggaaacgtaacgtccaccgtaacggtccttaccccgtaccccgttggtaccttggtttactttaccgcgttccggtacggggtaccgtaaccgggtaacccttaggtacgtccgttctcccgtacaccggccctacccgaccggacggtaccctcggttacccgtccctaccccggtcgaccctccccttacccgtagaaccgtacgccctacccgttcggggtcgggacccacggaccgggccgtacccgggtcgaccgtcggccggttacgggaaccaacccgggtacttcccgttacccgtagtaccgtagcccggttacgcgggaaccggtccgggttcgacggacggtacccgggacttaccgcgttancgtacg

SEQ ID NO: 28566 - DNA, 707 bp, Homo sapiens
  misc_feature: GYAE6OF02GM8AX.52.53.E09.1.454.CMB.1.raw
  modified_base (144)..(144): a, c, t, g, unknown or other
  misc_feature (144)..(144): n is a, c, g, or t
  modified_base (182)..(182): a, c, t, g, unknown or other
  misc_feature (182)..(182): n is a, c, g, or t
  modified_base (664)..(664): a, c, t, g, unknown or other
  misc_feature (664)..(664): n is a, c, g, or t
tcagcgcagtacgacacgaccggtgctcgatttagagagagtgtgttgggtttgggggaggcttggtaaagcgggggggtatctgagactctcctgttcagtctctggattcaccttaaataactatggcatgagctgggtccnccaggctcgagggagggctggagtgggtctctatttancagtggtactggtgtagcacagtacctacgcagaccttccggtaggaaggggcccgttacaacctatcctaccaaaagtaccaaagttcccaaagaaccacgtcttagttatttaacaaatgaaacagcctgagacgccgaggacaccggaccgtatacttactgtgtagaaacgatctaccgaccgttccgtcccgccccgttggaccgttggtttaactttcgacttccggtacggggtaccaagggtaacccctggtaacggtacccgttactcccgtacgtaccgtcccgtaccaaccggaccgggccctacggtccggttacccctttcccccgtacggtccctaaccccgttcccgtaacccgaacgtaccgcctacccgtcgggtaaccgggccacgacgggtcccgccgtacgggcgtacgtccgtcggttacgaacggtaccttaccgttcctacgttacgtacgtcgtacgnggaacggttcggcgtacggacgaaccggcgtcgtaactgcacg

SEQ ID NO: 28567 - DNA, 694 bp, Homo sapiens
  misc_feature: GYAE6OF02F8KU5.52.53.E09.1.454.CMB.1.raw
tcagcgcagtacgacacgaccggtgctcgatttagagagagtgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctaccaaaagacaattccaaagaaccacgtctgtaatttaacaaatgaacagcctgagagccgaggacacggccgtatattactgtgtagaaagatctccacgtctccgccccttggacttggttattcgactccgtcggggccacgggaaccctagtacgcccgttctccctcgacgtccctacccgaaccgaacgggacccctacgttaccgggtcccctttcccccgtcgggccctaacccccgtccctaacccgaaaggtaccgcccgtaccttccgggacgggggaccctacgaacggtcccgggcccgtacggggccgtccggccgttacgggttaccgaaacgggtaccttaacccgtttaccttaacgttaccggacgttccgccgttacgggacgggccggggtccttaggggaccctaaggggtaccgactaacgtacgtgcg

SEQ ID NO: 28568 - DNA, 621 bp, Homo sapiens
  misc_feature: GYAE6OF02FITL5.52.53.E09.1.454.CMB.1.raw
  modified_base (376)..(376): a, c, t, g, unknown or other
  misc_feature (376)..(376): n is a, c, g, or t
  modified_base (446)..(446): a, c, t, g, unknown or other
  misc_feature (446)..(446): n is a, c, g, or t
  modified_base (461)..(461): a, c, t, g, unknown or other
  misc_feature (461)..(461): n is a, c, g, or t
  modified_base (492)..(492): a, c, t, g, unknown or other
  misc_feature (492)..(492): n is a, c, g, or t
  modified_base (618)..(618): a, c, t, g, unknown or other
  misc_feature (618)..(618): n is a, c, g, or t
tcagcgcagtacgacacgaccggtgctcgatttagagagagtgtgttgggtttgggggaggcttggtaaagcggggggggtatctgagactctcctgttcagtctctggattcaccttaaataactatggcatgacgctgggtcccgccaggcctccgaggggaaggggctggaggtgggtctctatttatcaggttggtactgggtggtacgcactatacctacgcaagacctccggtaggaaacggggtcccgtttcaccattcctacccaaaagacaacttaccaaagaaccacgcttagtattaacaatagaacagctgagacgccgaggacacgccgtatattacgtgtgtagaaagtatctaccacgtcnccgtccccgttggacttggttacttcgactcggcgggccacggaccctagacgccgttctctcacgcccnccaaccgacggcccncgtccgtccctccccgtggcccacccttccnccaagccgcaccgtcgcggggccacgacggcccgccgtgggctcggccgtgaccgaagtacctcttaccagtacgacgtccgacgtggacggtcggcgtacggaccgacgggcgtacacgtacgtnacg

SEQ ID NO: 28569 - DNA, 216 bp, Homo sapiens
  misc_feature: GYAE6OF01EHRTN.36.20.B09.1.454.CMB.1.raw
  modified_base (215)..(216): a, c, t, g, unknown or other
  misc_feature (215)..(216): n is a, c, g, or t
tcagtacgctgtctcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttccagacagcgtactgagcgggctggcaaggcgcatagnn

SEQ ID NO: 28570 - DNA, 232 bp, Homo sapiens
  misc_feature: GYAE6OF01BBPAC.36.20.B09.1.454.CMB.1.raw
  modified_base (215)..(232): a, c, t, g, unknown or other
  misc_feature (215)..(232): n is a, c, g, or t
tcagtacgctgtctcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttccagacagcgtactgagcgggctggcaaggcgcatagnnnnnnnnnnnnnnnnnn

SEQ ID NO: 28571 - DNA, 453 bp, Homo sapiens
  misc_feature: GYAE6OF01BVQ9X.36.20.B09.1.454.CMB.1.raw
  modified_base (423)..(453): a, c, t, g, unknown or other
  misc_feature (423)..(453): n is a, c, g, or t
tcagtacgctgtctcacgaccggtgctcgatttagtgtagtgtgaagggccggttcaccatctccagagacaattccaacagcacgctgtatttgcacatgaacagcctgagagccgaggacacggccatatattattgtgcgtaaacttccttttgactggttattactcccctagtgaccacgtggggccagggaaccctggtccaccgtctcctcacgcctccaccaacgggcccagtccggtccttccccctcggccacccctcctccaagacgccaccctcggtcgggggccaccgacggcccgggtcccgtggggcctcggcccgttgggtaccgaaacgggtaccttaccgttccgacgaccgacggtccgtacgtggacgggcgggtccgtgggaccgaagggcgacgaagtagnnnnnnnnnnnnnnnnnnnnnnnnnnnnnnn

SEQ ID NO: 28572 - DNA, 215 bp, Homo sapiens
  misc_feature: GYAE6OF02HP31K.36.20.B09.1.454.CMB.1.raw
  modified_base (214)..(215): a, c, t, g, unknown or other
  misc_feature (214)..(215): n is a, c, g, or t
tcagtacgctgtctcacgaccggtgctcgatttagtgtagtgtgaagggtgccagggaaccctggtcaccgtctcctcagcctccaccaagggcccatcggtcttcccctggcaccctcctccaagagcacctcgtggggcacagcggccctgggctgcctggtcaaggactacttccagacagcgtactgagcgggctggcaaggcgcatagnn

SEQ ID NO: 28573 - DNA, 215 bp, Homo sapiens
  misc_feature: GYAE6OF02HVSS5.36.20.B09.1.454.CMB.1.raw
  modified_base (213)..(215): a, c, t, g, unknown or other
  misc_feature (213)..(215): n is a, c, g, or t
tcagtacgctgtctcacgaccggtgctcgatttagtgtagtgtgaagggtgccagggaaccctggtcaccgtctcctcagcctccaccaagggcccatcggtcttcccctggcaccctcctccaagagcacctctggggcacagcggccctgggctgcctggtcaaggactacttccagacagcgtactgagcgggctggcaaggcgcatagnnn

SEQ ID NO: 28574 - DNA, 215 bp, Homo sapiens
  misc_feature: GYAE6OF02IZ7TP.36.20.B09.1.454.CMB.1.raw
  modified_base (214)..(215): a, c, t, g, unknown or other
  misc_feature (214)..(215): n is a, c, g, or t
tcagtacgctgtctcacgaccggtgctcgatttagtgtagtgtgaagggtgccagggaaccctggtcaccgtctcctcagcctccaccaagggcccatcggtcttcccctggcaccctcctccaagagcacctctgggggcacagcggccctgggctgcctggtcaaggactacttccagacagcgtactgagcgggctggcaaggcgcatagnn

SEQ ID NO: 28575 - DNA, 355 bp, Homo sapiens
  misc_feature: GYAE6OF02GD3HI.36.20.B09.1.454.CMB.1.raw
  modified_base (352)..(355): a, c, t, g, unknown or other
  misc_feature (352)..(355): n is a, c, g, or t
tcagtacgctgtctcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagagcacctctgggggcacagcggccctgggctgcctggtcaaggactacttccagacagcgtactgagcgggctggcaaggcgcatagnnnn

SEQ ID NO: 28576 - DNA, 363 bp, Homo sapiens
  misc_feature: GYAE6OF02GNJG0.36.20.B09.1.454.CMB.1.raw
  modified_base (246)..(246): a, c, t, g, unknown or other
  misc_feature (246)..(246): n is a, c, g, or t
  modified_base (353)..(363): a, c, t, g, unknown or other
  misc_feature (353)..(363): n is a, c, g, or t
tcagtacgctgtctcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccnggcaccctcctccaagagcacctctgggggcacgagcggccctgggctgcctggtcaaggactacttccagacagcgtactgacgcgggctggcaaggcgcagtagnnnnnnnnnnn

SEQ ID NO: 28577 - DNA, 365 bp, Homo sapiens
  misc_feature: GYAE6OF02F4NVI.36.20.B09.1.454.CMB.1.raw
  modified_base (355)..(365): a, c, t, g, unknown or other
  misc_feature (355)..(365): n is a, c, g, or t
tcagtacgctgtctcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtccttccccctggccaccctcctccaagacgcacctctgggggcacagcggccctgggctgcctggtcaaggactacttccagacagcgtactggagcgggctggcaaggcgcatagnnnnnnnnnnn

SEQ ID NO: 28578 - DNA, 372 bp, Homo sapiens
  misc_feature: GYAE6OF02JGXB8.36.20.B09.1.454.CMB.1.raw
  modified_base (358)..(359): a, c, t, g, unknown or other
  misc_feature (358)..(359): n is a, c, g, or t
  modified_base (361)..(372): a, c, t, g, unknown or other
  misc_feature (361)..(372): n is a, c, g, or t
tcagtacgctgtctcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatccctagtgaccactggggccagggaaccctggtcaccgtctcctcagcctccaccaagggcccatcggtccttccccctcggccaccctcctccaagacgccacctctgggggcacagcgcctgggctcgcctggtcaaggctaccttccagaccagctacgtgaggcgggctcggcaagggcgcatagnntnnnnnnnnnnnn

SEQ ID NO: 28579 - DNA, 368 bp, Homo sapiens
  misc_feature: GYAE6OF02H9SZ2.36.20.B09.1.454.CMB.1.raw
  modified_base (168)..(168): a, c, t, g, unknown or other
  misc_feature (168)..(168): n is a, c, g, or t
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
  modified_base (349)..(368): a, c, t, g, unknown or other
  misc_feature (349)..(368): n is a, c, g, or t
tcagtacgctgtctcacgaccggtgctcgatttagtgtagtgtgaagggccggttcaccatctccagagacaattccaacagcacgctgtatttgcacatgaacagcctgagagcccgaggacacggccatatattattgtgcgaaacttccttttgactggttattntcccctagtgaccactggggccagggaaccctggtcaccgtntcctnacgcctccacaagggccctatcggtcttccccagcgccncctcacgaagtnacctctggcggcancggctccggtgcncncgtcgacaagcttcacancgtagtctnagccggggntcgagagacgctanangnnnnnnnnnnnnnnnnnnnn

SEQ ID NO: 28580 - DNA, 472 bp, Homo sapiens
  misc_feature: GYAE6OF02IBAN9.36.20.B09.1.454.CMB.1.raw
  modified_base (312)..(312): a, c, t, g, unknown or other
  misc_feature (312)..(312): n is a, c, g, or t
  modified_base (399)..(399): a, c, t, g, unknown or other
  misc_feature (399)..(399): n is a, c, g, or t
  modified_base (439)..(472): a, c, t, g, unknown or other
  misc_feature (439)..(472): n is a, c, g, or t
tcagtacgctgtctcacgaccggtgctcgatttagtgtagtgtgaagggccggttcaccatctccagagacaattccaacagcacgctgtatttgcacatgaacagcctgagagccgaggacacggccatatattattgtgacgaaacttccttttgactggttattactccctagtgaccacgtggggccaagggaaccctggtcctaccgtctcctcgacgtcctaccaaccgaacgggccctacgttccggttcccttacccccgtggaccctacccccttcctaccgaaagacgtccaacccttcggnggggggccacacggtccggccccgtgggggccttacggcccgtaggtaccaaaggtacctacgttccaagacacggtccgttaacgngacgggccggtcgtaggaccgaaggcgacgttaagaagcnnnnnnnnnnnnnnnnnnnnnnnnnnnnnnnnnn

SEQ ID NO: 28581 - DNA, 261 bp, Homo sapiens
  misc_feature: GYAE6OF01BQKZV.51.20.B09.1.454.CMB.1.raw
  modified_base (219)..(261): a, c, t, g, unknown or other
  misc_feature (219)..(261): n is a, c, g, or t
tcagcgatcgtatacacgaccggtgctcgatttagtgtagtgtgaagggtgccgagggaaccctggtcaccgtctcctcagcctccaccaagggcccactcggtcttccccctggcaccctcctccaagagcacctctgggggcacagcggccctgggctgcctggtcaaggactacttcctcgtagcactctgagcgggctggcaaggcggcatagcnnnnnnnnnnnnnnnnnnnnnnnnnnnnnnnnnnnnnnnnnnn

SEQ ID NO: 28582 - DNA, 218 bp, Homo sapiens
  misc_feature: GYAE6OF01CSDUL.51.20.B09.1.454.CMB.1.raw
  modified_base (215)..(218): a, c, t, g, unknown or other
  misc_feature (215)..(218): n is a, c, g, or t
tcagcgatcgtatacacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttcctcgtagcactctgagcgggctggcaaggcgcatagnnnn

SEQ ID NO: 28583 - DNA, 216 bp, Homo sapiens
  misc_feature: GYAE6OF02IX65L.51.20.B09.1.454.CMB.1.raw
  modified_base (214)..(216): a, c, t, g, unknown or other
  misc_feature (214)..(216): n is a, c, g, or t
tcagcgatcgtatacacgaccggtgctcgatttagtgtagtgtgaagggtgccagggaaccctggtcaccgtctcctcagcctccaccaagggcccatcggtcttcccctggcaccctcctccaagagcacctctgggggcacagcggccctgggctgcctggtcaaggactacttcctcgtagcactctgagcgggctggcaaggcgcatagnnn

SEQ ID NO: 28584 - DNA, 191 bp, Homo sapiens
  misc_feature: GYAE6OF01CA6IQ.29.38.D05.1.454.CMB.1.raw
  modified_base (175)..(191): a, c, t, g, unknown or other
  misc_feature (175)..(191): n is a, c, g, or t
tcagatagagtactcacgaccggtgctcgatttagtatctgatagttgggtttgggggaagagggagactgaccggtccccccaggagttcaggtgctgggcacagcggccctgggctgcctggtcaaggactacttcatagtatagactggagcgggctggcaaggcgcatagnnnnnnnnnnnnnnnnn

SEQ ID NO: 28585 - DNA, 635 bp, Homo sapiens
  misc_feature: GYAE6OF02HYO8N.29.38.D05.1.454.CMB.1.raw
  modified_base (223)..(223): a, c, t, g, unknown or other
  misc_feature (223)..(223): n is a, c, g, or t
  modified_base (265)..(265): a, c, t, g, unknown or other
  misc_feature (265)..(265): n is a, c, g, or t
  modified_base (324)..(324): a, c, t, g, unknown or other
  misc_feature (324)..(324): n is a, c, g, or t
tcagatagagtactcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaagagttacnctctcctgcaaggccagtcagagtgttgcatcgacgttgccnggtaccaacaaaaccgtggaccaggcctcccagtcctcctcatctagtgggcatcctanaggatgaccggcactcccgagactacggttcagtgccaggtgggtctgggacagtacttcactctaccaccataccaaacaccgacgttcgggaccgacccgtagtaaacgttacttttacggacgtagtttagttaactttacgttggtacgacgttagtagttacgttagggttacggtaccgtaacccgttaaccttaccgtttcgggaacccgggtaggggtaacccgtaaggggtaacggtaaccggacgttaccgaacggtaacgtaacggttagggtacggacttaccggacctaccgttaacg

SEQ ID NO: 28586 - DNA, 510 bp, Homo sapiens
  misc_feature: GYAE6OF01DO5X9.40.39.D06.1.454.CMB.1.raw
  modified_base (461)..(461): a, c, t, g, unknown or other
  misc_feature (461)..(461): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccactggcatcccagacaggttcagtggcagtggtctgggacagacttcactctcaccgtcagcagactggaccctgaagtattttgctagtgtaattactgtcagcagtatggtagctcaccgatcaccttcggccaagggacacgactggagataaccgactgnggctgcacctatctcgtcttcacttccttcccgcctattctgtagtccg

SEQ ID NO: 28587 - DNA, 524 bp, Homo sapiens
  misc_feature: GYAE6OF01D8GL4.40.39.D06.1.454.CMB.1.raw
  modified_base (284)..(284): a, c, t, g, unknown or other
  misc_feature (284)..(284): n is a, c, g, or t
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (379)..(379): a, c, t, g, unknown or other
  misc_feature (379)..(379): n is a, c, g, or t
  modified_base (413)..(413): a, c, t, g, unknown or other
  misc_feature (413)..(413): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtncatccagcagggccactggcatcccagacaggttcagtggcagtggtcngggacagaattcactcncaccgtnagcagactggaccctgaaagtnttttgcagtgtattactgtcagctagtatggtanctcacgatcaccgttcggaccgaagggacacgacgtaggacgtaacttaaccgaactggtaggctgaccaccgatctcgttcttctacttcctcccgctactctagagtcg

SEQ ID NO: 28588 - DNA, 541 bp, Homo sapiens
  misc_feature: GYAE6OF01D7A1U.40.39.D06.1.454.CMB.1.raw
  modified_base (354)..(354): a, c, t, g, unknown or other
  misc_feature (354)..(354): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggcccactggcatccccagacaggttcagtggcaggtgggtctgggacagacttcactcncaccgtcagcagactggaccctgaagtatttgctagtgttattactgtcagctagtatggtagctcaccgatcctaccgttcggaccaagggaccacggacgtggaacgtaacgttaaccgacgtggtggctcgaccaccgtatctcgttcttactacttccttcccgacctatcctgaacggtccg

SEQ ID NO: 28589 - DNA, 502 bp, Homo sapiens
  misc_feature: GYAE6OF01BC5F3.40.39.D06.1.454.CMB.1.raw
  modified_base (472)..(472): a, c, t, g, unknown or other
  misc_feature (472)..(472): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggacccctgaagattttgctagtgtattactgtcagcagtatggtagctcaccgatcaccttcggccaagggacacgactggagataaccgactgtggctgcaccntctgtcttcatcttcccgcatcctgagtcg

SEQ ID NO: 28590 - DNA, 495 bp, Homo sapiens
  misc_feature: GYAE6OF01DSLDR.40.39.D06.1.454.CMB.1.raw
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
  modified_base (484)..(484): a, c, t, g, unknown or other
  misc_feature (484)..(484): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccactggcatcccagacaggttcagtggcagtgggtctgggacagacttcactctcaccgtcagcagctggaccctgaagtatttgctagtgtattactgtcagcagtatggtagctcaccgatcacctcggcaaggacacgactggagattaaccgatgtgctgcaccgatntgtcttcntccttccncatctgagtcg

SEQ ID NO: 28591 - DNA, 537 bp, Homo sapiens
  misc_feature: GYAE6OF01AG838.40.39.D06.1.454.CMB.1.raw
  modified_base (284)..(284): a, c, t, g, unknown or other
  misc_feature (284)..(284): n is a, c, g, or t
  modified_base (350)..(350): a, c, t, g, unknown or other
  misc_feature (350)..(350): n is a, c, g, or t
  modified_base (412)..(412): a, c, t, g, unknown or other
  misc_feature (412)..(412): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtncatccagcaggccactggcatcccagacaggttcagtggcaggtggtctgggacagacttcactcncaccgtcagcagctggaccctgaagtattttgctagtgtattactgtacagcagtatggtanctcacgtatccaccgttccggaccgaagggaccacggtacgtacggaagtaacgttaaccgacgtcggcggctcgaccacgtctctcgtcttctacttcccgttcccgactactctgtacgtccg

SEQ ID NO: 28592 - DNA, 545 bp, Homo sapiens
  misc_feature: GYAE6OF01COYPR.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtgcagtggtctgggacagacttcgactctcaccgtcagcagactggaccctgaagtattttgctagtgtattactgtctagcagtagtggtagctcaccgtatcctacgttcgacgaacggacacgaacgtggaacgtaattaaccgacgtggtgtctcgaccgaccaagttccttacgtccttacctattcccttccccgacctattccttagacgttaccgg

SEQ ID NO: 28593 - DNA, 781 bp, Homo sapiens
  misc_feature: GYAE6OF01EXPRR.40.39.D06.1.454.CMB.1.raw
  modified_base (709)..(709): a, c, t, g, unknown or other
  misc_feature (709)..(709): n is a, c, g, or t
tcagtctagcgactcacgaccggtgctcgatttagtgacatctcgcagttctttgggggaagacaatgggtttgattcagattacatgggtgacttttctgttgtatttccaatctcagatcgccccggagaaattgtgttgacgcagtctccagacaccctgtcttgtctccgagggaagacgccaccttctcctgcaggtccagtcagtacgtaccttaaccaacgtacttacttacgcctacggtaccatacgaacgtaaaccgtcggaccgacggcctacccgaggtcccttccctactacgttaccgtaaccgggtcgacctaacgtacccgacggaccggtaaccgggggacccctaacggtcgggaccctaaccgtaccccgaaggtaccggtaggttaccgagggttcggaccggtaagggttcgggttaccggtacggggtaacctaacggttaccctttaccgtacccgtttaccgtaacccggtaacccggtacgaacgggtaccgtaaacgggttaccccggttaaccgggtaaacccggttaaggttaaaccggtttacgttttacggacgttaaggtttacgttaacgttacgtacgtacgtagtacgtaaggttacggtacgtacgtaccgtaccgacgtaccgtaccgtacggtaccggaacgacgaacgacgtacgtagtactacgtaacgngtcgcgtcgtacactacgtcgttactcttccttcctaccttcccgttaccgactagttccgtacgtcgtacg

SEQ ID NO: 28594 - DNA, 524 bp, Homo sapiens
  misc_feature: GYAE6OF01EQTMI.40.39.D06.1.454.CMB.1.raw
  modified_base (381)..(381): a, c, t, g, unknown or other
  misc_feature (381)..(381): n is a, c, g, or t
  modified_base (490)..(490): a, c, t, g, unknown or other
  misc_feature (490)..(490): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactactagcctggtaccatcagaaacctggccaggctccaggcctcctcatctacggtgcatccagcagggccactggcactcccagacaggttcagtggcagtgggtctgggacagacttcactctcaccgtcagcagacgtcggaccctgaagtntttcgctagttgtattactgtcagctagtatgggtacgctacgaccgatcaccgttcggaccgaagggacacgacgtggaagtactaaccgacgtgtggctcgacaccntctgtcttctacttccttcccgctatctgagtcg

SEQ ID NO: 28595 - DNA, 612 bp, Homo sapiens
  misc_feature: GYAE6OF01C7Q2X.40.39.D06.1.454.CMB.1.raw
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (338)..(338): a, c, t, g, unknown or other
  misc_feature (338)..(338): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcncatcacggtncatccagcagggccacgtggaccatcccagacaggttcagtgcaggtggtctggacngtactcactctcacgtcagcagtacgtggaccctagaagtacttttgacgtagtagttaacgttacgtgtcgtacgtactacgtagtggtacgtcctcgtaccgtactaccgtaccgttccggacgaacgggacgtaccgtaacgtacgggaacgtaacgttaaacccggtacgttacgggtacggtacgtacgtaccgtaaccgtacgttacttacggttccttaccgtacttcccgttaccccgcctacgttcctaggtaacgttaacccgg

SEQ ID NO: 28596 - DNA, 725 bp, Homo sapiens
  misc_feature: GYAE6OF01BDV64.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgccccggagaaattgtgttgacgcagtctcagacaccctgtcttgtctccgagggaaagagccaccttctcctgcaggtccagtcagagtctaccaacgactacttagcctggtaccatcaacgaaacctggccaggcctccgaggcctcctcactcgtacggtcgcaactccagcgacgggccacgtcggcactcccgagactaggttcagtggactaggtcgggtcgtagggacacggtactcactcgtaccacggtcagcagacgtacggaccctaggtaacgttagtttcgacgtaggttacgttactttaacgtcgttacgaacgtacgtaaggttacgttacggggttacgaccgtttaccgaacccggtaacttaccccgttaacccggttacccgggaacccggtaaaccggggtacccgtaaaccgggtaaccggttaacggggtaaacggttaaaccgttaaacccgggtaacgttacggggttacggtacccgttacggaacccgtaaccgtacgttaccgtcgttttacccggttacctaacccgttcccgttaccccggaccttaacgttccgtaacgggtacgtacccgg

SEQ ID NO: 28597 - DNA, 512 bp, Homo sapiens
  misc_feature: GYAE6OF01BJHSJ.40.39.D06.1.454.CMB.1.raw
  modified_base (183)..(183): a, c, t, g, unknown or other
  misc_feature (183)..(183): n is a, c, g, or t
  modified_base (341)..(341): a, c, t, g, unknown or other
  misc_feature (341)..(341): n is a, c, g, or t
  modified_base (502)..(502): a, c, t, g, unknown or other
  misc_feature (502)..(502): n is a, c, g, or t
tcagtctagcgactcacgaccggtgctcgatttagtgacatctcgcagttctttgggggaagacaatgggtctgattcagattacatgggtgacttttctgttgtatttccaatctcagatgcccccggagaaattgtgttgacgcagtctccagacaccctgtctttgtctccaggggaaanagccaccttctcctgcaggtccagtcagagtcttaccaacgactacttagcctggtaccatcagaaacctggccaggctcccaggctcctcatctacggtgcatccagcaggggccactggcatcccagacaggttcagtggcagtgggtctgggacngacttcactctcaccgtcagcagactggaccctgaacgtattttgctagtgtattactgtcagcagtatggtagctcaccgatccaccttcggaccaacgggacacgacgtggagataaccgactgtgctgcacctatctgtcttcactccttcccgaccntcgtgtaacg

SEQ ID NO: 28598 - DNA, 545 bp, Homo sapiens
  misc_feature: GYAE6OF01D50FQ.40.39.D06.1.454.CMB.1.raw
  modified_base (380)..(380): a, c, t, g, unknown or other
  misc_feature (380)..(380): n is a, c, g, or t
tcagtctagcgactcacgaccggtgctcgatttagtgacatctcgcagttctttggggggaagacaatgggtttgattcagattacatgggtgacttttctgttgtatttccaatctcagatgcccccggagaaattgtgttgacgcagtctccagacaccctgtctttgtctccagggggaaagagccaccttctcctgcaggtccagtcagagtcttaccaacgactacttagcctggtaccatcagaaacctggccaggctccaggctcctcatctacggtgcatccagcagggccactggcatcccagacaggttcagtggcagtgggtctgggacagacttcactctcaccgtcagcagactggaccctgaagtnttttgctagtgtattactgtcagcagtatggtagctacacgtatcctaccgttcggacgaacgggacacggacgtagggaagtacgttaaccgactggtggctcgacaccgattcgtcgttcttactacttcccgttcccgtacctacttacgtaagtcgtaccg

SEQ ID NO: 28599 - DNA, 585 bp, Homo sapiens
  misc_feature: GYAE6OF01DR5GE.40.39.D06.1.454.CMB.1.raw
  modified_base (360)..(360): a, c, t, g, unknown or other
  misc_feature (360)..(360): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccactggcactcccagacaggttcagtggcaggtgggtctgggacagacttcactctcgaccgtnagcagactcggaccctagtaaacgtattttgcgtagtgttaacttacgtgtacagtacgaagttagtgggtacgcctacgaccgtactcctaccgttcggacgaacgggacgtaacgacgtaggacgtaacttaaccgacgtggtacgcgtcgaccaccgtaacgttcgtacgttccttaccgtacttcccgttaccccgacctacttacgtggtaacgtaccgg

SEQ ID NO: 28600 - DNA, 565 bp, Homo sapiens
  misc_feature: GYAE6OF01A6T2J.40.39.D06.1.454.CMB.1.raw
  modified_base (282)..(282): a, c, t, g, unknown or other
  misc_feature (282)..(282): n is a, c, g, or t
  modified_base (543)..(543): a, c, t, g, unknown or other
  misc_feature (543)..(543): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaacctgccaggctcccaggctcctcatctacggtncatccagcagggccacgtggcactcccagacaggttcagtggcaggtgggtctgggacaggtacttcactctcaccgtcagcagactggaccctgaagtatttgctagtgtattactgtcagctagtatggtagctcgaccgactctacccttcggaccgaaagggaccaccggacgtagggaacgtaacgtttaaacccgaacgttggtacggtctacgccaaccgtacttcttcgttccttcctacttcccgttccccncctactcgttaggtaacgtccg

SEQ ID NO: 28601 - DNA, 521 bp, Homo sapiens
  misc_feature: GYAE6OF01B1951.40.39.D06.1.454.CMB.1.raw
  modified_base (482)..(482): a, c, t, g, unknown or other
  misc_feature (482)..(482): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccactggcatcccagacaggttcagtgcagtggtctgggacagacttcactctcaccgtcagcagactggaccctgaacgtattttgctagtgtattactgtcagcagtatggtagctcaccgatcaccgttcggaccaagggaccacgacgtaggagtaacgttaaccgactgtggctcgcaccgnttctgttcttcacttccttcccgcctatctgacgtaccg

SEQ ID NO: 28602 - DNA, 764 bp, Homo sapiens
  misc_feature: GYAE6OF01CPA35.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatcgccccggagaaattgtgttgacgcagtctccagacaccctgtctttgctcgagggaagacgccaccttctcctgcaggtccagtcagagtcttacaacgactacttagcctgtaccatcaagtaacctggccaggcctacccgaggcctccctacacttctacgggtcactactaccgagccgacggggcccacgtcggaccaacgtacccccgaagtaaccgtagggtttccgaagggtcgggccgtaaggggttcgggtacgtacggggaacctaacggtaccctttaccaaccgtttccgacccgttaacccggacgtaacggacgtaacggtacccgtaccgggtaaaccccgtaggtaaacggttacgttttacggacccgttaggttacgtttaacgtttacgtacggtacgtaacgtacgtaacgttaaggtcgggttacgccgtttacccgaacgtacgttaccgtaacccggttaccgggaacccggtaaacgggaacctaccggtaacggtacggtaaacgttaaccgttaaaccgtacggtaccggtagccgtacgtaccaccgtcttaccgttcttccgttactaccgttccccttacccgacttaccgtacgtaccggtacgtaccggg

SEQ ID NO: 28603 - DNA, 773 bp, Homo sapiens
  misc_feature: GYAE6OF01BE1PU.40.39.D06.1.454.CMB.1.raw
  modified_base (283)..(283): a, c, t, g, unknown or other
  misc_feature (283)..(283): n is a, c, g, or t
tcagtctagcgactcacgaccggtgctcgatttagtgacatctcgcagttctttggggggaagacaatgggtttgattcagattacatgggtgacttttctgttgtatttccaatctcagatgcccccggagaaattgtgttgacgcagtctccagacaccctgtctttgtctcaggggaagagccaccttctcctgcaggtccagtcagagtcttacaacgactactagctgtaccatcaagaacctggccaggcctccgaggcctcctcactcgtacggtncactccagcagggccagtcggcactcccagacgtaggttcaggtcggctagggtcgggtactggggacctaggtaccttcacttcctaccgaccgtacgacgaccgaacggtaccgtcggtaaccccgtaggtaaacgtttactttttacggaccgttaagggtttacgtttaacgtttaaccgttacgggttaacctaacgggtaccgttaaagggtttacggtttaacggggttaacgtcccgttaacccgtaacccggttaacgtttacccgttaaccccggtttacccggggaaaccggtaaaccggggtaaccccgtaaccgggtaaccggttaacggggtaaaccgttaaaccggtttaaacccggtacggttacgggtaccggtaccgtaccggtacccgtaacgtaccgtttacgttccgttccgttacctaccgtttccccgttccccgacttaccgttacgtaggtaaccggttacccgg

SEQ ID NO: 28604 - DNA, 683 bp, Homo sapiens
  misc_feature: GYAE6OF01CUMD2.40.39.D06.1.454.CMB.1.raw
  modified_base (182)..(182): a, c, t, g, unknown or other
  misc_feature (182)..(182): n is a, c, g, or t
  modified_base (286)..(286): a, c, t, g, unknown or other
  misc_feature (286)..(286): n is a, c, g, or t
tcagtctagcgactcacgaccggtgctcgatttagtgacatctcgcagttctttgggggaagacaatgggtctgattcagattacatgggtgacttttctgttgtatttccaatctcagatgcccccggagaaattgtgttgacgcagtctccagacaccctgtctttgtctccaggggaanagccaccttctcctgcacggtccagtcagacgtcttaaccaacgactacttagcctgtaccatcagaaacctggccaggctcccgaggctcctcatctacggtncatccagccacggggccacgtggcactcccaggacctaggttcaggtggccgaggtgggtcgagggacacggtactccgtacctcctacgacccgtcacggactacgacctaccggaaccctaggtaaacgttcgttttcgactaacggtttagttaacgttacgttagttacgtagtacgtaaggttaacgtggttaacggtccctaccgtaaccgtaacgttccctaacccgttacgggaaccgaacggggaccctaacgggtacgtaacgggaacgtaaccgttaaccgtaacgtcggtaggtccgtacggtacctaacccgtattaccggttacgttacccttaccggtactttccccgttacccgtacctaacttcgttaacggtaaaccgg

SEQ ID NO: 28605 - DNA, 658 bp, Homo sapiens
  misc_feature: GYAE6OF01B84U9.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtcttgtctccgaggggaaagagccaccttctcctgcaggtccagtcagagtctaccaacgactacttagctggtaccatcagaacctggccaggcctcccgaggctcctcactcgtacggtgcactccagcgacgggccacgtgcactcccagacgaggttcaggtggcgaggtcgggtcgtgggacacgacttcactcctacgaccgtacacgcgacgaccgtcggaccctaggtaagtagttttgacgtaggttcgttacgtttactgtacgacgtacgtaggttagtagggtacgtcctaccgtaaccgtactacccgtaccgttccgggaacccgtaaacggggaaccaaccggtacggtaacgggtaacgttaaaccgttaacccggtaacgtcgggtacgtaccgttcgacccgaaccgtcgttctacggtttcctccttaccgttcccgttaccccgaccttaccttcgtacggtaaccgttacccgg

SEQ ID NO: 28606 - DNA, 556 bp, Homo sapiens
  misc_feature: GYAE6OF01B4WDB.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccacgtggcatcccagacaggttcagtgcaggtgggtctgggacagacttcactctcaccgtcagcagactggaccctgaagtctttgctagtgtattactgtcagctagtatggtagctacgacgactcctaccgttcggaccgaagggaccacggacgtacggagtaacgttaaccgacgtcggtacggtctcgacctaccgtacttcgtcgttccttacctacgttcccttcccgacctactcgtacgtacgttaccg

SEQ ID NO: 28607 - DNA, 742 bp, Homo sapiens
  misc_feature: GYAE6OF01EDW0L.40.39.D06.1.454.CMB.1.raw
tcagtctagcgactcacgaccggtgctcgatttagtgacatctcgcagttctttggggggaagacaatggggtttgattcagattacatgggtgactttttctgttgtatttcctaatctcagatgcccccggagaaattgtgttgacgcagtctccagacaccctgttctttgtctccgaggggaaagagccaccttcctcctgcacggtccagtcagacgtccttaccaacgacttacttagcctgtaccatcaacgaaaccgtggccaggcctccaggcctcctcatcgtacggtgcactccagcgacggccactcggcactcccgagacgaggttccgagtggcgtaggtgggtcgtggacgagtccttcgactcgtacgaccgtcacgcgagtacgtccgggacctaggtaagttacgttttgacgtagttagttaagtttacgttcgtacacgtacgtaaggttacgttagggttaccgtaccgtaccgtaaccggtacttacccgtaacccggtttaccgggaaccggtaaaccggggaaccgtaaccggtaaccggttacgggtaaacgttaaaccgtttaaacccggaacggttacgggttaccggtaccggttaccgaaccgtaacccgttaacgtttacccgttacggtttcccgttaccgttaacccctttccccgttaacccccgttaccccgtaacccgtttaacggtacccgttaaccggtacccgg

SEQ ID NO: 28608 - DNA, 765 bp, Homo sapiens
  misc_feature: GYAE6OF01CQ8K6.40.39.D06.1.454.CMB.1.raw
  modified_base (151)..(151): a, c, t, g, unknown or other
  misc_feature (151)..(151): n is a, c, g, or t
  modified_base (211)..(211): a, c, t, g, unknown or other
  misc_feature (211)..(211): n is a, c, g, or t
tcagtctagcgactcacgaccggtgctcgatttagtgacatctcgcagttctttgggggaagacaatgggtttgattcagattacatgggtgtacttttctgttgtatttccaatctcagatcgccccggagaattgtgttgacgcagtcnccagaccaccctgttctttgtctaccgaaggggaaagacgacccaccttcctcctcgcgnggtccagtcagacgtacttaaccaacgtactacttacgccgtacggtaccatacgaaacgtaaaccgtcggaccgacggtccctacccgtacggtcctaccctaccacgttaccgtacgggtcacctacgtccgacgccggacgggacccacggtcgaccaccgtacccgaacgaccgtacgggttacgacgggttacggacggtagggtcgggtacggtaacgggacgtaacgtacctttaccgaccgttacctacccgtaccgtacacggactaacggtaccgaccggtaaccgttaagtaagtttacgtttacgacgttagtttagttacgttacgttacgtacgtacgtacgtaagttagtacgtaccgtactacccgacttacctccgtaccgtaccggaacggaacggaaccgtacgtaacggtacggtaaacgtaaccgttaaccgacgtggtaccgtacgtccgaaccgtactacgttcgtacgtttcctaccgttacccttcccgtaacccgtacttaaccgttacggtaacggttcgtaaccgg

SEQ ID NO: 28609 - DNA, 580 bp, Homo sapiens
  misc_feature: GYAE6OF01B2CKN.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaacctggccaggctccaggctcctcatctacggtgcatccagcgacgggcccacgtcggaccactcccagacgaggttcaggtggcaggtgggtctgggacagtacttcactctcaccgtcagcagactcggaccctagaagtgtttgactagttgtattactgtcagctaagtagtaggtacgtctacgaccgatcctaccgttaccggaccgaacgggacctaacggacgtaggagtaacgttaaccggacgtcggtcggcgtacgacctacgtactcgttcgttcttacctacttcccgttccccgacttacgtcgttaggtacgttacg

SEQ ID NO: 28610 - DNA, 789 bp, Homo sapiens
  misc_feature: GYAE6OF01BR3DY.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgccccggagaaattgtgttgacgcagtctccagacaccctgtctttgtctccgaaggggaaagagccaccttctccgtgcaggtccagtcagagttcttaccaacgactacttagcctgtaccatcaagaacctggccaggctcccgaggccttcctctactcgtacggtgcaactccagccacgggccacgtcggacctactccccgaaggtaccgtacgggtttaccgaagggttcgggaccgtaagggttcggggttaccgttacgggggtaacctaacgggtaaccctttcgaaccgttccgttaccgacccggtttacgacgtaccgaacggtaaccgttacgggtaaccccttaggtaaacggtttacgtttttaggaccgttaagggtttaacgttaacgtttaccgttacgttaccgtaacgtcggtaaagttaccggttaggtaacgtaccgtacccgtaacgtacgttaccctaccggtttaccggaacccggtaaacgggaccgtaacggtaaccggtacgggtaacggtaaacgttaaccggacggttcggtacggtcgttacgaccgtaccgtcgttacttcggttccctttacggtaccctttaccccggttacccgtacccgttaacgtccccgttaaggtaccggttacccg

SEQ ID NO: 28611 - DNA, 693 bp, Homo sapiens
  misc_feature: GYAE6OF01EBODP.40.39.D06.1.454.CMB.1.raw
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
  modified_base (628)..(628): a, c, t, g, unknown or other
  misc_feature (628)..(628): n is a, c, g, or t
  modified_base (636)..(636): a, c, t, g, unknown or other
  misc_feature (636)..(636): n is a, c, g, or t
  modified_base (643)..(643): a, c, t, g, unknown or other
  misc_feature (643)..(643): n is a, c, g, or t
  modified_base (652)..(652): a, c, t, g, unknown or other
  misc_feature (652)..(652): n is a, c, g, or t
tcagtctagcgactcacgaccggtgctcgatttagtgacatctcgcagttctttgggggaagacaatgggttttgagttcaggattaacatgggtgacgttttctgttgtatttaccaaatctcagtatcggccccggagaaattgtgttgacgcagtcctcagaccacccgtgtcttgtctcgagggaagcgctacttctctgcgtacggtcagtcgaggacgtaccgtaccaacgtactaccgttacgccgtacggtaccactacgaacgtaaccgtcggacccgtacgggtccctcccggacggcccttaccctcgtacgttccgtaacggtccgacctaccttaccgaaggccgaacgggtcccacggccggacctaccgtccgaacggtaccgtaggttccaagggtcgccgtagggtcggttcggacggtacgtacggtacttcccggacgtcgtaccgaccgnggacgntaacggacgaccgtacgtaaggtaactttgttgggactagttacttacgttctaggtacacggattaggtagtcggtacaccgtcggtacctacttcggtaaccctcgggaaccgacggaaccacgtagtaagggactaacgtaactagggngtcggcgntaacccntctccgttntcccgtcacccttcggttcccaatcgtttaacgcgatccgg

SEQ ID NO: 28612 - DNA, 845 bp, Homo sapiens
  misc_feature: GYAE6OF01AGRVW.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccgaaggggaaagacgcctaccttctcctgcaggtccagtcagagtccttaaccaacgactacttacgcctggtaccatacaacgaaacctcggccacggtcctcccgaggtcctccctacacttccgtaacgggtcgaccactccgaacggccgacgggccctaacgtcggactaccgtaccccgaaggacgtacgggttccaagggttcggacggtagggttcggggtaccgttaggggaaccacggtaaccctttcgaaccttcccgtaccgtaacccgggttcgaacggtaccgtaacggtaccgtacgggtaaccctaggtaaacgtttcgttttacggacgttaggttacgtttaacgtttaccgtacggtaccgtaacggtaccgttaaggttaacggttcgggtaacggtacccttaaccgtaacccggtaccttaacccggttaacccggttaccggggaacccggaaacggggtaacccgtaacggtaccgggttaaagggtaaaccggttaaaccgttaaacccgggtaaccgttcggggtaccggtaccgtacccgtaccgtaaacccgtacgttccgtttaaccggtttcctttacccgtaacccgtttccccgttaaccccggaccttaagtcccggtaaaggttaacccggttaaccg

SEQ ID NO: 28613 - DNA, 772 bp, Homo sapiens
  misc_feature: GYAE6OF01D4B3H.40.39.D06.1.454.CMB.1.raw
  modified_base (538)..(538): a, c, t, g, unknown or other
  misc_feature (538)..(538): n is a, c, g, or t
tcagtctagcgactcacgaccggtgctcgatttagtgacatctcgcagttctttgggggaagacaatgggtttgattcagattacatgggtgacttttctgttgtatttccaatctcagatcgccccggagaaattgtgttgacgcagtctccagacacctgtctttgtctcgagggaagcgcctaccttctcctgcgacggtcagtcgagtactaccttaaccgaacgtactaacttacgcctcggtaaccactaccgaacgtaaaccgtcgggaccaacgggtcctacccgacggtccttccctacgtacgttccgtaacggtcgacctacgtccgaggaccgaacggggccctaacggttacgggacctaaccgttccccgaaggtaaccgtaggggtttccgaagggtccgggtacgttaaggggttcggggttacggtacgggaacgtaacggttacccgttcgtaaacccgttcgtacccgtacgtccgaacggtacaacgggtacgtccggtaacccgtaggtaaagtttnttttacggacggttagttacgttaacgtttaacgtcggttaactaggtaccgtaaggtttacgtagggtactacccgtactacccgtacgtaccgtaccggtaccgggaacgaacgggtaacacggtacggttacggtaaccgtaacgttaaccggacgttgtacggctacgactaccgtcttactcgttacgtcctacttcccgtacccacgtacgttcgtagacgttaccgg

SEQ ID NO: 28614 - DNA, 651 bp, Homo sapiens
  misc_feature: GYAE6OF01DPI1V.40.39.D06.1.454.CMB.1.raw
  modified_base (360)..(360): a, c, t, g, unknown or other
  misc_feature (360)..(360): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttacaacgactacttagcctggtaccatcagaaaacctggaccaggctccaggctcctcatctacgtgcatccagcagggccatggcactcccagacaggttcagtgcaggtggtctgggacagacttacactcctcgaaccgtnaacggcaagacgtcgggaccctaggtaacgtattttcgacgtagtcgttaatttaacgtcgtacgtagaacgtagttaagtacgggttacgtaccgtaccgaacccgtaccgttacgtaccccgtttaccgggacccggaaaacgggaaccgtaaaccggtaacgtgggtaaacgtaaccgtttaaaccggtaaaccgttgggtacggtaccggtcggacctaccgtacttacttcggttaccttacctacttacccgttaccccgtacttactacgtcgtaagtacccgg

SEQ ID NO: 28615 - DNA, 795 bp, Homo sapiens
  misc_feature: GYAE6OF01DYJWV.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatcgcccccggagaaattgtgttgacgcagtcctccaagaccacccgttgttcttttgtcctaccggaagggggaaacgacgccctaccttcctcctcggcacggtccagtccagtacgtccttaaccaaacgtacttacttacgccgtaggtacccatacgaacgaaaccgtggaccgacgtccacccgagtcctcctctactccgtaacggtcgactactccgacgaccggacggtaccgacgtacggtccaccgtaccgacggaaccgtaggttaccgaggttacgggtaccgtacggggttcgggtacggtacgggaactaccggtaccttactaccgttcctaccgtaccggtacaccggtaacgaacggtaccgaccgtaaccgtaggtaacgtttacgttcgtacgttagttacggttaacttacgtgggttacccaggtaacttacggtagtccggtaacgttcccaccgtaacgtaccttacccggtacgtcccgggaacggtaaccggtacgaaccggtaacgtacgggtaaccttaaccggttaacgtacgggtcgtcccgaagtccgaaccgtacgttcgtttacccgaccttttcgaaccttacccccggttttcccgtaaaccccaggtttacctaacccgggttagggtaacctaaccggg

SEQ ID NO: 28616 - DNA, 736 bp, Homo sapiens
  misc_feature: GYAE6OF01B2OKT.40.39.D06.1.454.CMB.1.raw
tcagtctagcgactcacgaccggtgctcgatttagtgacatctcgcagttctttgggggaagacaattgggtttgattcagattacatgggtgtacttttctgttgtatttccaatctcagatcgccccggagaattgtgttgacgcagtcctccacgtaccccctgttctttgtctccggaaggggaacgcgccctaccttcctcctgaccgacggtccagtccagtacgttaccttaaccgaaccgtaccttacgttacgtccgtacggtaccataccgaacggtaaacccgtcggaccgacggtcctacccgacggtccctacctctacgttccgtacggtcacctacgtccgagccgaccggcctacgtcggaccaccgtacccgagtacgtcggtcgaggtcgcggtagggtcgggtcgtacggacacgtcctactccgtacctcgaccgtcgacgtactacgtaccggtacgtaccgtaggtaagtttcgttacgacgtttagttacgttacgttacgtgtaacgtacgtacgtacggttagtacggtaccttaccgtaaccgtccgttaccgtaccgtacccggtaccgggaacgacggtaccgacgtacgtaagtaacgtaaccgtacgtacgtcgacgtcctacacctcgttacttcgttaccgttccttcccgtaacccgtttccccgtacccgtctacttaccggtaccgtaacgtccgtaacgg

SEQ ID NO: 28617 - DNA, 583 bp, Homo sapiens
  misc_feature: GYAE6OF01CRVF1.40.39.D06.1.454.CMB.1.raw
  modified_base (181)..(181): a, c, t, g, unknown or other
  misc_feature (181)..(181): n is a, c, g, or t
  modified_base (278)..(278): a, c, t, g, unknown or other
  misc_feature (278)..(278): n is a, c, g, or t
  modified_base (390)..(390): a, c, t, g, unknown or other
  misc_feature (390)..(390): n is a, c, g, or t
tcagtctagcgactcacgaccggtgctcgatttagtgacatctcgcagttctttgggggaagacaatgggtttgattcagattacatgggtgacttttctgttgtatttccaatctcagatgccccggagaattgtgttgacgcagtctccagacaccctgtctttgtctccaggggaaanagcctaacttctcctgcaggtccagtcagagtcttaccaacgactacttagcctggtaccatcagaaacctgacaggctccaggctctcatctagtncatccagcgaggtccagtcggacactcccgaagaccaggtttcagtgacgacggtgggtactggggacacgacttcgaacttctccacgtcaacgctacgactcgggacccngtaaagtctttgctagtattacgttactgactagacgtagtataggtagacgttacgtaccgactccgaacctttcgggaacgaacgggtaaccacggtaaccgtagggtagtaaacgtttaaccgacgtcggttacggctcggtcacgtactctgtacttctaagtcccttcgacctagtcctgaacgtacg

SEQ ID NO: 28618 - DNA, 756 bp, Homo sapiens
  misc_feature: GYAE6OF01ACCXK.40.39.D06.1.454.CMB.1.raw
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
  modified_base (218)..(218): a, c, t, g, unknown or other
  misc_feature (218)..(218): n is a, c, g, or t
tcagtctagcgactcacgaccggtgctcgatttagtgacatctcgcacgttctttgggggaagacaatggggtttgagttcagagttacagtgggtgacttttcgtgttggtatttccaatctcagatcgcccccggtagaaacttgtcgttgacgcagtctccagaccaccctgtctttgctcaggggaangccacgttcncgtgcagccagtcagngtctacaacgactactagctggtaccagtcagaaccgtggcctaggcctccgaggcctcctcgactcgtacggtgcagtccgagtccaggacccacgtggcctactccccgaagtccgtaacggttcaagggtcgccgagggtttcggtcgtcggggaaccgttagtacccttccgaaccttcccgtaccgtaaccgtacgacggacgtaacgtaccggttcgggaaacccccgttggaaaccggtttacgtttacggaccgttaacgggtttcttaacgtttaccgtcgttaaccgtacggtacggtaacggttacgttacgggtacgtttacccgtaccgtaaccgtacgttcccgttaccgtacccgggaacggttaacggaaccgtaccggtacgttacggacgttaaacgtaacccggtaagttccgggtagtccgtcgtacctaaccgttcttaccggtttcgttaccgttacccgttaccgtccccttaaccccggaccctacgttccgttaacggtacggttaaccccgg

SEQ ID NO: 28619 - DNA, 792 bp, Homo sapiens
  misc_feature: GYAE6OF01D33D6.40.39.D06.1.454.CMB.1.raw
  modified_base (132)..(132): a, c, t, g, unknown or other
  misc_feature (132)..(132): n is a, c, g, or t
  modified_base (474)..(474): a, c, t, g, unknown or other
  misc_feature (474)..(474): n is a, c, g, or t
tcagtctagcgactcacgaccggtgctcgatttagtgacatctcgcagttctttgggggaagacaatgggtttgattcagattacatgggtgtacttttctgttgtatttccaatctcagatcgccccgganaaattgtcgttgacgcagtctacagaccacccgtgttctttgtcctaccgaagggggtaaacgacgccctacctttcctcctggaccgacggtccagtccaggacttacttaaccaacgtacttactcgtcctagtaccatacaacgtaaccgtggccacggcctacccgagtaccctccctatacgtaccgtacggtcgactaaccgtccgaaggtacccgacggggtcccaaggtccggacctaacgtcccgaaacggtacgttaccgggtttagagggttaccgacgttagggtcgggtacgcgggaactacggtcttcgaacttcgaccgacccgtanacgccgtaaggtcccgtaccggtaaccgtaggtaaacgtttacgtttcggaacggttacgttacgtttaacgttacgttacggtacgtacgtaccgttaaggttacggttcggtacgtaccttaccggacccgtacggttaccgttacccggttaccgggaaccggaacgtacccgaacggtaaccggtacgggtaacgttaaaccggtaacccggtaaggttcggtaccgtaaccgtccgacgttacgtccgttcttacgttaccgttaccttccgtacccgtcccgtaacttccgttaacgcggttacgtacccgg

SEQ ID NO: 28620 - DNA, 858 bp, Homo sapiens
  misc_feature: GYAE6OF01AYCZW.40.39.D06.1.454.CMB.1.raw
tcagtctagcgactcacgaccggtgctcgatttagtgacatctcgcagttcgtttggggggaagacaatggggtttgattcagattacatgggtgtacttttctgttgtatttccaatctcagatcgccccggataattgtgttgacgcagtctccacgaccaccctgttctttcgtcgtaccggaaggggaaagacgccctaccttcctccgtcgccgtacggtccgacgtacgagtacgttacctaaccaacgtaacttacttacgtccgtacggtaccataccaacgtaaccgtcggaccgacggcctcccgacgtcctaccgtcgtacttccgtacggtcacctacgtacccacggtaccggaccgggcccacggttcggaccctaccgtacccgtacggtacgtacgggttacgtacgggtcggacgggttacgggtaccgggtacgggtacgggtaaccgtacggttaaccctttccgaaccgttcccgtaacgtcccggtacgaacgtcgtaacgtacccgggtaccgtaaccggttaaggtacgtttacgttgacgttacggtttactttaccgtacgttacggaccttaggtacgtagggtttacgtacgggttacctaaccggtttaacccgaccttaaccgttccgaccccggtaacgggtaacccgtaaccgggtaacgtacccggtaaggttaaccgggtaactttaaccggtaacccggtaggttccgggaccggtccgtacgtacccgtaccgttccgttacccggtttaccgttcccttaccgttaacccgtcccccgtttacggttaactacccgggtttaacgccgggtttacccgtacg

SEQ ID NO: 28621 - DNA, 199 bp, Homo sapiens
  misc_feature: GYAE6OF02HJS74.40.39.D06.1.454.CMB.1.raw
  modified_base (182)..(188): a, c, t, g, unknown or other
  misc_feature (182)..(188): n is a, c, g, or t
  modified_base (190)..(199): a, c, t, g, unknown or other
  misc_feature (190)..(199): n is a, c, g, or t
tcagtctagcgactcacgaccggtgctcgattagtgacatctcgcgaggttctttgggtttgggggaagaggaagactgacggtcccccaggagttcaggtgctgggcacagcggccctgggctgccctggtcaaggactacttccagtcgctagactgagcgggctggcaaggcgcatagnnnnnnnannnnnnnnnn

SEQ ID NO: 28622 - DNA, 541 bp, Homo sapiens
  misc_feature: GYAE6OF02IDIB5.40.39.D06.1.454.CMB.1.raw
  modified_base (283)..(283): a, c, t, g, unknown or other
  misc_feature (283)..(283): n is a, c, g, or t
  modified_base (386)..(386): a, c, t, g, unknown or other
  misc_feature (386)..(386): n is a, c, g, or t
  modified_base (503)..(503): a, c, t, g, unknown or other
  misc_feature (503)..(503): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggcctctcatctacggtncatccagcagggccacgtggcactcccagactaggttcaggtgcaggtcggtctgggacagacttcgactctcgaccgtcagcagacgtcggaccctgaagtntttgacgtagtgttatttacgtgtcagtactagtagtggtagctacgacgactcctaccgttcggacgaacggacacggactaggaacgtacgttaaaccgacgtgtcgctagcacnctctcgtcttcacttcctcccgcctactcgtgagtccg

SEQ ID NO: 28623 - DNA, 503 bp, Homo sapiens
  misc_feature: GYAE6OF02FWI7U.40.39.D06.1.454.CMB.1.raw
  modified_base (472)..(472): a, c, t, g, unknown or other
  misc_feature (472)..(472): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaacgtattttgctagtgtattactgtcagcagtatggtagctcaccgatcaccttcggccaagggacacgactggagactaaccgactgtgctgcacntctgtcttcatcttcccgcctatctgagtcg

SEQ ID NO: 28624 - DNA, 517 bp, Homo sapiens
  misc_feature: GYAE6OF02F048U.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtagtggtagctcaccgactcaccttcggccgaacgggacacgacgtggagattaaccgactgtgctgcaccatctgtccttcggacttccttcccgtacctactctcgagtccg

SEQ ID NO: 28625 - DNA, 539 bp, Homo sapiens
  misc_feature: GYAE6OF02G2ECI.40.39.D06.1.454.CMB.1.raw
  modified_base (377)..(377): a, c, t, g, unknown or other
  misc_feature (377)..(377): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtgcagtgggtctgggacagacttcactctcacgtcagcagactggaccctgaagtntttgctagtgtattactgtacagcagtagtggtagctacacgatcgaccttccggacgaaagggaccacggacgtggaacgtacgttaacccgacgtgtacggctcgacctaaccgtatccgttagtcttctacgtccttcccgctactcttagtacgtccg

SEQ ID NO: 28626 - DNA, 544 bp, Homo sapiens
  misc_feature: GYAE6OF02F15PL.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccagtggcactcccagacaggttcagtggcaggtgggtctgggacagtcttcactctcaccgtcagcagactcggaccctgaagtattttgctagtgtattacgtgtcagctagtagtggtagtctaccacgtactcaccgttcggaccgaacgggacacgacgtggaacgtaacttaaccgaacgtgtgacgtgaccaccgtatcttagtccttctacttccttcccgacctactcgtagacgtccg

SEQ ID NO: 28627 - DNA, 525 bp, Homo sapiens
  misc_feature: GYAE6OF02HXWK7.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgccccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtgcagtgggtctgggacaggacttcactctcaccgtcagcagactggaccctgaagtattttgcagtgtatttatgtcagcagtatggtagctcaccgatccaccgttcggcgaagggaccacgacgtggagaacttaaccgaactgtagctacgcaccgattcctgttcttacacttccttcccgacctactcgtgacgtcg

SEQ ID NO: 28628 - DNA, 560 bp, Homo sapiens
  misc_feature: GYAE6OF02G9QBX.40.39.D06.1.454.CMB.1.raw
  modified_base (212)..(212): a, c, t, g, unknown or other
  misc_feature (212)..(212): n is a, c, g, or t
  modified_base (358)..(358): a, c, t, g, unknown or other
  misc_feature (358)..(358): n is a, c, g, or t
  modified_base (382)..(382): a, c, t, g, unknown or other
  misc_feature (382)..(382): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagngtcttaccaacgactacttagcctggtaccatcagaaacctggcaggctccaggctcctcatctacggtgcatccagcagggccacgtggcatcccagacaggttcaggtggcagtgggtctgggacagacttcactctcaccgtnacgcagactcggaccctggaagtnttttgctagtgtacttatgtcagactagtatggtagtctccgacgactccaccttccggaccgaacgggacaccgacgtaggaacgtacgttaaaccgtaactggtacgcgtcgaccacgtaacttcgtcgtccttactacttcccgttacccgcctacgtacttacggacgtaccgg

SEQ ID NO: 28629 - DNA, 514 bp, Homo sapiens
  misc_feature: GYAE6OF02FXGUQ.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgccccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcaggtgggtctgggacagacttcactctcaccttcagcagactggaccctgaagtattttgctagtgtattactgtcagcagtatggtagctcaccgatcaccttcggaccaagggacacgactggagtataaccgactgtgctgcacctatctcgtcttacacttcttcccgcctactctgtagtccg

SEQ ID NO: 28630 - DNA, 542 bp, Homo sapiens
  misc_feature: GYAE6OF02FX3JY.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcaggtgggtctgggacagacttcactctcaccgtcagcagactcggaccctggaagtcttttgctagtgttattactgtcagctagtagtggtagctcaccgatcctaccttccggaccaagggacacgtacgtggaacgtacgttaaaccgacgtgtacggctcgcaccgtattcctcgttcttcctacttccgtcccgcctatcgtacgtagtccg

SEQ ID NO: 28631 - DNA, 559 bp, Homo sapiens
  misc_feature: GYAE6OF02GLGZP.40.39.D06.1.454.CMB.1.raw
  modified_base (283)..(283): a, c, t, g, unknown or other
  misc_feature (283)..(283): n is a, c, g, or t
  modified_base (381)..(381): a, c, t, g, unknown or other
  misc_feature (381)..(381): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtncatccagcagggccactggcatcccagacaggttcaggtggcaggtgggtctgggacaggacttcactctcaccgtcagcagactcggaccctgaatntttgctagtgtattactgtcagactagtagtggtacgctacaccgtactcgtaccgttccggaccgtaacgggaccacgacgtaggagtaacgttaaccgaacgtgtacggcgtacgacctaccgtacgttacttcgtccttactacgttccttcccgcctactccgtagtacgtccg

SEQ ID NO: 28632 - DNA, 658 bp, Homo sapiens
  misc_feature: GYAE6OF02HOH6K.40.39.D06.1.454.CMB.1.raw
  modified_base (194)..(194): a, c, t, g, unknown or other
  misc_feature (194)..(194): n is a, c, g, or t
  modified_base (428)..(428): a, c, t, g, unknown or other
  misc_feature (428)..(428): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttcncctgcaggtccagtcagagtccttaccaacgactactacgtctcgtacactacacgaaactacgcacgctccacgctcctcatctacgtgcatccagacacggacgacctcggcacctccccgagaacgacggttacgagtgggcaaggtgggtcgtgggacaagacttcactcctcaccgtcacgacacgaactacggaccctagaagtattttcgacgacgttagtattacnggtaccagtctacggttatgggtagtccacgaacccgattcctacccggttaccggtaaccggaaggtaaccgacgtaacgtgggaaacggttaacttaaacccggtaaacgttggaacggtccgttacgaccgtaaacccgtaagttcccgttagttcccgttaacctacgttaccccgttttcccccggaaccgtaacggtttaaccttacgggaaaccggttcccgg

SEQ ID NO: 28633 - DNA, 556 bp, Homo sapiens
  misc_feature: GYAE6OF02GWA9H.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaacctggccaggctcccaggctcctcatctacggtgcatccagcagggccacgtggcactccccagacaggttcagtggcaggtgggtctgggacagacttcactctcaccgtcagcagactcggaccctggaacgtattttgctagtgtattactgtcagctagtagtggtagtctacgacgactctaccgtcggaccgaaggacacgacgtggaacgtaacgtaaccgacgtgtacggcgtcgaccaccgtactccgttcgtccttacctacttcccttcccgtcctacttccgtacgtacgtccgg

SEQ ID NO: 28634 - DNA, 572 bp, Homo sapiens
  misc_feature: GYAE6OF02I1HZL.40.39.D06.1.454.CMB.1.raw
  modified_base (284)..(284): a, c, t, g, unknown or other
  misc_feature (284)..(284): n is a, c, g, or t
  modified_base (400)..(400): a, c, t, g, unknown or other
  misc_feature (400)..(400): n is a, c, g, or t
  modified_base (519)..(519): a, c, t, g, unknown or other
  misc_feature (519)..(519): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtncatccagcagggccacgtggcactcccaagacaggttcagtcggcaggttgggtctggggacagacttcactctcaccgtcagcagactcggaccctgaagtattttcgactagtnttattactgtacagcagtatggtagctcaccgtatacctaccgttaccggaccgaacgggaccgaacggtacgtagggaacgtaacttaaaccgaacgtggtacgcctacgacgtaccnttacctacggttcctttactacttccttcccgcctactcgtacgtacgtaccg

SEQ ID NO: 28635 - DNA, 548 bp, Homo sapiens
  misc_feature: GYAE6OF02H0P29.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggcctcctcatctacggtgcatccagcagggccactggcatcccagacaggttcagtggcaggtgggtctgggacaggacttcactctcaccgtcagcagacctggaccctgaacgatttttgactagtgttattactgtcagcagtagtggtagctcaccgatccaccgtccggacgaagggacacgacgtaggacgaagttaaaccgaactgtggtctcgacaccgaatcctcgttccttactacttcccttcccgtcctactccgtagaaccgttccgg

SEQ ID NO: 28636 - DNA, 522 bp, Homo sapiens
  misc_feature: GYAE6OF02FWH8P.40.39.D06.1.454.CMB.1.raw
  modified_base (481)..(481): a, c, t, g, unknown or other
  misc_feature (481)..(481): n is a, c, g, or t
  modified_base (508)..(508): a, c, t, g, unknown or other
  misc_feature (508)..(508): n is a, c, g, or t
tcagtctagcgactcacgaccggtgctcgatttagtgacatctcgcagttctttgggggaagacaatgggtttgattcagattacatgggtgacttttctgttgtatttccaatctcagatgccccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcaggtgggtctgggacagacttcactctcaccgtcagcagctggaccctgaagtattttgctagtgttattactgtcagctagtatggtagcgtcaccgatcaccgttcgaccgaaggaccacgacgtggagtactaaccgagtagtggctgcacntctcgtcttctcttccttcccgacctntcgtacgtagtccg

SEQ ID NO: 28637 - DNA, 523 bp, Homo sapiens
  misc_feature: GYAE6OF02F70AY.40.39.D06.1.454.CMB.1.raw
  modified_base (183)..(183): a, c, t, g, unknown or other
  misc_feature (183)..(183): n is a, c, g, or t
  modified_base (382)..(382): a, c, t, g, unknown or other
  misc_feature (382)..(382): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaanagccaccttctcctgcaggtccagtcagagtcttaccaacgactacttagcctggtaccatcagaaacctggccaggctcccaggctcctcatctacggtgcatccagcagggccactggcatcccagacaggttcagtggcaggtgggtctgggacagacttcactctcaccgtcagcagactcggaccctgaacgtnttttcgctagtgtattactgtcagcagtagtggtagctcaccgatctaccttcggaccaagggacacgacgtggagtataaccgactgtgctgcaccgtatcttgtcttctacttccttcccgcctactcgtacgagtccg

SEQ ID NO: 28638 - DNA, 517 bp, Homo sapiens
  misc_feature: GYAE6OF02IZ90I.40.39.D06.1.454.CMB.1.raw
  modified_base (417)..(417): a, c, t, g, unknown or other
  misc_feature (417)..(417): n is a, c, g, or t
  modified_base (483)..(483): a, c, t, g, unknown or other
  misc_feature (483)..(483): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcaggccactggcatcccagacaggttcagtggcaggtgggtctggacagtacttcactctcaccgtcagcagactcggaccctgaagtattttgactagtagtattactgtcagcagtagtggtanctcaccgatcctacctcggccgaaggacacgacgtggaagtacttaaccgactgtcgctcgcaccntctgtcttctactccttcccgctatctgtatccg

SEQ ID NO: 28639 - DNA, 623 bp, Homo sapiens
  misc_feature: GYAE6OF02IX3I2.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttacaacgactacttagcctggtaccatcagaaacctggccaggcctccgaggctcctcatcctacggtgccatccagcagggccacgtcggcactcccagacaggttcaggtggacaggtggtcgtgggacacgtacttccactctcctaccgtcacgcaaggtacctaggacccctaggaacgttaacgttttcgacgtaggttacgttacttacgtaggtaccaggtactaaggttacgtgggttacgccgttacaccgtactcccgtaccgttaccgggaccgaacggaccgtaccgacgtagggaactaacgttaaaccgacgttcgtcgccgtgaccctactcgtaccttcgttcttacctcttacccgtcccgtaccttactacgttacggtacgtaccgg

SEQ ID NO: 28640 - DNA, 583 bp, Homo sapiens
  misc_feature: GYAE6OF02JAF8C.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccacgtggcactcccagacaggttcagtggcagtgggtctgggacagacttcactctccaccgtcacgcagacctggaccctgaaacgtgttttgcgtaagtgttacttactgtcgagctacgtataggtagcgtcaccgtatccgtcctccggaccgaagggaccacgtacgtggacgtacgttaaccgaacttagtcggacgtcgccgtaaccacgttccttacggttctttaccgtaacttcccgttaccccgtaccacgtttacccgtgtaaccggttacccgg

SEQ ID NO: 28641 - DNA, 220 bp, Homo sapiens
  misc_feature: GYAE6OF02GPM48.40.39.D06.1.454.CMB.1.raw
  modified_base (68)..(68): a, c, t, g, unknown or other
  misc_feature (68)..(68): n is a, c, g, or t
  modified_base (183)..(220): a, c, t, g, unknown or other
  misc_feature (183)..(220): n is a, c, g, or t
tcagtctagcgactcacgaccggtgctcgattagtgacatctcgcgagttctttgggtttgggggaanaggaagactgacggtccccccaggagttcaggtgctgggcacagccggccctgggctgccctggtcaaggtctactccagtcgctagactgagcgggctggcaaggcgcatagcnnnnnnnnnnnnnnnnnnnnnnnnnnnnnnnnnnnnnn

SEQ ID NO: 28642 - DNA, 558 bp, Homo sapiens
  misc_feature: GYAE6OF02GPG8M.40.39.D06.1.454.CMB.1.raw
  modified_base (183)..(183): a, c, t, g, unknown or other
  misc_feature (183)..(183): n is a, c, g, or t
  modified_base (389)..(389): a, c, t, g, unknown or other
  misc_feature (389)..(389): n is a, c, g, or t
tcagtctagcgactcacgaccggtgctcgatttagtgacatctcgcagttctttgggggaagacaatgggtctgattcagattacatgggtgacttttctgttgtatttccaatctcagatgcccccggagaaattgtgttgacgcagtctccagacaccctgtctttgtctccaggggaaanagccaccttctcctgcaggtccagtcagagtcttaccaacgactacttagcctggtaccatcaagaacctggccaggctcccaggctcctcatctacggtgcatccagcgacgggccacgtggcactcccagaccgaggttcaggtggcaggtgggtctggacagtaccttcactctcaccgtcacgcagactcggaccctgaatntttgctagtgtattacgtgtacgagcgtagtagtggtagctacaccatcctaccgttacggaccgaaggaccacgacgtaggaacgtaactaaccgaagtcgtacgtcgtacgacgacgacttctcgttactcgtacttcccgtcccgtacctacgttcctaggtaccg

SEQ ID NO: 28643 - DNA, 760 bp, Homo sapiens
  misc_feature: GYAE6OF02J3HSE.40.39.D06.1.454.CMB.1.raw
  modified_base (214)..(214): a, c, t, g, unknown or other
  misc_feature (214)..(214): n is a, c, g, or t
tcagtctagcgactcacgaccggtgctcgatttagtgacatctcgcagttctttgggggaagacaatgggtttgattcagattacatgggtgacttttctgttgtatttccaatctcagatcgcccccggagaattgtgttgacgcagtcctccagaccaccctgtcttgtctccgaaggggaaatcgccaccttctctgcaggtccagtcagngtccttaccacgtactactcgcctggtaccatcaacgaacctggccaggtcctcccgaggtcctcctacacttccgtacggtcgccacgtccgagccgtaggccacgtcggacactacccgagaccgtaggttacgacggtcgacggtacgggttacgggtcgtacggggaacctacggtaccttccgacctccgtacccgtaaccggtcgaaccgtacgtaacgaccgtacgggtaccccgttaaggtaaacgtttgtttacggctaggtttctttaacgtaccgttgtaaccgcggtacgttagtcggttacggacgtccgtaaccggacgtaccgtaccgtacccggtccgggtaaacgaacgggtaccgacggtaacgtacggggtaacctaaaccggttaaccgtaccgtgggttacccacgtaccgaacgtacccggttaacgtccggttaccttaacccggtttaccgtaacccgtttaccccggtttaccccgaacgtttacccgttaccggttaacccgggtaaccggttaacccgg

SEQ ID NO: 28644 - DNA, 577 bp, Homo sapiens
  misc_feature: GYAE6OF02G50NJ.40.39.D06.1.454.CMB.1.raw
  modified_base (184)..(184): a, c, t, g, unknown or other
  misc_feature (184)..(184): n is a, c, g, or t
  modified_base (195)..(195): a, c, t, g, unknown or other
  misc_feature (195)..(195): n is a, c, g, or t
  modified_base (367)..(367): a, c, t, g, unknown or other
  misc_feature (367)..(367): n is a, c, g, or t
  modified_base (395)..(395): a, c, t, g, unknown or other
  misc_feature (395)..(395): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (499)..(499): a, c, t, g, unknown or other
  misc_feature (499)..(499): n is a, c, g, or t
tcagtctagcgactcacgaccggtgctcgatttagtgacatctcgcagttctttgggggaagacaatgggtttgattcagattacatgggtgactttttctgttgtatttccaatctcagatgccccccggagaaattgtgttgacgcagtctccagacaccctgtctttgtctccagggaaanagccaccttcncctgcaggtccagtcagagtcttaaccaacgactacttagcctgtaccatcaagaaacctgaccaggctcccaggctcctcatctacggtgacatccagcacgggccactggacactcccagacaggttcagtggcaggtgggctgggacagacttcactctaccgaccgtnacgcgataccgtacggacctagaagttntttgcgtagtgttaattactgtacagcaagttagnggtanctacgacgatacctaccgttccggacgaacggacgacgaagtggaacgtaacgttaacgtaacngtgctgacctaccgacttctacgttccttactacgttacccgttccccgtaactacgttaccgtaggtaccgtaccgg

SEQ ID NO: 28645 - DNA, 609 bp, Homo sapiens
  misc_feature: GYAE6OF02HHR30.40.39.D06.1.454.CMB.1.raw
  modified_base (318)..(318): a, c, t, g, unknown or other
  misc_feature (318)..(318): n is a, c, g, or t
  modified_base (353)..(353): a, c, t, g, unknown or other
  misc_feature (353)..(353): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaaccaacgactacttagcctggtaccatcagaaacctggccaggctccaggctcctcatctacggtgcatccagcacgggccacgtggcactcccagacgnggttcaggtggcagtgggtcgtgggacagtactcnctctcgaccgcacgcacgtacgtcggtacctaggtaagtttctttacgacgttagtacgttaacttacgttgtacgagtacgtaggtacgtggtactacctaccgaccgtactacctacccgtaccggaccggaaagggacccgtacgacggtaaggaacgtaacgttaaaccgacgtaggtcgtccgacgacctacgtacttcgtacgttccttactaccttcccgtcctaccgtacgtacgtacgtacgtaccg

SEQ ID NO: 28646 - DNA, 516 bp, Homo sapiens
  misc_feature: GYAE6OF02G7R66.40.39.D06.1.454.CMB.1.raw
  modified_base (181)..(181): a, c, t, g, unknown or other
  misc_feature (181)..(181): n is a, c, g, or t
  modified_base (351)..(351): a, c, t, g, unknown or other
  misc_feature (351)..(351): n is a, c, g, or t
  modified_base (413)..(413): a, c, t, g, unknown or other
  misc_feature (413)..(413): n is a, c, g, or t
  modified_base (466)..(466): a, c, t, g, unknown or other
  misc_feature (466)..(466): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctcaggggaanagccacttctcctgcaggtccagtcagagtcttaccaacgactacttagcctggtaccatcagaaacctggccaggctccaggctcctcatctacggtgcatccagcagggccatggcatcccagacaggttcagtcggctagtgggtctggggactggacttcacttcncacgtcagcagctggaccctgaacgtattttgacagttgtattactgtcagtcagtatggtnctcacgtctctaccgtcgaccgaggacacgctaggagacttaaccgatgtgcngcacgtactcttacgtcttacacgttccttccgcctatcttacgagtccg

SEQ ID NO: 28647 - DNA, 631 bp, Homo sapiens
  misc_feature: GYAE6OF02I218N.40.39.D06.1.454.CMB.1.raw
  modified_base (285)..(285): a, c, t, g, unknown or other
  misc_feature (285)..(285): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccgaggggaaagagccaccttctcctgcaggtccagtcagagtcttaccaacgactacttagcctggtaccatcagaaacctggccaggcctccaggctcctcatcgtacggngcactccagcacgggccacgtcggcactcccagactaggtcaggtggcgaggtgggtcgtgggacaggtacttcactctacaccgtcacgcaagcctacggtacccgtagtaacgttagttttagactaggttagttagttacttgtacagtacgtagttagtaggtacgtctacctaccgactccgtaccgtaccggacgaacggaccacgtaacgtacggtaacgtaacgtaaccggtaacgtacgtcggtacgtacgaccgtaccgtaacgttccgttacgttcccgttacgttccgttcccgttacccgtaccgttaactcggttacggtaccgttaaccgg

SEQ ID NO: 28648 - DNA, 844 bp, Homo sapiens
  misc_feature: GYAE6OF02HVITH.40.39.D06.1.454.CMB.1.raw
  modified_base (276)..(276): a, c, t, g, unknown or other
  misc_feature (276)..(276): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccgaggggaaagagccaccttctcctgcaggtccagtcagacgtcttaccaacgactacttagcctggtaccatcaagaaatctggccaggctcccaggctccncatctacggtgcatccacgcgacgggcccacgtgggctacgtaccccagaccgtagggtttaccagggttacggcgtagggttacggggttcgtcggggaactacggtaacctttaccgaccttaccgtccgaacccggttacgaccggacctaacgtacccgtacggggtaacccccttaaggtaaacggtttacgttttttacggaacgtaacggtttacggtttaacgtttaaccgtttcgttaaccgtaacggtacgttaacgggttaacgttacgggttaacggtaccgttacccggaaccgttaccgtaacccgttaacccggtttaacccggggaaccccggtaaacgggggaaacccgtaacccgggtaaaccggttaaccggggtaaccgttaaaaccgggtttaaaaccccggtaaacggttacggggtaccgggttacccggttacggaacccgtaacccggtaccgtttaccgttaccggttaccttttaccgtacccgtttaccccggtttaccccgtacccggttacctttacccgggtaacggttaacccggg

SEQ ID NO: 28649 - DNA, 628 bp, Homo sapiens
  misc_feature: GYAE6OF02JBNZP.40.39.D06.1.454.CMB.1.raw
  modified_base (130)..(130): a, c, t, g, unknown or other
  misc_feature (130)..(130): n is a, c, g, or t
  modified_base (143)..(143): a, c, t, g, unknown or other
  misc_feature (143)..(143): n is a, c, g, or t
  modified_base (180)..(180): a, c, t, g, unknown or other
  misc_feature (180)..(180): n is a, c, g, or t
  modified_base (371)..(371): a, c, t, g, unknown or other
  misc_feature (371)..(371): n is a, c, g, or t
  modified_base (410)..(410): a, c, t, g, unknown or other
  misc_feature (410)..(410): n is a, c, g, or t
  modified_base (485)..(485): a, c, t, g, unknown or other
  misc_feature (485)..(485): n is a, c, g, or t
  modified_base (506)..(506): a, c, t, g, unknown or other
  misc_feature (506)..(506): n is a, c, g, or t
  modified_base (572)..(572): a, c, t, g, unknown or other
  misc_feature (572)..(572): n is a, c, g, or t
  modified_base (582)..(582): a, c, t, g, unknown or other
  misc_feature (582)..(582): n is a, c, g, or t
  modified_base (587)..(587): a, c, t, g, unknown or other
  misc_feature (587)..(587): n is a, c, g, or t
  modified_base (611)..(611): a, c, t, g, unknown or other
  misc_feature (611)..(611): n is a, c, g, or t
  modified_base (623)..(623): a, c, t, g, unknown or other
  misc_feature (623)..(623): n is a, c, g, or t
tcagtctagcgactcacgaccggtgctcgatttagtgacatctcgcagttctttgggggaagacaatgggtttgattcagattacatgggtgacttttctgttgtatttccaatctcagatcgcccgganaattgtgttgacncagtctccagacaccctgtcttgtctccgaagggaancgcctaccttctcctgcacggtccagtcagtacgtccttaaccaacgtactacttacgccttaggtaccataccgaacgtaaacctggaccgaacggtccttacccgacggtcctccctagactcgtacggtgacactccagcgacggcccagtcggcaccgtccgagacgtaggttccaggtcggtacgngggtggttacgcgggaactcggtaccttccgacttaccncgacccgtgacgtcaaggtcctaccgggacctgtaagtttctttacgacgtagttacgttattaccgtgacgtanaccgttagtacgtcgggttanaccgtcgaaccgtactccgtaaccgtccggaacgaggtaccacgtagagggtaactacgttaaccngttacgcgtnacgcngtctctcttctcactcccgtaccngtctagtacgtntaccg

SEQ ID NO: 28650 - DNA, 693 bp, Homo sapiens
  misc_feature: GYAE6OF02JBD1B.40.39.D06.1.454.CMB.1.raw
  modified_base (181)..(181): a, c, t, g, unknown or other
  misc_feature (181)..(181): n is a, c, g, or t
  modified_base (282)..(282): a, c, t, g, unknown or other
  misc_feature (282)..(282): n is a, c, g, or t
  modified_base (418)..(418): a, c, t, g, unknown or other
  misc_feature (418)..(418): n is a, c, g, or t
tcagtctagcgactcacgaccggtgctcgatttagtgacatctcgcagttctttggggaagacaatgggtttgattcagattacatgggtgacttttctgttgtatttccaatctcagatgcccccggagaaattgtgttgacgcagtctccagacaccctgtcttgtctccgagggtaancgccaccttctcctgcacggtccagtcagagtccttaaccaacgactacttacgcctaggtaccatccaagaaccctggccaaggcctcccgaggtcctcncatctacggtcgcactaccgagtccgaacgggtcccaagtcggactaccgtacccaggaaccgtagggttccaggttcggcgtaggtcgggtacgtacgggactacaccgtttcgaacttccgtaccaccgggttnacgtacgacgacgtcggaccctaagtaacgtacgttttcgacgtagtacgtaactttacgtagtaccgtacgtaacgttagttacgtaggtacgtaccgtaccgtaaccgtactaccgtaaccggttccggaaccgtaacgggtaccaaccggtacgacggtaacgtaacgttaaacccggtagtacggtacgtacgtcgtaacctaccgtacgtacttcgtaaccgttcctaacgttcccgtcccgtacctacgttacgtacggtaccgtacgg

SEQ ID NO: 28651 - DNA, 671 bp, Homo sapiens
  misc_feature: GYAE6OF02FYELQ.40.39.D06.1.454.CMB.1.raw
  modified_base (271)..(271): a, c, t, g, unknown or other
  misc_feature (271)..(271): n is a, c, g, or t
  modified_base (282)..(282): a, c, t, g, unknown or other
  misc_feature (282)..(282): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctgtaccatcagaaacctgccagcctccaggctcctnactctacggtnacatccagcacggccacgtcggacactcccgagacgtacggttcaggtggctaggttcgggtctacgggactacggtacttccacgtcctcctaaccggtcaacggcaacgtacgtacggaccctaaggtaacgtttacttttacggaccgttaagttacgttaactttacgttcggttcgaacggctaaggttacgtcggtaacgtccgtaccgaccggtacttacccgtaccgttaccgggaccgtaacgggacaccggtaacgtacggtagttaaaccgttaaccgaagttcgggtacgttccgtacgtaccgaacccttgtaccgttacgttaccttactaccgttccttacccggtacctacgtttaccgaggtacgttacccg

SEQ ID NO: 28652 - DNA, 680 bp, Homo sapiens
  misc_feature: GYAE6OF02IVJ3E.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatcgcccccggagaaattgtgttgacgcagtctccagacaccctgtctttgtctccaggggaaagagccaccttctcctgcaggtccagtcagagtccttaaccaacgactactagcctgtaccatcaacgaaccgtggaccaggcctacccgaggccttccgtacactaccgtacggtagaccactaccagccgaagggcccctaacgtcgggacacctaccccgaagaccagggtttccaggtcggctaggttcgggtactgggaacagtacctttcacttccacgactacaggccaacgtaccgacggtaccctaggtaaagtttattttaccgacgttacgttaagtaacgtttacgtagtacctaaggtctaaggttatacgggttaactccgtaacgaccgtaacgtaccgtacccttaccgggaacgtaaccgggaaccaacggtacggaggtaacgtaacggttaaaccgaaagttcggacgctagacctacgtaacgtccttacgtacttacgtactttacccgtacccggcctatacgtacgtaacgtcgg

SEQ ID NO: 28653 - DNA, 698 bp, Homo sapiens
  misc_feature: GYAE6OF02GKFY0.40.39.D06.1.454.CMB.1.raw
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccgaggggaaacgagccaccttctcctgcaggtccagtcagagtcttaccgaacgactacttagcctgtaccatcagaaacctggccaggcctcccacgctcctcatcgtacgtgcatccgagcgacgggccactcggctactacccacgacgacggtttcgacgcgggtcgtaaggttcgggtcgtaggggaacctaggtaaccttccaaccgttcttaccgaccgtttcacggacacggtaccgacgggtaaccctacggtaaagttacgttttcgaccgttaagttacggttaagtttaccgttgtaccggtaacgtacgtaagttagtcgggttaacaccctacgtaacccgttcgtacctaccggttccggaccgtaaacgggacctaacggaacgttcgaacggttaacgttaacccgtaaagttcgtacgggaccttacggaccaccgtaactaccgtcgtttaccgttactaaccgttcccgttcccgtaaccgttctaaccggtacgtattacccgg

SEQ ID NO: 28654 - DNA, 919 bp, Homo sapiens
  misc_feature: GYAE6OF02ITIWL.40.39.D06.1.454.CMB.1.raw
tcagtctagcgactcacgaccggtgctcgatttagtgacatctcgcgagttctttgggggaagacaatgggtttagattcagattacatgggtgacttttctgttgtatttccaatctcagatgcccccggagaattgtgttagacgcagtcctaccagactacctgtattttgtcctaccgaggggaaagacgaccctaccgtttcctcccgtgacaacgggttcccagttccgacggtaacgttcctttaaccgaaccgtaacgttaacctttaacggcccgttacggttaaccctaacttaccgtaaaaccggtaaaaccccgttcgggaacccgtaacgggtacccttacccccggtaagggtacccttaccccggttacaaccgtttaccgttaaaccgggtcgttaccgtaaccgttaccgaccggacgtaaccgggaccctaaccggttcggaacctaccgtacccgaacggtaccgtaccggttaccgtacgtacggtcgtaacggttcggggtcgtacggggtaccagtacccgtttaccacttaccgtcctaaccgtccctaacggtacgtaacgtaacggttaacccggaccgtaaacgggtaacgtttaaacgtttcggaacggttagtttacgtttaacgtttaccgtttacggtacctaacggtaccgtaaagtttacggttacgggttacccgcgtttaacccgaaccggtatttacccggaaaccggtttcccgggaaacggtaaccgggaacctacgggtaaccttaaggtacgtaaccgttaaacccgtaagttccgggtaggtaccgtaccgacctaaaccgtcggtttacctacggttccttaccgttaacgttccccgttacccgaccggtttactaacggtttacaacggttacccg

SEQ ID NO: 28655 - DNA, 800 bp, Homo sapiens
  misc_feature: GYAE6OF02GRYVI.40.39.D06.1.454.CMB.1.raw
tcagtctagcgactcacgaccggtgctcgatttagtgacatctcgcagttctttgggggaagacaatgggtctgattcagattacatgggtgacttttctgttgtatttccaatctcagatcgcccccggagaaattgtgttgaccgcagtctccagacacctgtcttgtctccgaggggaaagagccaccttctcctgcgtaggtccagtcagacgtcttaaccaacgactacttagcctaggtaccatcaacgtaaaccgtggccacggtcctacccgaggtcctccctcacgttccgtaacggtcgactactaccgacggacgacggggtacccctacggtcggacctaaccgtacccgtaaggacggttaacgggtttacaaagggttcggggaccgttaacggggttcggggttaaccgtacgggggtaaccttaacggtaacccgtttaccggaacccttacccggtaccgtaacccggtacgaacggtaccgaacggttacccgtacgggtaaccctagggtaaacgtttcgtttacggacgttaacggttacgttaacgttaaccgtacggtacgtacggttacgtaggtttacgtacggttacggtaccctacggacccgtaaccttaccggtaccgttaccggaaccgtaaaccgggtcgaaccggtacgtacgggtaacgttaaccgtaacgtaccggtgtaccggctaccgtaccgtaacgtaacgtttcgtacgtaccgtttacgtacgttccccgacccgttactaccgttacggtacctaaccgg

SEQ ID NO: 28656 - DNA, 609 bp, Homo sapiens
  misc_feature: GYAE6OF02FZFKE.40.39.D06.1.454.CMB.1.raw
  modified_base (288)..(288): a, c, t, g, unknown or other
  misc_feature (288)..(288): n is a, c, g, or t
  modified_base (361)..(361): a, c, t, g, unknown or other
  misc_feature (361)..(361): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagaccccctgtctttgtctccaggggaaagagccaccttctcctgcaggtccagtcagagtcttaccaacgactacttagcctggtaccatcagaacctggccaggctccaggctcctcatctacggtgcatccngcacgggcccacgtggacactcccaaggacaggttcaggtggcaggtgggtcgtgggacagaccttcacctcncctaccgtcagcagactcggaccctagaacgtactttgacgtagttagtagttactgtacagtactagttagtgtagtctacgacgtatcctacgttccggaccgaacgggaacgaccggagtacggtaacgtaacgttaaccgtaacgtcggtacggtccgacgtccgtactcgttccgtacgtttccgttacgtaccgttcccgttacccgccttaccgtaccgtacggttacgtccggttaaccg

SEQ ID NO: 28657 - DNA, 765 bp, Homo sapiens
  misc_feature: GYAE6OF02JXYXS.40.39.D06.1.454.CMB.1.raw
tcagtctagcgactcacgaccggtgctcgatttagtgacatctcgcagttctttggggaagacaatgggtttgattcagattacatgggtgacttttctgttgtatttccaatctcagatgcccccggagaaattgtgttgacgcagtctccagacaccctgtctttgtctccagggaaagagccaccttctcctgccaggtccagtcagagtcttaccaacgactacttagcctggtaccatcagaaacctggaccaggcctcccgaggctcctctactaccttacggtgctactccacggaccgtacgggcccaacgtcggcctaaccgtccccgaaggtacctaacgggtttcaaacggttcggaccgaggttccggggtcgtaacgggggaacctaggtacccttacgaccgttcctaccgtaacccgtacgacgtccgtaacgtaccggttacccgggaccgttaacggtaacgttacgtttttcgggaaccgttaggttaacgggtttaaccttttacggtaggtacgtaacggtaccgtaggttagttacgggtaacgttacttacccgaacgttaaccgtaccttacccggtttaccgggaccggtaaacgggtaaccctaccggtaacgttaaggaacgttaaaccgttaacccggaagttacgggtacgtacgtccgtaacctacggtcttacgttcgttaccgttctaaccgttcccgtacccggtaccttagttacccgtagaccgttaccgg

SEQ ID NO: 28658 - DNA, 642 bp, Homo sapiens
  misc_feature: GYAE6OF02F7DFV.40.39.D06.1.454.CMB.1.raw
  modified_base (183)..(183): a, c, t, g, unknown or other
  misc_feature (183)..(183): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (373)..(373): a, c, t, g, unknown or other
  misc_feature (373)..(373): n is a, c, g, or t
  modified_base (375)..(375): a, c, t, g, unknown or other
  misc_feature (375)..(375): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattgtgttgacgcagtctccagacaccctgtctttgtctccgagggaaanagccaccttctcctgcaggtccagtcagagtcttaccaagactacttagcctaggtaccatcaagaaacctggccaggcctcccgaggctcctnatctacggtnacatccagcagggccacgtggctactccccgaagacaggttacaggtgacaggtcggtctagggacagacttcgactcacaccgtnancaagctacggacctaggtaaatcgttttacgcgtagttacgttaacttacgtggtactaacggcgtaagtaacgtaggttaacgtaccgtacctaacggtacttacccgtaacccggtttaccggaaccggtaaaggggacctaaccggtacgtacggaacgttaaccgtaaaccgtaccgtggtacgtaccgtacaccgtacctaagttccgtaagttcccgtactacgttcccgtacccgtactaacgtcgtaggaccgttaacg

SEQ ID NO: 28659 - DNA, 696 bp, Homo sapiens
  misc_feature: GYAE6OF02G6ORF.40.39.D06.1.454.CMB.1.raw
  modified_base (183)..(183): a, c, t, g, unknown or other
  misc_feature (183)..(183): n is a, c, g, or t
  modified_base (420)..(420): a, c, t, g, unknown or other
  misc_feature (420)..(420): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaaattggtgttgacgcagtctaccagacaccctgtctttgctcaggggaaancgccacttctcctgcaggtccagtcagagtacttaccaacgactactacgcctggtaccatcagaaacctggccaggcctcccgaggtcctcctcactcgtacggtcactactccgaaggccgacggggccctacgtgggacccacgttccccgaaggtaccgtaggttaccagggttcggcgtaagggttcgggtcgtacggggactaacgtccttacgaccttcgtccaaccgtnaacggtccaagtaccgtaccgggtaacccaggttaagtacttttcgacgttaggttacgttaacgttacgtcggttaccgaagtacgtaaggttagttacggttactaccgtaccgtaccgtactcctaccgtaccggaaccgtaacgggtaccgacgtacgtacggtaacgttaaccgtaaccggtacgtcggtacgtacgttacgccgtaacgtctacgttcttaccgtttccacgtttcccgtacccgtactaccgtcgtaccgtacgtaccg

SEQ ID NO: 28660 - DNA, 716 bp, Homo sapiens
  misc_feature: GYAE6OF02IJTIY.40.39.D06.1.454.CMB.1.raw
  modified_base (210)..(210): a, c, t, g, unknown or other
  misc_feature (210)..(210): n is a, c, g, or t
  modified_base (262)..(262): a, c, t, g, unknown or other
  misc_feature (262)..(262): n is a, c, g, or t
  modified_base (265)..(265): a, c, t, g, unknown or other
  misc_feature (265)..(265): n is a, c, g, or t
  modified_base (281)..(281): a, c, t, g, unknown or other
  misc_feature (281)..(281): n is a, c, g, or t
tcagtctagcgactcacgaccggtgctcgatttagtgacatctcgcgagttctttgggggaagacaatgggtttgattcagatttacatgggtgactttctgttgtattccatctcagatgcccccggagaaattgtgttgacgcagtctccagacaccctgtcttgtctccagggaagagccaccttctccgtagcaggtccagtcagngtcttaccacgactactagcctggtacatcagaactgcagctccaggctccncancgtacgtgctagtccnggctacgggcccacgtgggacacgtcccgagacctggttcgagttcggcgtaggtggtcgtaaggggtacagtaaccgttctaacgtccgttacaacccggggttcaacggtaccgaacggttaccgttaaccgggcccccgttaaggtaaaccgtgtttttacggacgtaacgttcggttaaacgtttcgtacgtcgtacgcgttaggttacgtgggtacctacggttacgaaccgacgtaccgttacccgttacggtaacggtaacgtaacccgttacggaacccgtacggttaacggttaaaccgttaacggttaccgaagggttaccgtccgttaccggtaacctccgttaaacgtcccggttacgttacccggtttactacccgttccggttaccccggtccgtatttaccggtacggtaccgttacccg

SEQ ID NO: 28661 - DNA, 820 bp, Homo sapiens
  misc_feature: GYAE6OF02HK8FA.40.39.D06.1.454.CMB.1.raw
  modified_base (206)..(206): a, c, t, g, unknown or other
  misc_feature (206)..(206): n is a, c, g, or t
tcagtctagcgactcacgaccggtgctcgatttagtgacatctcgcagttctttgggggaagacaatgggtttgattcagattacatgggtgacttttctgttgttatttccaatctcagatcgcccccggagaaattgtgttgacgcagtctccagacaccctgttctttgtctccgaggggaaagacgcctaccttctcctgcnggtccagtcagagtcttaccaacgtactactacgcctggtaccatacgtaagaacctggaccacggcctccgacggtcctcctaccattccgtacggtcgcacgtccaggcgacgggcctacgtcggacaccgtcccaagtaccgtacgttacaggtacgggcttaggtcgggttacgtacggggactacggtaaccgttccaccttcgcccgtaaccgtcgaacgacgtacggtaaccctcggtaccctagggtaaaccttagtttccggaacgtaggtttaacgttaacggttttacgtactttacggaaacgtcgttaagttacgggttaagggtacgtaccgtaccggaacccgttacccgtttaccgaaccggtttacccggaaaccgggtaaccgggtaaccgtaaccgggtaacgtacgggttaacggtaacccgttaaaccggttaaaccggtcggtaccgggtaacccgttaccggaacccgttaccggttaacgtttcccgggtttacttacccccgttttaaaccgtttcccccggtttaaaccgttaccccccggttacgttaacccgttaccggttacccggttaacccgtttaacccggg

SEQ ID NO: 28662 - DNA, 673 bp, Homo sapiens
  misc_feature: GYAE6OF02JQHJQ.40.39.D06.1.454.CMB.1.raw
  modified_base (183)..(183): a, c, t, g, unknown or other
  misc_feature (183)..(183): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
  modified_base (372)..(372): a, c, t, g, unknown or other
  misc_feature (372)..(372): n is a, c, g, or t
tcagtctagcgactcacgaccggtgctcgatttagtgacatctcgcagttctttgggggaagacaatgggtttgattcagattacatgggtgacttttctgttgtatttccaatctcagatgcccccggagaattgtgttgacgcagtctccagacaccctgtccttgtcctccaggggaaanagccaccttctcctgacaggtccagtcagtgtcttaccacgactacgttgcctggtacatacagaacctggaccaggctccagctccnatctagncatcagctcggccagnggcactacccgagaccgtaggttcagtggacgaggtcgggtactagggactagtaccttcactcgtaccacgttgacncaaggtacctacggaccctagaagtttcttacgcgttactaggttaactacgttacggtccgagtagttaaaccggttagtacgggtactaccgttacgaacccggttacgttaccgttaccccggttacgaaccgggtaaaccggttacaacccgggttacggtaccggtaaacgttaaccgttaaaccggacgttcgggtaccgttccacgttaccggacctaagtttcccgacgtttccgtaaccctcgttacccccgttcggttaccctaggttacccggtaacgttccggaacccg

SEQ ID NO: 28663 - DNA, 171 bp, Homo sapiens
  misc_feature: GYAE6OF01AZ56X.35.57.F02.1.454.CMB.1.raw
  modified_base (171)..(171): a, c, t, g, unknown or other
  misc_feature (171)..(171): n is a, c, g, or t
tcagtacagatcgtcacgaccggtgctcgatttagctcgatatagttgggtttggggaagaggaagactgacggtccccaggagttcaggtgctgggcacagcggccctgggctgcctggtcaaggactacttccacgatctgtactgagcgggctggcaaggcgcatagn

SEQ ID NO: 28664 - DNA, 172 bp, Homo sapiens
  misc_feature: GYAE6OF01D0ITG.35.57.F02.1.454.CMB.1.raw
  modified_base (170)..(172): a, c, t, g, unknown or other
  misc_feature (170)..(172): n is a, c, g, or t
tcagtacagatcgtcacgaccggtgctcgatttagctcgatatagttgggtttggggaagaggaagactgacggtccccaggagttcaggtgctggcacagcggccctgggctgcctggtcaaggactacttccacgatctgtactgagcgggctggcaaggcgcatagnnn

SEQ ID NO: 28665 - DNA, 172 bp, Homo sapiens
  misc_feature: GYAE6OF01EJ427.35.57.F02.1.454.CMB.1.raw
  modified_base (172)..(172): a, c, t, g, unknown or other
  misc_feature (172)..(172): n is a, c, g, or t
tcagtacagatcgtcacgaccggtgctcgatttagctcgatatagttgggtttgggggaagaggaagactgacggtcccccaggagttcaggtgctggcacagcggccctgggctgcctggtcaaggactacttccacgatctgtactgagcgggctggcaaggcgcatagn

SEQ ID NO: 28666 - DNA, 179 bp, Homo sapiens
  misc_feature: GYAE6OF01DO7OI.35.57.F02.1.454.CMB.1.raw
  modified_base (167)..(179): a, c, t, g, unknown or other
  misc_feature (167)..(179): n is a, c, g, or t
tcagtacagatcgtcacgaccggtgctcgatttagctcgatatagttgggtttggggaagaggaagactgacggtccccaggagttcaggtgctggcacagcggcctggctgcctggtcaaggctacttccacgatctgtactgagcgggctggcaaggcgcatagnnnnnnnnnnnnn

SEQ ID NO: 28667 - DNA, 172 bp, Homo sapiens
  misc_feature: GYAE6OF01CXNSO.35.57.F02.1.454.CMB.1.raw
  modified_base (171)..(172): a, c, t, g, unknown or other
  misc_feature (171)..(172): n is a, c, g, or t
tcagtacagatcgtcacgaccggtgctcgatttagctcgatatagttgggtttggggaagaggaagactgacggtccccaggagttcaggtgctgggcacagcggccctgggctgcctggtcaaggactacttccacgatctgtactgagcgggctggcaaggcgcatagnn

SEQ ID NO: 28668 - DNA, 181 bp, Homo sapiens
  misc_feature: GYAE6OF01C9I0Z.35.57.F02.1.454.CMB.1.raw
  modified_base (172)..(181): a, c, t, g, unknown or other
  misc_feature (172)..(181): n is a, c, g, or t
tcagtacagatcgtcacgaccggtgctcgatttagctcgatatagttgggttttggggaagaggaagactgacggtccccaggagttcaggtgctgggcacagcggccctgggctgcctggtcaaggactacttccacgatctgtactgagcgggctggcaaggcgcatagnnnnnnnnnn

SEQ ID NO: 28669 - DNA, 174 bp, Homo sapiens
  misc_feature: GYAE6OF01C1B7C.35.57.F02.1.454.CMB.1.raw
  modified_base (174)..(174): a, c, t, g, unknown or other
  misc_feature (174)..(174): n is a, c, g, or t
tcagtacagatcgtcacgaccggtgctcgatttagctcgatatagttgggttttgggggaagaggaagactgacggtcccccaggagttcaggtgctgggcacagcggccctgggctgcctggtcaaggactacttccacgatctgtactgagcgggctggcaaggcgcatagn

SEQ ID NO: 28670 - DNA, 178 bp, Homo sapiens
  misc_feature: GYAE6OF01DJNSC.35.57.F02.1.454.CMB.1.raw
  modified_base (171)..(178): a, c, t, g, unknown or other
  misc_feature (171)..(178): n is a, c, g, or t
tcagtacagatcgtcacgaccggtgctcgatttagctcgatatagttgggtttggggaagaggaagactgacggtccccaggagttcaggtgctgggcacagcggccctgggctgcctggtcaaggactacttccacgatctgtactgagcgggctggcaaggcgcatagnnnnnnnn

SEQ ID NO: 28671 - DNA, 192 bp, Homo sapiens
  misc_feature: GYAE6OF01BT69D.35.57.F02.1.454.CMB.1.raw
  modified_base (174)..(192): a, c, t, g, unknown or other
  misc_feature (174)..(192): n is a, c, g, or t
tcagtacagatcgtcacgaccggtgctcgatttagctcgatataggttgggtttgggggaagaggaagactgacggtcccccaggagttcaggtgctggacacagcggccctgggctgcctggtcaaggactacttccacgatctgtactgagcgggctggcaaggcgcatagnnnnnnnnnnnnnnnnnnn

SEQ ID NO: 28672 - DNA, 174 bp, Homo sapiens
  misc_feature: GYAE6OF01CDEOF.35.57.F02.1.454.CMB.1.raw
  modified_base (173)..(174): a, c, t, g, unknown or other
  misc_feature (173)..(174): n is a, c, g, or t
tcagtacagatcgtcacgaccggtgctcgatttagctcgatatagttgggtttgggggaagaggaagactgacggtcccccaggagttcaggtgctgggcacagcggccctgggctgcctggtcaaggactacttccacgatctgtactgagcgggctggcaaggcgcatagnn

SEQ ID NO: 28673 - DNA, 175 bp, Homo sapiens
  misc_feature: GYAE6OF01BJV87.35.57.F02.1.454.CMB.1.raw
  modified_base (173)..(175): a, c, t, g, unknown or other
  misc_feature (173)..(175): n is a, c, g, or t
tcagtacagatcgtcacgaccggtgctcgatttagctcgatatagttgggtttgggggaagaggaagactgacggtcccccaggagttcaggtgctgggcacagcggccctgggctgcctggtcaaggactacttccacgatctgtactgagcgggctggcaaggcgcatagnnn

SEQ ID NO: 28674 - DNA, 175 bp, Homo sapiens; identical to SEQ ID NO: 28673
  misc_feature: GYAE6OF01CKOV4.35.57.F02.1.454.CMB.1.raw
  modified_base (173)..(175): a, c, t, g, unknown or other
  misc_feature (173)..(175): n is a, c, g, or t

SEQ ID NO: 28675 - DNA, 174 bp, Homo sapiens; identical to SEQ ID NO: 28672
  misc_feature: GYAE6OF01AFMIT.35.57.F02.1.454.CMB.1.raw
  modified_base (173)..(174): a, c, t, g, unknown or other
  misc_feature (173)..(174): n is a, c, g, or t

SEQ ID NO: 28676 - DNA, 175 bp, Homo sapiens
  misc_feature: GYAE6OF01CEA4K.35.57.F02.1.454.CMB.1.raw
  modified_base (174)..(175): a, c, t, g, unknown or other
  misc_feature (174)..(175): n is a, c, g, or t
tcagtacagatcgtcacgaccggtgctcgatttagctcgatatagttgggttttgggggaagaggaagactgacggtcccccaggagttcaggtgctgggcacagcggccctgggctgcctggtcaaggactacttccacgatctgtactgagcgggctggcaaggcgcatagnn

SEQ ID NO: 28677 - DNA, 175 bp, Homo sapiens; identical to SEQ ID NO: 28676
  misc_feature: GYAE6OF01ALJ68.35.57.F02.1.454.CMB.1.raw
  modified_base (174)..(175): a, c, t, g, unknown or other
  misc_feature (174)..(175): n is a, c, g, or t

SEQ ID NO: 28678 - DNA, 174 bp, Homo sapiens; identical to SEQ ID NO: 28672
  misc_feature: GYAE6OF01EQIYE.35.57.F02.1.454.CMB.1.raw
  modified_base (173)..(174): a, c, t, g, unknown or other
  misc_feature (173)..(174): n is a, c, g, or t

SEQ ID NO: 28679 - DNA, 193 bp, Homo sapiens
  misc_feature: GYAE6OF01CDXQG.35.57.F02.1.454.CMB.1.raw
  modified_base (176)..(193): a, c, t, g, unknown or other
  misc_feature (176)..(193): n is a, c, g, or t
tcagtacagatcgtcacgaccggtgctcgatttagctcgatataggttgggtttgggggaaggaggaagactgacggtcccccaggagttcaggtgctgggcaccagcggccctgggctgcctggtcaaggctacttccacgatctgtactgagcgggctaggcaaggcgcatagnnnnnnnnnnnnnnnnnn

SEQ ID NO: 28680 - DNA, 175 bp, Homo sapiens; identical to SEQ ID NO: 28676
  misc_feature: GYAE6OF01CN61O.35.57.F02.1.454.CMB.1.raw
  modified_base (174)..(175): a, c, t, g, unknown or other
  misc_feature (174)..(175): n is a, c, g, or t

SEQ ID NO: 28681 - DNA, 173 bp, Homo sapiens
  misc_feature: GYAE6OF01D9LYX.35.57.F02.1.454.CMB.1.raw
  modified_base (173)..(173): a, c, t, g, unknown or other
  misc_feature (173)..(173): n is a, c, g, or t
tcagtacagatcgtcacgaccggtgctcgatttagctcgatatagttgggtttgggggaagaggaagactgacggtcccccaggagttcaggtgctgggcacagcggccctgggctgcctggtcaaggactacttccacgatctgtactgagcgggctggcaaggcgcatagn

SEQ ID NO: 28682 - DNA, 174 bp, Homo sapiens; identical to SEQ ID NO: 28672
  misc_feature: GYAE6OF01D3P30.35.57.F02.1.454.CMB.1.raw
  modified_base (173)..(174): a, c, t, g, unknown or other
  misc_feature (173)..(174): n is a, c, g, or t

SEQ ID NO: 28683 - DNA, 189 bp, Homo sapiens
  misc_feature: GYAE6OF01D8TN5.35.57.F02.1.454.CMB.1.raw
  modified_base (171)..(189): a, c, t, g, unknown or other
  misc_feature (171)..(189): n is a, c, g, or t
tcagtacagatcgtcacgaccggtgctcgatttagctcgatatagttgggttgggggaagaggaagactgacggtcccccaggagttcaggtgctggacacagcggccctgggctgcctggtcaaggctacttccacgatctgtactgagcgggctggcaaggcgcatagnnnnnnnnnnnnnnnnnnn

SEQ ID NO: 28684 - DNA, 176 bp, Homo sapiens
  misc_feature: GYAE6OF01BLXUD.35.57.F02.1.454.CMB.1.raw
  modified_base (174)..(176): a, c, t, g, unknown or other
  misc_feature (174)..(176): n is a, c, g, or t
tcagtacagatcgtcacgaccggtgctcgatttagctcgatatagttgggttttgggggaagaggaagactgacggtcccccaggagttcaggtgctgggcacagcggccctgggctgcctggtcaaggactacttccacgatctgtactgagcgggctggcaaggcgcatagnnn

SEQ ID NO: 28685 - DNA, 176 bp, Homo sapiens
  misc_feature: GYAE6OF01A35DE.35.57.F02.1.454.CMB.1.raw
  modified_base (173)..(176): a, c, t, g, unknown or other
  misc_feature (173)..(176): n is a, c, g, or t
tcagtacagatcgtcacgaccggtgctcgatttagctcgatatagttgggtttgggggaagaggaagactgacggtcccccaggagttcaggtgctgggcacagcggccctgggctgcctggtcaaggactacttccacgatctgtactgagcgggctggcaaggcgcatagnnnn

SEQ ID NO: 28686 - DNA, 174 bp, Homo sapiens; identical to SEQ ID NO: 28669
  misc_feature: GYAE6OF01B6RXG.35.57.F02.1.454.CMB.1.raw
  modified_base (174)..(174): a, c, t, g, unknown or other
  misc_feature (174)..(174): n is a, c, g, or t

SEQ ID NO: 28687 - DNA, 174 bp, Homo sapiens
  misc_feature: GYAE6OF01DQ94X.35.57.F02.1.454.CMB.1.raw
  modified_base (174)..(174): a, c, t, g, unknown or other
  misc_feature (174)..(174): n is a, c, g, or t
tcagtacagatcgtcacgaccggtgctcgatttagctcgatatagttgggtttgggggaagaggaagactgaccggtcccccaggagttcaggtgctgggcacagcggccctgggctgcctggtcaaggactacttccacgatctgtactgagcgggctggcaaggcgcatagn

SEQ ID NO: 28688 - DNA, 173 bp, Homo sapiens; identical to SEQ ID NO: 28681
  misc_feature: GYAE6OF01CP6IB.35.57.F02.1.454.CMB.1.raw
  modified_base (173)..(173): a, c, t, g, unknown or other
  misc_feature (173)..(173): n is a, c, g, or t

SEQ ID NO: 28689 - DNA, 191 bp, Homo sapiens
  misc_feature: GYAE6OF01BUMKT.35.57.F02.1.454.CMB.1.raw
  modified_base (180)..(191): a, c, t, g, unknown or other
  misc_feature (180)..(191): n is a, c, g, or t
tcagtacagatcgtcacgaccggtgctcgatttagctcgatatagttgggttttggggggaaggaggaagactgatcggtccccccaggagttcaggtgctgggcacgagcggccctgggctgcctggtcaaggactacttccacgatcgtgtactgagcgggctggcaaggcgcatagnnnnnnnnnnnn

SEQ ID NO: 28690 - DNA, 175 bp, Homo sapiens; identical to SEQ ID NO: 28673
  misc_feature: GYAE6OF01A8JLD.35.57.F02.1.454.CMB.1.raw
  modified_base (173)..(175): a, c, t, g, unknown or other
  misc_feature (173)..(175): n is a, c, g, or t

SEQ ID NO: 28691 - DNA, 177 bp, Homo sapiens
  misc_feature: GYAE6OF01CBD2K.35.57.F02.1.454.CMB.1.raw
  modified_base (174)..(177): a, c, t, g, unknown or other
  misc_feature (174)..(177): n is a, c, g, or t
tcagtacagatcgtcacgaccggtgctcgatttagctcgatatagttgggttttgggggaagaggaagactgacggtcccccaggagttcaggtgctgggcacagcggccctgggctgcctggtcaaggactacttccacgatctgtactgagcgggctggcaaggcgcatagnnnn

SEQ ID NO: 28692 - DNA, 175 bp, Homo sapiens; identical to SEQ ID NO: 28676
  misc_feature: GYAE6OF01DG8YF.35.57.F02.1.454.CMB.1.raw
  modified_base (174)..(175): a, c, t, g, unknown or other
  misc_feature (174)..(175): n is a, c, g, or t

SEQ ID NO: 28693 - DNA, 175 bp, Homo sapiens; identical to SEQ ID NO: 28676
  misc_feature: GYAE6OF02INI8F.35.57.F02.1.454.CMB.1.raw
  modified_base (174)..(175): a, c, t, g, unknown or other
  misc_feature (174)..(175): n is a, c, g, or t

SEQ ID NO: 28694 - DNA, 174 bp, Homo sapiens
  misc_feature: GYAE6OF02HMFME.35.57.F02.1.454.CMB.1.raw
  modified_base (173)..(174): a, c, t, g, unknown or other
  misc_feature (173)..(174): n is a, c, g, or t
tcagtacagatcgtcacgaccggtgctcgatttagctcgatatagttgggttttggggaagaggaagactgacggtcccccaggagttcaggtgctgggcacagcggccctgggctgcctggtcaaggactacttccacgatctgtactgagcgggctggcaaggcgcatagnn

SEQ ID NO: 28695 - DNA, 172 bp, Homo sapiens
  misc_feature: GYAE6OF02GCRCK.35.57.F02.1.454.CMB.1.raw
  modified_base (172)..(172): a, c, t, g, unknown or other
  misc_feature (172)..(172): n is a, c, g, or t
tcagtacagatcgtcacgaccggtgctcgatttagctcgatatagttgggtttgggggaagaggaagactgacggtcccccaggagttcaggtgctgggcacagcggccctgggctgcctggtcaaggactacttccagatctgtactgagcgggctggcaaggcgcatagn

SEQ ID NO: 28696 - DNA, 185 bp, Homo sapiens
  misc_feature: GYAE6OF02F47JX.35.57.F02.1.454.CMB.1.raw
  modified_base (174)..(185): a, c, t, g, unknown or other
  misc_feature (174)..(185): n is a, c, g, or t
tcagtacagatcgtcacgaccggtgctcgatttagctcgatatagttgggttttgggggaagaggaagactgacggtcccccaggagttcaggtgctgggcacagcggccctgggctgcctggtcaaggactacttccacgatctgtactgagcgggctggcaaggcgcatagnnnnnnnnnnnn

SEQ ID NO: 28697 - DNA, 192 bp, Homo sapiens; identical to SEQ ID NO: 28671
  misc_feature: GYAE6OF02F3QO4.35.57.F02.1.454.CMB.1.raw
  modified_base (174)..(192): a, c, t, g, unknown or other
  misc_feature (174)..(192): n is a, c, g, or t

SEQ ID NO: 28698 - DNA, 171 bp, Homo sapiens; identical to SEQ ID NO: 28663
  misc_feature: GYAE6OF02HNG5F.35.57.F02.1.454.CMB.1.raw
  modified_base (171)..(171): a, c, t, g, unknown or other
  misc_feature (171)..(171): n is a, c, g, or t

SEQ ID NO: 28699 - DNA, 173 bp, Homo sapiens; identical to SEQ ID NO: 28681
  misc_feature: GYAE6OF02GHMG8.35.57.F02.1.454.CMB.1.raw
  modified_base (173)..(173): a, c, t, g, unknown or other
  misc_feature (173)..(173): n is a, c, g, or t

SEQ ID NO: 28700 - DNA, 175 bp, Homo sapiens; identical to SEQ ID NO: 28676
  misc_feature: GYAE6OF02IHT2T.35.57.F02.1.454.CMB.1.raw
  modified_base (174)..(175): a, c, t, g, unknown or other
  misc_feature (174)..(175): n is a, c, g, or t

SEQ ID NO: 28701 - DNA, 175 bp, Homo sapiens; identical to SEQ ID NO: 28676
  misc_feature: GYAE6OF02I04XI.35.57.F02.1.454.CMB.1.raw
  modified_base (174)..(175): a, c, t, g, unknown or other
  misc_feature (174)..(175): n is a, c, g, or t

SEQ ID NO: 28702 - DNA, 187 bp, Homo sapiens
  misc_feature: GYAE6OF02HOK7A.35.57.F02.1.454.CMB.1.raw
  modified_base (174)..(187): a, c, t, g, unknown or other
  misc_feature (174)..(187): n is a, c, g, or t
tcagtacagatcgtcacgaccggtgctcgatttagctcgatataggttgggtttgggggaagaggaagactgacggtcccccaggagttcaggtgctggacacagcggccctgggctgcctggtcaaggactacttccacgatctgtactgagcgggctggcaaggcgcatagnnnnnnnnnnnnnn

SEQ ID NO: 28703 - DNA, 181 bp, Homo sapiens
  misc_feature: GYAE6OF02IYLJM.35.57.F02.1.454.CMB.1.raw
  modified_base (173)..(181): a, c, t, g, unknown or other
  misc_feature (173)..(181): n is a, c, g, or t
tcagtacagatcgtcacgaccggtgctcgatttagctcgatatagttgggtttgggggaagaggaagactgacggtcccccaggagttcaggtgctgggcacagcggccctgggctgcctggtcaaggactacttccacgatctgtactgagcgggctggcaaggcgcatagnnnnnnnnn

SEQ ID NO: 28704 - DNA, 194 bp, Homo sapiens
  misc_feature: GYAE6OF02HL7R7.35.57.F02.1.454.CMB.1.raw
  modified_base (172)..(194): a, c, t, g, unknown or other
  misc_feature (172)..(194): n is a, c, g, or t
tcagtacagatcgtcacgaccggtgctcgatttagctcgatatagttgggtttgggggaagaggaagactgacggtcccccaggagttcaggtgctgggcacagcggccctgggctgcctggtcaaggactacttccacgatctgtactgagcggctggcaaggcgcatagnnnnnnnnnnnnnnnnnnnnnnn

SEQ ID NO: 28705 - DNA, 173 bp, Homo sapiens; identical to SEQ ID NO: 28681
  misc_feature: GYAE6OF02HQMLK.35.57.F02.1.454.CMB.1.raw
  modified_base (173)..(173): a, c, t, g, unknown or other
  misc_feature (173)..(173): n is a, c, g, or t

SEQ ID NO: 28706 - DNA, 175 bp, Homo sapiens; identical to SEQ ID NO: 28676
  misc_feature: GYAE6OF02FM253.35.57.F02.1.454.CMB.1.raw
  modified_base (174)..(175): a, c, t, g, unknown or other
  misc_feature (174)..(175): n is a, c, g, or t

SEQ ID NO: 28707 - DNA, 174 bp, Homo sapiens; identical to SEQ ID NO: 28672
  misc_feature: GYAE6OF02GQONW.35.57.F02.1.454.CMB.1.raw
  modified_base (173)..(174): a, c, t, g, unknown or other
  misc_feature (173)..(174): n is a, c, g, or t

SEQ ID NO: 28708 - DNA, 175 bp, Homo sapiens; identical to SEQ ID NO: 28676
  misc_feature: GYAE6OF02FTPM4.35.57.F02.1.454.CMB.1.raw
  modified_base (174)..(175): a, c, t, g, unknown or other
  misc_feature (174)..(175): n is a, c, g, or t

SEQ ID NO: 28709 - DNA, 177 bp, Homo sapiens; identical to SEQ ID NO: 28691
  misc_feature: GYAE6OF02H57SV.35.57.F02.1.454.CMB.1.raw
  modified_base (174)..(177): a, c, t, g, unknown or other
  misc_feature (174)..(177): n is a, c, g, or t

SEQ ID NO: 28710 - DNA, 174 bp, Homo sapiens; identical to SEQ ID NO: 28672
  misc_feature: GYAE6OF02G0MVM.35.57.F02.1.454.CMB.1.raw
  modified_base (173)..(174): a, c, t, g, unknown or other
  misc_feature (173)..(174): n is a, c, g, or t

SEQ ID NO: 28711 - DNA, 179 bp, Homo sapiens
  misc_feature: GYAE6OF02H2K0F.35.57.F02.1.454.CMB.1.raw
  modified_base (174)..(179): a, c, t, g, unknown or other
  misc_feature (174)..(179): n is a, c, g, or t
tcagtacagatcgtcacgaccggtgctcgatttagctcgatatagttgggttttgggggaagaggaagactgacggtcccccaggagttcaggtgctgggcacagcggccctgggctgcctggtcaaggactacttccacgatctgtactgagcgggctggcaaggcgcatagnnnnnn

SEQ ID NO: 28712 - DNA, 173 bp, Homo sapiens; identical to SEQ ID NO: 28681
  misc_feature: GYAE6OF02GVD7X.35.57.F02.1.454.CMB.1.raw
  modified_base (173)..(173): a, c, t, g, unknown or other
  misc_feature (173)..(173): n is a, c, g, or t

SEQ ID NO: 28713 - DNA, 175 bp, Homo sapiens
  misc_feature: GYAE6OF02HSYXE.35.57.F02.1.454.CMB.1.raw
  modified_base (173)..(175): a, c, t, g, unknown or other
  misc_feature (173)..(175): n is a, c, g, or t
tcagtacagatcgtcacgaccggtgctcgatttagctcgatatagttggttttgggggaagaggaagactgacggtcccccaggagttcaggtgctgggcacagcggccctgggctgcctggtcaaggactacttccacgatctgtactgagcgggctggcaaggcgcatagnnn

SEQ ID NO: 28714 - DNA, 178 bp, Homo sapiens
  misc_feature: GYAE6OF02GYSQ0.35.57.F02.1.454.CMB.1.raw
  modified_base (175)..(178): a, c, t, g, unknown or other
  misc_feature (175)..(178): n is a, c, g, or t
tcagtacagatcgtcacgaccggtgctcgatttagctcgatatagttgggttttgggggaagaggaagactgacggtccccccaggagttcaggtgctgggcacagcggccctgggctgcctggtcaaggactacttccacgatctgtactgagcgggctggcaaggcgcatagnnnn

SEQ ID NO: 28715 - DNA, 175 bp, Homo sapiens; identical to SEQ ID NO: 28673
  misc_feature: GYAE6OF02I4P3W.35.57.F02.1.454.CMB.1.raw
  modified_base (173)..(175): a, c, t, g, unknown or other
  misc_feature (173)..(175): n is a, c, g, or t

SEQ ID NO: 28716 - DNA, 204 bp, Homo sapiens
  misc_feature: GYAE6OF02HVGYC.35.57.F02.1.454.CMB.1.raw
  modified_base (173)..(204): a, c, t, g, unknown or other
  misc_feature (173)..(204): n is a, c, g, or t
tcagtacagatcgtcacgaccggtgctcgatttagctcgatatagttgggtttgggggaagaggaagactgacggtcccccaggagttcaggtgctgggcacagcggccctgggctgcctggtcaaggactacttccacgatctgtactgagcgggctggcaaggcgcatagnnnnnnnnnnnnnnnnnnnnnnnnnnnnnnnn

SEQ ID NO: 28717 - DNA, 175 bp, Homo sapiens; identical to SEQ ID NO: 28676
  misc_feature: GYAE6OF02FRN26.35.57.F02.1.454.CMB.1.raw
  modified_base (174)..(175): a, c, t, g, unknown or other
  misc_feature (174)..(175): n is a, c, g, or t

SEQ ID NO: 28718 - DNA, 181 bp, Homo sapiens
  misc_feature: GYAE6OF02JGJD4.35.57.F02.1.454.CMB.1.raw
  modified_base (174)..(181): a, c, t, g, unknown or other
  misc_feature (174)..(181): n is a, c, g, or t
tcagtacagatcgtcacgaccggtgctcgatttagctcgatatagttgggtttgggggaaggaggaagactgacggtcccccaggagttcaggtgctgggcacagcggccctgggctgcctggtcaaggactacttccacgatctgtactgagcgggctggcaaggcgcatagnnnnnnnn

SEQ ID NO: 28719 - DNA, 235 bp, Homo sapiens
  misc_feature: GYAE6OF02FQ74D.35.57.F02.1.454.CMB.1.raw
  modified_base (178)..(179): a, c, t, g, unknown or other
  misc_feature (178)..(179): n is a, c, g, or t
  modified_base (181)..(183): a, c, t, g, unknown or other
  misc_feature (181)..(183): n is a, c, g, or t
  modified_base (185)..(235): a, c, t, g, unknown or other
  misc_feature (185)..(235): n is a, c, g, or t
tcagtacagatcgtcacgaccggtgctcgatttagctcgatatagttgggtttgggggggaagaggaagactgacggtccccccaggagttcaggtgctgggcacaggcggccctgggctgcctggtcaaggactacttccacgatctggtactgagcgggctggcaaggcgcatagnncnnngnnnnnnnnnnnnnnnnnnnnnnnnnnnnnnnnnnnnnnnnnnnnnnnnnnn

SEQ ID NO: 28720 - DNA, 174 bp, Homo sapiens
  misc_feature: GYAE6OF02JH46N.35.57.F02.1.454.CMB.1.raw
  modified_base (164)..(164): a, c, t, g, unknown or other
  misc_feature (164)..(164): n is a, c, g, or t
  modified_base (169)..(174): a, c, t, g, unknown or other
  misc_feature (169)..(174): n is a, c, g, or t
tcagtacagatcgtcacgaccggtgctcgatttagctcgatatagttgggtttgggggaagaggaagactgacggtcccccaggagttcaggtgctggcacagcggcctggctgcctggtcaaggactacttccacgatctgtactgagcggctggacaaggcnatagnnnnnn

SEQ ID NO: 28721 - DNA, 189 bp, Homo sapiens
  misc_feature: GYAE6OF02JDJW1.35.57.F02.1.454.CMB.1.raw
  modified_base (174)..(189): a, c, t, g, unknown or other
  misc_feature (174)..(189): n is a, c, g, or t
tcagtacagatcgtcacgaccggtgctcgatttagctcgatatagttgggtttgggggaagaggaagactgacggtccccccaggagttcaggtgctgggcacagcggccctgggctgcctggtcaaggactacttccacgatctgtactgagcgggctggcaaggcgcatagnnnnnnnnnnnnnnnn

SEQ ID NO: 28722 - DNA, 183 bp, Homo sapiens
  misc_feature: GYAE6OF02IEX34.35.57.F02.1.454.CMB.1.raw
  modified_base (173)..(183): a, c, t, g, unknown or other
  misc_feature (173)..(183): n is a, c, g, or t
tcagtacagatcgtcacgaccggtgctcgatttagctcgatatagttgggtttgggggaagaggaagactgacggtccccccaggagttcaggtgctgggcacagcggcctgggctgcctggtcaaggactacttccacgatctgtactgagcgggctggcaaggcgcatagnnnnnnnnnnn

SEQ ID NO: 28723 - DNA, 262 bp, Homo sapiens
  misc_feature: GYAE6OF01D73DY.2.57.F02.1.454.CMB.1.raw
  modified_base (252)..(262): a, c, t, g, unknown or other
  misc_feature (252)..(262): n is a, c, g, or t
tcagacgctcgacacacgaccggtgctcgatttagctcgatatagttgggtttgggacagagttcactctcaccatcagcagcctgcagtctgaagattttgcagtttattactgtcaccagtataatgactggccttcctcactttcggcggagggaccaaggtggagatcaaacgactgtggctgcaccatctgtcttcatcttcccgcatcgatgtcgagcgtctgagcgggctggcaaggcgcatagnnnnnnnnnnn

SEQ ID NO: 28724 - DNA, 262 bp, Homo sapiens
  misc_feature: GYAE6OF01DE5OC.2.57.F02.1.454.CMB.1.raw
  modified_base (142)..(142): a, c, t, g, unknown or other
  misc_feature (142)..(142): n is a, c, g, or t
  modified_base (258)..(262): a, c, t, g, unknown or other
  misc_feature (258)..(262): n is a, c, g, or t
tcagacgctcgacacacgaccggtgctcgatttagctcgatatagttgggtttgggacagagttcactctcaccatcagcagcctgcagtctgaagattttgcagtttattactgtcaccagtataatgactgccttccctnactttcggcggagggaccaaggtggagatcaaacgactgtggctgcaccatctgtcttcatccttcccgccatctgatcgtcgagtcgtctgagcgggctggcaaggcgcaatagnnnnn

SEQ ID NO: 28725 - DNA, 281 bp, Homo sapiens
  misc_feature: GYAE6OF01AVYSM.2.57.F02.1.454.CMB.1.raw
  modified_base (262)..(281): a, c, t, g, unknown or other
  misc_feature (262)..(281): n is a, c, g, or t
tcagacgctcgacacacgaccggtgctcgatttagctcgatataggttgggtttgggacagagttcactctcaccatcagcagcctgcagtctgaagattttgcagttttattactgtcaccagtataatgactggcctttccctcactttcggcggagggaccaaggtggagatcaaacgaactgtggctggcaccatcctgtcttcatccttcccgccatctgatgtcgagcgtctgagcgggctggcaaggcgcatagnnnnnnnnnnnnnnnnnnnn

SEQ ID NO: 28726 - DNA, 265 bp, Homo sapiens
  misc_feature: GYAE6OF01CDHAH.2.57.F02.1.454.CMB.1.raw
  modified_base (255)..(255): a, c, t, g, unknown or other
  misc_feature (255)..(255): n is a, c, g, or t
  modified_base (261)..(265): a, c, t, g, unknown or other
  misc_feature (261)..(265): n is a, c, g, or t
tcagacgctcgacacacgaccggtgctcgatttagctcgatatagttgggtttgggacagagttcactctcaccatcagcagcctgcagtctgaagattttgcagtttattactgtcaccagtataatgactggccttccctcactttcggcggaggggaccaaggtggagatacaaacgaactgtggctgcaccatctgtcttcatccttcccgccatctgatgtcgagcgtctggagcgggctggcaagggcncatagnnnnn

SEQ ID NO: 28727 - DNA, 256 bp, Homo sapiens
  misc_feature: GYAE6OF01CACAT.13.55.E11.1.454.CMB.1.raw
  modified_base (255)..(256): a, c, t, g, unknown or other
  misc_feature (255)..(256): n is a, c, g, or t
tcagtcacgtactacacgaccggtgctcgatttagcactcgcacgttgggtctgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcatcttcccgccatctgatagtacgtgactgagcgggctggcaaggcgcatagnn

SEQ ID NO: 28728 - DNA, 256 bp, Homo sapiens
  misc_feature: GYAE6OF01CCBJF.13.55.E11.1.454.CMB.1.raw
  modified_base (254)..(256): a, c, t, g, unknown or other
  misc_feature (254)..(256): n is a, c, g, or t
tcagtcacgtactacacgaccggtgctcgatttagcactcgcacgttgggtctgggacagacttcactctcaccatcagcagcctcgagcctgaagatttgcagcttattactgtcagcagcgtagcaactggcctccggccctttcggcggagggaccaaggtggagatcaaacgaactgtggctgcaccatctgtcttcatcttcccgccatctgatagtacgtgactgagcgggctggcaaggcgcatagnnn

SEQ ID NO: 28729 - DNA, 255 bp, Homo sapiens
  misc_feature: GYAE6OF01A9WZG.13.55.E11.1.454.CMB.1.raw
  modified_base (255)..(255): a, c, t, g, unknown or other
  misc_feature (255)..(255): n is a, c, g, or t
tcagtcacgtactacacgaccggtgctcgatttagcactcgcacgttgggtctgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcatcttcccgccatctgatagtacgtgactgagcgggctggcaaggcgcatagn

SEQ ID NO: 28730 - DNA, 256 bp, Homo sapiens
  misc_feature: GYAE6OF01EIS45.13.55.E11.1.454.CMB.1.raw
  modified_base (255)..(256): a, c, t, g, unknown or other
  misc_feature (255)..(256): n is a, c, g, or t
tcagtcacgtactacacgaccggtgctcgatttagcactcgcacgttgggtttgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcatcttcccgccatctgatagtacgtgactgagcgggctggcaaggcgcatagnn

SEQ ID NO: 28731 - DNA, 254 bp, Homo sapiens
  misc_feature: GYAE6OF01CSAS5.13.55.E11.1.454.CMB.1.raw
  modified_base (253)..(254): a, c, t, g, unknown or other
  misc_feature (253)..(254): n is a, c, g, or t
tcagtcacgtactacacgaccggtgctcgatttagcactcgcacgttgggtctgggacagacttcactctcaccatcagcagcctcgagcctgaagatttgcagcttattactgtcagcagcgtagcaactggcctccggccctttcggcggagggaccaaggtggagatcaaacgaactgtggctgcaccatctgtcttcatcttcccgcatctgatagtacgtgactgagcgggctggcaaggcgcatagnn

SEQ ID NO: 28732 - DNA, 257 bp, Homo sapiens
  misc_feature: GYAE6OF01A1TOK.13.55.E11.1.454.CMB.1.raw
  modified_base (255)..(257): a, c, t, g, unknown or other
  misc_feature (255)..(257): n is a, c, g, or t
tcagtcacgtactacacgaccggtgctcgatttagcactcgcacgttgggtttgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcatcttcccgccatctgatagtacgtgactgagcgggctggcaaggcgcatagnnn

SEQ ID NO: 28733 - DNA, 501 bp, Homo sapiens
  misc_feature: GYAE6OF01DIT54.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaagacctactgaattggtttcagcagagccaggccagtctccaaggcgcctaatttataatgttttacccgggactctggggtcccagacagattcagcggcagtgggtcaggcactgatttcacattgaaatcaccagggtgagctgaggatgttgggatttattactgcatgcaagctacattctggcctttcactttcggccctgggaccaaagtggataccaatcgaactgtgctgcaccatctgtcc

SEQ ID NO: 28734 - DNA, 524 bp, Homo sapiens
  misc_feature: GYAE6OF01B5RPM.13.55.E11.1.454.CMB.1.raw
tcagtcacgtactacacgaccggtgctcgatttagcactcgcacgttgggtttgggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaatcataatttatgatttcactaatcggccctcaggtgtatctaatcgcttcactggctccaagtctggcaacacggcctccctgacccatctctgggctccaggcagaggacgaggctgattattactgcggctcctggacgattagctaccctttatgtcttcgggactgtgaccaggtcaccgtcctaggtcacgcccaaggcccaaccccactcgtccactctcgtcccccg

SEQ ID NO: 28735 - DNA, 257 bp, Homo sapiens
  misc_feature: GYAE6OF01BPI9D.13.55.E11.1.454.CMB.1.raw
  modified_base (255)..(257): a, c, t, g, unknown or other
  misc_feature (255)..(257): n is a, c, g, or t
tcagtcacgtactacacgaccggtgctcgatttagcactcgcacgttgggtctgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcatcttcccgccatctgatagtacgtgactgagcgggctggcaaggcgcatagnnn

SEQ ID NO: 28736 - DNA, 257 bp, Homo sapiens; identical to SEQ ID NO: 28735
  misc_feature: GYAE6OF01EDTUO.13.55.E11.1.454.CMB.1.raw
  modified_base (255)..(257): a, c, t, g, unknown or other
  misc_feature (255)..(257): n is a, c, g, or t

SEQ ID NO: 28737 - DNA, 491 bp, Homo sapiens
  misc_feature: GYAE6OF01CLHDZ.13.55.E11.1.454.CMB.1.raw
  modified_base (200)..(200): a, c, t, g, unknown or other
  misc_feature (200)..(200): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccggganagacagccagcatcacctgctctggaaataatggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccagggctagtggatggaggctgactatactgtcgaggcgtagggacagcagcactcgccgtctatcggtcttcggaacgtcgggaccaaggtcacccgtctaagtccg

SEQ ID NO: 28738 - DNA, 495 bp, Homo sapiens
  misc_feature: GYAE6OF01CUOUQ.13.55.E11.1.454.CMB.1.raw
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaagcccctaagctctgatctatggtgcatccagtttaaaaagtggggtcccatcaaggttcagcggcagtggatctggcacagacttcattctcaccatcagcagcctgcagcctgaagtattttgactaactttattactgtactacaagatcaacaattactcctgggacttcggaccaagggaccaaggtggaaatacgaaacgactgtggctgacaccatctgtcttctac

SEQ ID NO: 28739 - DNA, 259 bp, Homo sapiens
  misc_feature: GYAE6OF01DKRQ4.13.55.E11.1.454.CMB.1.raw
  modified_base (255)..(259): a, c, t, g, unknown or other
  misc_feature (255)..(259): n is a, c, g, or t
tcagtcacgtactacacgaccggtgctcgatttagcactcgcacgttgggtttgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcatcttcccgccatctgatagtacgtgactgagcgggctggcaaggcgcatagnnnnn

SEQ ID NO: 28740 - DNA, 533 bp, Homo sapiens
  misc_feature: GYAE6OF01B3UTH.13.55.E11.1.454.CMB.1.raw
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
  modified_base (358)..(358): a, c, t, g, unknown or other
  misc_feature (358)..(358): n is a, c, g, or t
  modified_base (411)..(411): a, c, t, g, unknown or other
  misc_feature (411)..(411): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccggganagacggccacaattcccngtgagggaaacaaccttagaagtcagaatgtccatggtaccagcagaagtcaggccaggcccctgtggtggtcatctatagggataataaccggccctctgggatccctgaccgattctctggctccaactcggggaacncggccaccctgacccatcaacagacgcccaagacgggatgaggctgactattntgtcaggtgtgggacaggcaccgacggtgagtattcgggcggcgggacaagctcgaccgtcgtaggtcacgcccaaggctcgcccccgtcggtcactctcgttcccaccctcctctcgtacg

SEQ ID NO: 28741 - DNA, 261 bp, Homo sapiens
  misc_feature: GYAE6OF01E03UC.13.55.E11.1.454.CMB.1.raw
  modified_base (259)..(261): a, c, t, g, unknown or other
  misc_feature (259)..(261): n is a, c, g, or t
tcagtcacgtactacacgaccggtgctcgatttagcactcgcacgttgggtctgggacagacttcactctcaccatcagcagcctgcaggctgaagatgtggcagtttattactgtcagcaatattatagtactcctccgaggctcactttcggcggagggaccaaggtggagatcaaacgaactgtggctgcaccatctgtcttcatcttcccgccatctgatagtacgtgactgagcgggctggcaaggcgcatagnnn

SEQ ID NO: 28742 - DNA, 256 bp, Homo sapiens
  misc_feature: GYAE6OF01C2TJQ.13.55.E11.1.454.CMB.1.raw
  modified_base (254)..(256): a, c, t, g, unknown or other
  misc_feature (254)..(256): n is a, c, g, or t
tcagtcacgtactacacgaccggtgctcgatttagcactcgcacgttgggtctgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcatcttccgccatctgatagtacgtgactgagcgggctggcaaggcgcatagnnn

SEQ ID NO: 28743 - DNA, 617 bp, Homo sapiens
  misc_feature: GYAE6OF01CF2IG.13.55.E11.1.454.CMB.1.raw
  modified_base (200)..(200): a, c, t, g, unknown or other
  misc_feature (200)..(200): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccggganagacggccacaattccctgtgagggaaacaaccttagaagtcagaatgtccactggtaccagcagaagtcaggccaggcccctggtggtggtcatctatagggataataaccggcctctgggactccctgaccgtattctcgtcggcctccgaacgtcggggaacaccggccaccctgaccatacaacagacgacccgaaggacgggataggacggctagaacttattagttgtcgagggttggtagggacagaccaccgaggtgagttacgttccgggcgggaccgggaaccgaacgcgtacggacccgtccgtagggtaccaccggaccccgaaggtccctccggcccccctcgggtccctaccgttcccgttacccggttcccccacccctttcctaccgttacggttacccgg

SEQ ID NO: 28744 - DNA, 259 bp, Homo sapiens
  misc_feature: GYAE6OF01EQD5J.13.55.E11.1.454.CMB.1.raw
  modified_base (255)..(259): a, c, t, g, unknown or other
  misc_feature (255)..(259): n is a, c, g, or t
tcagtcacgtactacacgaccggtgctcgatttagcactcgcacgttgggtctgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcatcttcccgccatctgatagtacgtgactgagcgggctggcaaggcgcatagnnnnn

SEQ ID NO: 28745 - DNA, 563 bp, Homo sapiens
  misc_feature: GYAE6OF01CMTWY.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccgctccatctcctgcaggtctagtacaaagcctgtatacagtgataggaaagacctacttgaattggtttcagcagaggccaggccagtctccaaggcacctaatttataattgttttacccggactcgtcgggtcccagacagattcaggcggcaggtggtcaggcactgtatttcacattagaaactcaacgagggtaggaggcgtggaaggagttggttaggggtaattttagttacgtgtacatggacaagtctactatttccgtacggttcctttcaccgtttccggacccgtagggaaccctaaaggttgaactaccgaatacgaaactggtaggctcggacacctatcttgttccg

SEQ ID NO: 28746 - DNA, 805 bp, Homo sapiens
  misc_feature: GYAE6OF01CFWNQ.13.55.E11.1.454.CMB.1.raw
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggcattagaatgatttaggctggtatcagacaagaaaccagggaaacgaccctaagctcttgatctagtggtgacaacgttaccgtaaaggttttaaaaaacgggtcggggttaacccctaagttacgtaaacgggtttacgaacggaccgggtacgtaagggtacgggtaacgttccggttacggggacctaaacgtaacggtaaccttttacctaacgttttaccctacccgtaaccctaacttacccgaacggtaccaaacggtccccttacggtacccgaaccgtacccgttaaggtaaaacgtttagtttttaccgaacctttaaacttttaacgtttaacctttaggttaacccttaaagtaaaccggtaactttaacccgaaaactttaaacgttttaaccgttcccggttaacgggggttaacccgtttacccggggtaaccgtaaaaccgggggtaacctaaagggggttaacggtaaaaacgttaacccgtaaaaaccgggtaacgttacgggtacggaccgttacgaacccgtaacccttaacgttaccgtttaccgttccgtttacgttaaccccg

SEQ ID NO: 28747 - DNA, 556 bp, Homo sapiens
  misc_feature: GYAE6OF01DBRKV.13.55.E11.1.454.CMB.1.raw
  modified_base (381)..(381): a, c, t, g, unknown or other
  misc_feature (381)..(381): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggcattagaatgatttagctggtatcagcagaaaccaggaacgccctaagctcttgatctatgtgcatctaagtttaaaagtgggtacccatcaaggttcagcggcagtgatcgtagggacagaattcactctacacaatcagcagctgacacgcctagaagtntttgactaacttattactagtacaactagtacttaatacgttacccgcttacgtaggtttccggacggtaacgggaccgtaagggtacggaagtaacgtaacgtaaaaccgggtacgttaggtacggtcttacggacctacctaacttcgttagttaccttcgtactttaccccg

SEQ ID NO: 28748 - DNA, 518 bp, Homo sapiens
  misc_feature: GYAE6OF01EQNUO.13.55.E11.1.454.CMB.1.raw
  modified_base (201)..(201): a, c, t, g, unknown or other
  misc_feature (201)..(201): n is a, c, g, or t
  modified_base (473)..(473): a, c, t, g, unknown or other
  misc_feature (473)..(473): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccggganagacagccagcatcacctgctctggaaataattggcagataaatatacttcctggtatcagcagaagtcaggccagtcccctgtgctggtcatctatcaagatgccaagcggccctcgacgggactcccgtgacgcgatttctctcggcctccaaactccgtacgggaactcgacgccctaactctacgaccatccgacggccgggaacccagggcctagtggatggaggctgactattactgtcgaggcgtggacagcagcactcgcccgntatcgtctacggacgtcgggaccaacggtccaccgtctagtaccg

SEQ ID NO: 28749 - DNA, 541 bp, Homo sapiens
  misc_feature: GYAE6OF01BUIW9.13.55.E11.1.454.CMB.1.raw
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccaagtttaaaaagtgggtacccatcaaggttcagcggcagtggatctggcacagacttcattctcaccatcagcagcctgcagcctagaagtattttgactaactttattactgtactaacaagtatacaactaattatccgtagggtacgttccgggaccaaaggggaccaaagggtacggaaaatacgaaaacggaacttggtcggacttaggacctaaccctattaccgttcgttcgttcctaacg

SEQ ID NO: 28750 - DNA, 256 bp, Homo sapiens; identical to SEQ ID NO: 28727
  misc_feature: GYAE6OF01A6HJC.13.55.E11.1.454.CMB.1.raw
  modified_base (255)..(256): a, c, t, g, unknown or other
  misc_feature (255)..(256): n is a, c, g, or t

SEQ ID NO: 28751 - DNA, 531 bp, Homo sapiens
  misc_feature: GYAE6OF01D24YI.13.55.E11.1.454.CMB.1.raw
  modified_base (200)..(200): a, c, t, g, unknown or other
  misc_feature (200)..(200): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccggganagacggccacaattccctgtgagggaaacaaccttagaagtcagaatgtccactggtaccagcagaagtcaggccaggcccctgtggtggtcatctatagggataataaccggcctctgggatccctgaccgattctctggctccaactcggggaacacggccaccctgaccatcaacagacgcccaagacgggatgaggctgactatattgtcaggtgtgggacagcacgacggtgatagttcggcggcgggaccagctgaccgtcctaggcagcccaaggcctcgcccccgtcggtccactcctcgttccccaccctcctcgtcgtacg

SEQ ID NO: 28752 - DNA, 256 bp, Homo sapiens; identical to SEQ ID NO: 28730
  misc_feature: GYAE6OF01DOVY9.13.55.E11.1.454.CMB.1.raw
  modified_base (255)..(256): a, c, t, g, unknown or other
  misc_feature (255)..(256): n is a, c, g, or t

SEQ ID NO: 28753 - DNA, 570 bp, Homo sapiens
  misc_feature: GYAE6OF01CNW5S.13.55.E11.1.454.CMB.1.raw
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (315)..(315): a, c, t, g, unknown or other
  misc_feature (315)..(315): n is a, c, g, or t
  modified_base (341)..(341): a, c, t, g, unknown or other
  misc_feature (341)..(341): n is a, c, g, or t
  modified_base (442)..(442): a, c, t, g, unknown or other
  misc_feature (442)..(442): n is a, c, g, or t
  modified_base (535)..(535): a, c, t, g, unknown or other
  misc_feature (535)..(535): n is a, c, g, or t
tcagtcacgtactacacgaccggtgctcgatttagcactcgcacgttgggtttgggggagcctgggcctcaggaagcagcatcgggggtgccgcagccatggcctggaccgctcgtcctgctgagcctccttgctcactttacagcttctgtggcctcctatgagttgactcagccactctcagtgtcagtggccccggganagacggccacaattccctgtgagggaacaaccttagaagtcagaatgtccatggtaccagcagaagtcaggccaggccctgtggnggtcatctanaggataactaaccgcctntgggactcccgtagaccgtattcgtntcggctaccgaacgtcggggaactacgggcctacccgtgaccataccaaacgacgtacgacccaaggacgggatgaacggctagactattatgtcaggtgnggacagcacgacggtgacttacgtcgggacggacggtacaagcctacgaccgtcgtacggtccacggccgaacggcctcgacccctggtaccncgttcttccgtaccccacccttcctcgtacgtacg

SEQ ID NO: 28754 - DNA, 566 bp, Homo sapiens
  misc_feature: GYAE6OF01BWIN8.13.55.E11.1.454.CMB.1.raw
  modified_base (344)..(344): a, c, t, g, unknown or other
  misc_feature (344)..(344): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctcttggagacagagtcaccgtcacgttgccgggcgagtcacgacattaacacttatttagcctgtatcagcagaagccagggagagtaccctaaattattgatctctgctgcgtccgccttgcaagtcggggtccctatctcggtcagtggcggtggatcgtaganagaatcactctcaccatcacctaactcgcacccgtagaacgtagtgttagtaagttattactgtcagtacctagtagttcgggtcggtacccgtgtcttaggttttccgggacgggtaacgggaccgtaagggtgacgaagtacttaaccgaaacgtaacgtcggtagggccgttcggacctacctagttccttcggttacctttcacgttcccttaccccg

SEQ ID NO: 28755 - DNA, 255 bp, Homo sapiens; identical to SEQ ID NO: 28729
  misc_feature: GYAE6OF01AYH5N.13.55.E11.1.454.CMB.1.raw
  modified_base (255)..(255): a, c, t, g, unknown or other
  misc_feature (255)..(255): n is a, c, g, or t

SEQ ID NO: 28756 - DNA, 640 bp, Homo sapiens
  misc_feature: GYAE6OF01C9VUG.13.55.E11.1.454.CMB.1.raw
  modified_base (238)..(238): a, c, t, g, unknown or other
  misc_feature (238)..(238): n is a, c, g, or t
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccgcctccatctcctgcaggtctagtcaaagcctcgtanacagtgataggaagacctacttgaattggtttcagcagaggccaggccagtctaccgaaggcgacctaatttataattcgtttttaaccccgggactcgtcggggtcccagacaagtacttcgacgcggcaggttgggtcaggcacgtgacgtttcaactattagaaaatccaccgaggggtggaggctaggaggtatggttagggtattttagtactgtacagtgacaagtcttacgtaactttcgtcgtcccttttacgtaccgttttccgggacccgttacggggaaaccctaaaaggttcggtaaacttaaaccccgtaaagttacccggtaaacgtttacgggttacggaccgtttacggacccgtaacccgtaacgttccgtttcggtttaacccc

SEQ ID NO: 28757 - DNA, 632 bp, Homo sapiens
  misc_feature: GYAE6OF01AFONN.13.55.E11.1.454.CMB.1.raw
  modified_base (298)..(298): a, c, t, g, unknown or other
  misc_feature (298)..(298): n is a, c, g, or t
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaagacctacttgaattggtttcagcagaggccaggccagtctccagcnctatttataattgttttacccggactcgtgggtccagacagattcagcgcagtggtcaggcactgtatttcactattagaaatcaaccgtaggggtggaggtcgtaggaggtacgttggttagggtaattttagtacgttgactagtgacctaagtctaactacgtttcgtacgggtcccttttaccgtaccgttttacccgggaccccgttaggggaacccttaaaacgggttacgggtaaaccgtttaacccgtaaacgttccggtaaaccgtttcgggtacggtacccgttacggaccctaacccgtacgtttcccgttaggtttaccccg

SEQ ID NO: 28758 - DNA, 238 bp, Homo sapiens
  misc_feature: GYAE6OF01A28QA.13.55.E11.1.454.CMB.1.raw
  modified_base (233)..(238): a, c, t, g, unknown or other
  misc_feature (233)..(238): n is a, c, g, or t
tcagtcacgtactacacgaccggtgctcgatttagcactcgcacgttgggtttgggtgccagggggaagaccgatgggcccctggtcaccgtctcctcagcctccaccaagggcccatcggtcttcccctggcaccctcctccaagagcacctctggggcacagcggccctgggctgcctggtcaaggactacttcctagtacgtgactgagcgggctggcaaggcgcatagnnnnnn

SEQ ID NO: 28759 - DNA, 511 bp, Homo sapiens
  misc_feature: GYAE6OF01EZMA4.13.55.E11.1.454.CMB.1.raw
  modified_base (383)..(383): a, c, t, g, unknown or other
  misc_feature (383)..(383): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
  modified_base (489)..(489): a, c, t, g, unknown or other
  misc_feature (489)..(489): n is a, c, g, or t
  modified_base (499)..(499): a, c, t, g, unknown or other
  misc_feature (499)..(499): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccaggcgagtcaggacattaacaactatttaaatggtatcagcagaaaccaggtaaacgccctaagcctcctgatctacgatgcatccaatttggaaacagggtcccatcaaggttcagtggaagtggatcgtgggactagtattttacttcaccatcagcagcctgcagcctagaanatattgctaacnttattacgtntcagcagtatgataactcgtaccgtataccgacttcgaccgaaggccacgacgtaggaacgtaacttaaacgactggtcggacncgtacactanccttagtcctac

SEQ ID NO: 28760 - DNA, 514 bp, Homo sapiens
  misc_feature: GYAE6OF01CM71W.13.55.E11.1.454.CMB.1.raw
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgattaggctggtatcagacagaaaccagggaaacgacccctaagctcttgatctatggtgcatcctaagtttaaaagtgggtacccatcgaaggttcagcggcagtgatctggcacagtacttcattctcaccatcagcagcctgcagcctagaagtatttgactaactttattactgtactactaagtatacaatattacgtccgtagggtaccgttcggacgaacgggacaagggtagaaatacgaaacgtacgtagtggactgactactatctgtctctcg

SEQ ID NO: 28761 - DNA, 570 bp, Homo sapiens
  misc_feature: GYAE6OF01BY72A.13.55.E11.1.454.CMB.1.raw
tcagtcacgtactacacgaccggtgctcgatttagcactcgcacgttgggtttggggggtctcagagaggagccttagccctggactccaaggcctttccacttggtgatcagcactgagcacagaggactcaccatggaattggggctgagctgggtgctccttgttgctattttagaaggtggccagtgtgagatgcgactggtggagtcgtgggggaggcttggtccgaggccgggggggtcacgtgagactctcctgtacagcctcgagattcattttcaggtattattggatgagttggtccgcagtctccgagggaagggctggagtgggtgaccaacgagtaaaggaggagtgggagtcgagacatagttatgtggagttcgtaggtggcggggccgtagttcacctatttccgagagaaccaacgaccaagactacgtactagtatatctagactaaagtgaggacgccgtagagtagtacgagtggaatacggactaacgattagttattggtgacgtaagtaagttcgaacttacgttttaccgaaggtacggtaaccgg

SEQ ID NO: 28762 - DNA, 623 bp, Homo sapiens
  misc_feature: GYAE6OF01DIF16.13.55.E11.1.454.CMB.1.raw
  modified_base (524)..(524): a, c, t, g, unknown or other
  misc_feature (524)..(524): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccggaagacggccacaattccctgtgaagggaaacaaccttagaagtcaagaactgtccagtggtaccagcagaagtcaggccaggccctgtgtggtcatctagtaggaataacgtaccggcctacgagggtactccccgtaggacgcgtactttcgtccgtggcctaccgtaaactccgtagggaacctcgacgtccctaactcgtacgaaccatccgaacggaccgggtaacccaggaccttagcgggattacggaacgggtctacgacttattaacgtcgtacgtagggtcggtagggacctaggccgaagccacgttcgacccgtntagtcgtccgttacggaacgtcgggaactaacgggtcctaccgtactaacggtccacggaccccgtaaacggacccctaacccgactcggtcctacccg

SEQ ID NO: 28763 - DNA, 532 bp, Homo sapiens
  misc_feature: GYAE6OF01CDFEB.13.55.E11.1.454.CMB.1.raw
  modified_base (432)..(432): a, c, t, g, unknown or other
  misc_feature (432)..(432): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaacgcccctaagctcttgatctatggtgcatcctagtttaaaagtgggtcccatcaaggttcagcggcagtgggatcgtggctacgagtacttcactttctcaccattcagcacgcctgccagcctagtaacgtattttgacttaactttattacttgtacctacaaagtntacaactaattacgtccgtagggtaccgttcggaccgaagggaccgaaggtacgaaagtacgaaacgtacgtggtcgctagcacattactcgtcttctac

SEQ ID NO: 28764 - DNA, 681 bp, Homo sapiens
  misc_feature: GYAE6OF01BIPNW.13.55.E11.1.454.CMB.1.raw
  modified_base (212)..(212): a, c, t, g, unknown or other
  misc_feature (212)..(212): n is a, c, g, or t
  modified_base (267)..(267): a, c, t, g, unknown or other
  misc_feature (267)..(267): n is a, c, g, or t
  modified_base (675)..(675): a, c, t, g, unknown or other
  misc_feature (675)..(675): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttggccgggnaagtcgaggcattagaaatgattaggctggtatcagacagaaaccgagggaaacnccctaagctctgatctagtggtacgctacgtaccgtaaaggttttaaaacggtcggggtaccctaagtacgtaaagggttacaaggaggacgtaggtaggtaagtcgttacggacctaacgtacgtaactttactaactttacgttaccaaccgtaactacgaacgaccgacgtcccgttacggactaacggtaccgttaggtaaacgtttacgtttacgaacctttaaactttaacgtttaccttacggttaacttaacgaagttaactactaaacctaatttaccgtacggttacgggttaacggttacccggaacgtaaccgggaacgtaagggtacgtaaaacgtaccgtaaaacggtactaggtacgtacgtacgacctaacgtacttacctgttacccgttntacccg

SEQ ID NO: 28765 - DNA, 553 bp, Homo sapiens
  misc_feature: GYAE6OF01C77B8.13.55.E11.1.454.CMB.1.raw
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttggcttacttgggttttccttgttgctattttaaaaggtgtccaatgtgagctgcagctggtggagtctggggggagtttggtacagccagggcggtccctgagactctcctgtataacttctggattcaacttgggtgattatgctatgaactgggtccgccaggctccgaggggaaggggctgggaggtggggttaggtttcagtttagggagcaatttctcatgatgggaacaacgagaatacgccgcgtctagtaaaaggcagattcaccatctacaagagatgagtaccaagaagcactccgccttttctgcagatgagtacgcctagaacggaccgaaggaccaacgacgaccattactattactgtgcgtagagagttattacgctacgtcctacgtaccg

SEQ ID NO: 28766 - DNA, 600 bp, Homo sapiens
  misc_feature: GYAE6OF01DARIA.13.55.E11.1.454.CMB.1.raw
  modified_base (409)..(409): a, c, t, g, unknown or other
  misc_feature (409)..(409): n is a, c, g, or t
tcagtcacgtactacacgaccggtgctcgatttagcactcgcacgttgggtttggggtggatcaggactcctcagttcaccttctcacaactggaggctccctgctcagctcctgggctgctaatgctctgggtcccaggatccagtggggatgttgtgatgactcagtctccactctccctgcccgtcgacccttggacagccggcctccagtcctcctgctaggtctagtcaaagcctcgtatacagtgatggaagacctacttgaattggtttcagtcagaggccaggccagtctcaggcgctaagttataattcgttttacccggatcgtggggtaccagacagatcagcggctagtgggtcaggcacgtgatttcacattagaaaatcaccgtagggtagaggntgagtatgttgggtatttagtactgactatcgactaaggtccttaacgtatttctcgggttcctttactacggttttccggacccgttacgggtaaccaaaggttcggaacttaacccgtaaagtttccgtaaaccgttcggttagggtaccttcggtaaccgtaacccgtacgttccgttcggttacccc

SEQ ID NO: 28767 - DNA, 566 bp, Homo sapiens
  misc_feature: GYAE6OF01B1N6T.13.55.E11.1.454.CMB.1.raw
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctaggtatcagacaagaaaccagggaaacgcccctaagctcttgatctatggtgcatacctaagtttaaaaagtgggtacccatacgaaggttcaggcggacagtaggatcgtaggctacagtacttcatttctaccaccatcacgcagcctgcacgcctagaagtattttgactaacttattactgtacttaacaagtaatacaactaattacttacccgtgggtaaccgttccgggaccgaagggaacccgtaaaggtaggaaataccgaaaacggaacgttggtcggtacctagaccctaacctacttcgtcgtttcttcgtacc

SEQ ID NO: 28768 - DNA, 569 bp, Homo sapiens
  misc_feature: GYAE6OF01DVEOK.13.55.E11.1.454.CMB.1.raw
  modified_base (200)..(200): a, c, t, g, unknown or other
  misc_feature (200)..(200): n is a, c, g, or t
  modified_base (549)..(549): a, c, t, g, unknown or other
  misc_feature (549)..(549): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccggganagacggccacaattccctgtgaggaaacaccttagaagtcagaatgtccactggtaccagcagaagtcaggccaggcccctgtggtggtcatctatagggataataaccggcctctgggatccctgaccgattctctggctccaactcggggaacacgggccaccctgaccatcaaacagacgaccctaaggaccgggaatcggaggctagacttatacgttgtcgtagggtgtcgggactagacgaccgaacgggtgactaagttccgggacgggccggggtactaacggctggaccgtccgtaggtcacgcccaaggctcgccccctgaccactccctcgttccccncccttccctcgtagtaccgg

SEQ ID NO: 28769 - DNA, 693 bp, Homo sapiens
  misc_feature: GYAE6OF01ASLA8.13.55.E11.1.454.CMB.1.raw
tcagtcacgtactacacgaccggtgctcgatttagcactcgcacgttgggtttggggatgctttctgagagtcatggatctcatgtgacaaagaaaatgaagcacctgtggttcttcctcctgctggtggcggctccagagtgggcctgtcccagctgcagctgcaggagtccgggcccaggaggtggtgaagccgttcggacgaccctgtccctcagttgtaatgtgtcgtggtggcctacccgtaaggtacggtacttaacttactacgtggggctggacgtccggcgaccgccccggaggggacgggcgtggagtggtaggttggggattagtcttacgttagtaggtagggtagtaacgaactaacaactcccgtaccctacgaagacgtcgagtcatcatactcgagacgagtccaaggaactacttccgtaccgtagtaaagtgtagttcgtgtacgacccgtcgacgaacgaccgacggtctgttacttagtttagttggtcggtaccgtaagggtaccggaacttaaagttgtttacgggttaaccgaggggttacgttccgaacgttaccgggtacggggacccgtaacggggtaaccccgttgggtaaccccgttacccggttccgttaccccgttacggacccgttaccccgtaccccgaaaccggtacccgggtacccccg

SEQ ID NO: 28770 - DNA, 521 bp, Homo sapiens
  misc_feature: GYAE6OF01AR2GB.13.55.E11.1.454.CMB.1.raw
  modified_base (356)..(356): a, c, t, g, unknown or other
  misc_feature (356)..(356): n is a, c, g, or t
  modified_base (381)..(381): a, c, t, g, unknown or other
  misc_feature (381)..(381): n is a, c, g, or t
tcagtcacgtactacacgaccggtgctcgatttagcactcgcacgttgggtttggggggtctcagagaggagccttagccctggactccaaggcctttccacttggtgatcagcactgagcacagaggactcaccatggaattggggctgagctgggtgctccttgttgctattttagaaggtggccagtgtgagatgcgactggtggagtctgggggagcttggtccagccgggggggtcactgagactctcctgtacagcctcgagattcattttcaggaattattggatgagttgggtccgccagtctccgagggaaggggctgggagtggggtggccaacgagtaaaagggnggagtggggagtcagacagtattangtggatctgtgcggggccattcgaccatttccagtagacaacgccagactcgtcagtatatctgacaaatgaggagcctgagagtcgatgatacggctacatattatgtgcgagaattgactagttttccagtcggtacg

SEQ ID NO: 28771 - DNA, 516 bp, Homo sapiens
  misc_feature: GYAE6OF01E4PD1.13.55.E11.1.454.CMB.1.raw
  modified_base (387)..(387): a, c, t, g, unknown or other
  misc_feature (387)..(387): n is a, c, g, or t
  modified_base (488)..(488): a, c, t, g, unknown or other
  misc_feature (488)..(488): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacagggtcccatacaaggttcaggtggaagtggatctgggactaggtattttaactttcaccatcagcagcctgcagcctagaanatattgcaaacatattactgtacagcagtatagataactcctaccgtatccaccttcggaccaacgggacacgacgtaggagtacttaaacgaacgttggnggtcctgccaacctatcttgttcttacc

SEQ ID NO: 28772 - DNA, 256 bp, Homo sapiens; identical to SEQ ID NO: 28727
  misc_feature: GYAE6OF01EZRZG.13.55.E11.1.454.CMB.1.raw
  modified_base (255)..(256): a, c, t, g, unknown or other
  misc_feature (255)..(256): n is a, c, g, or t

SEQ ID NO: 28773 - DNA, 257 bp, Homo sapiens
  misc_feature: GYAE6OF01A80UC.13.55.E11.1.454.CMB.1.raw
  modified_base (254)..(257): a, c, t, g, unknown or other
  misc_feature (254)..(257): n is a, c, g, or t
tcagtcacgtactacacgaccggtgctcgatttagcactcgcacgttgggtctgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcatcttcccgcatctgatagtacgtgactgagcgggctggcaaggcgcatagnnnn

SEQ ID NO: 28774 - DNA, 545 bp, Homo sapiens
  misc_feature: GYAE6OF01A8EHQ.13.55.E11.1.454.CMB.1.raw
  modified_base (421)..(421): a, c, t, g, unknown or other
  misc_feature (421)..(421): n is a, c, g, or t
  modified_base (460)..(460): a, c, t, g, unknown or other
  misc_feature (460)..(460): n is a, c, g, or t
  modified_base (486)..(486): a, c, t, g, unknown or other
  misc_feature (486)..(486): n is a, c, g, or t
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagccccagggaaggggctggagtgggattgggggatatctcttatagtgggagtacgaactacaatccgtccctcaagagtcgagtcatcatatccgtagacaggtccaggaacgaattcctcctagaaagtgagttctgtgaccgtcncagacacggctgtctattattgtgcgagacggacaaatnttggttcagggtagttcgacttacgnggggccacgggtaccctgggcctaccgtctccgtcacgccctcccaccgacgggtcccc

SEQ ID NO: 28775 - DNA, 593 bp, Homo sapiens
  misc_feature: GYAE6OF01B8Z1Y.13.55.E11.1.454.CMB.1.raw
  modified_base (323)..(323): a, c, t, g, unknown or other
  misc_feature (323)..(323): n is a, c, g, or t
  modified_base (362)..(362): a, c, t, g, unknown or other
  misc_feature (362)..(362): n is a, c, g, or t
tcagtcacgtactacacgaccggtgctcgatttagcactcgcacgttgggtttggggggggtctcaggaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgatgttgggacttatgaccttgtctcctggtaccgacaacacccaggcaaagcccccaaactcattatttacggggtcaatagcggccctnagggctttctgatcgcttctctggctcagtctggcaacncggcctcctgacatctctgactccagcgagcgagctgtattttactgttgttcattatgacgtaggaaggtagtgtatttagtgttcgtttagggtaacgtgggtaacctaagggttcctaacccggttcccgttagggtacctaacgggtacccccgaaacggggtaccccctaaaaccccccgtacgttaccggtaccctaaccttcccgttccggtttccccccccgg

SEQ ID NO: 28776 - DNA, 575 bp, Homo sapiens
  misc_feature: GYAE6OF01EIOC0.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgataggaagacctacttgaatttggtttcagcagaggccaggccagtctccaaggcgacctaatttataaggtgtctgacagggacgtccgggtccagacagattcgagcggcaggtggtcaggcactgatttcacactagaaatacccccccgagacgagggtaggaggcgtaggaggtagtagtttagttgggtcgttacgttatttagttgtcgagtagacgaagaccgaacactacgtcggtccgtacgtacgtttacggtaccggaacggggaacccgaacggtcgtaggaggaacgtacgtaaacgtacgtaacgtggtggtacg

SEQ ID NO: 28777 - DNA, 257 bp, Homo sapiens
  misc_feature: GYAE6OF01BCWB7.13.55.E11.1.454.CMB.1.raw
  modified_base (256)..(257): a, c, t, g, unknown or other
  misc_feature (256)..(257): n is a, c, g, or t
tcagtcacgtactacacgaccggtgctcgatttagcactcgcacgttgggtctgggacagacttcactctcaccatcagcagcctcgagcctgaagattttgcagcttattactgtcagcagcgtaacaactggcctccggccctttcggcggagggaccaaggtggagatcaaacgaactgtggctgcaccatctgtcttcatcttcccgccattctgatagtacgtgactgagcgggctggcaaggcgcatagnn

SEQ ID NO: 28778 - DNA, 504 bp, Homo sapiens
  misc_feature: GYAE6OF01A2SKB.13.55.E11.1.454.CMB.1.raw
  modified_base (406)..(406): a, c, t, g, unknown or other
  misc_feature (406)..(406): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtgggtcccatcaaggttcagcggcagtggatctggcacagacttcattctcaccatcagcagcctgcagcctagaagtatttgactaacttattactgtctanagatcactaattatcgtagggtacgttcggacgaagggtaccgaaggtagaaactacgaaacgtaataggtcggctagcctacatactgttctctacc

SEQ ID NO: 28779 - DNA, 257 bp, Homo sapiens; identical to SEQ ID NO: 28732
  misc_feature: GYAE6OF01DST1Q.13.55.E11.1.454.CMB.1.raw
  modified_base (255)..(257): a, c, t, g, unknown or other
  misc_feature (255)..(257): n is a, c, g, or t

SEQ ID NO: 28780 - DNA, 631 bp, Homo sapiens
  misc_feature: GYAE6OF01BL8GH.13.55.E11.1.454.CMB.1.raw
  modified_base (404)..(404): a, c, t, g, unknown or other
  misc_feature (404)..(404): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccggcaagtcaggcattagaatgattaggctggtatcagcaagaaaccgaggaacgacccctaagctctagatctagtggtgcatacctaaggttttaaaaggtcgggtacccagttacgtaaggttcgagcggtacaggtgatcgtggacacagtacttcattctacacatcagcagcctagcagacctagtaacgtntttacgacttaaactttacttactcgttactaacaagtactaccaacttaacttacgttaccggttacgggtacggtttacccggaaccgtaaacggggtaacccgtaaagggtaacggtaaaaacgttaccggaaaaacgttaacggttacgggtaacggtacccgttacgaacccgttaacccgtaacgtttacccgttacgtttacccgtttaccgttaacccg

SEQ ID NO: 28781 - DNA, 615 bp, Homo sapiens
  misc_feature: GYAE6OF01EYQG8.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaagacctacttgaattggtttcagcagaggccaggccagtctccgaaggcgccttaatttataattcgtttttacccggacttcgtggggtcccagacagattcagcggcaggtgggtcaggcatgtatttcactattagaaatcaaccgagggtggaggctaggaggtattggttgggtaattttattacgtgctaattcgactaaggtccttaactatttccgttaggttccctttttcgtaccgttttccgggaccccgtagggtaacccgtaaaaggtcgggtaacttaaacccgtaaagttaccggaaacttcgggtacggaccgttcggaccctaaccgtcttaccgttcggtttaccc

SEQ ID NO: 28782 - DNA, 520 bp, Homo sapiens
  misc_feature: GYAE6OF01D1PM1.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaagacctacttgaattggtttcagcagaggccaggccagtctcaaggcgcctaatttataattgtttttacccgggacttcgtcggggtcccagacagattcgagcggcagtgggtcaggcactgatttcactattagaaaatcaaccgagggtgaggctgaggtatggttggtatttatactgcatgctaagctactattctggtcctttcactttcggaccctgggacccaaagtgaataccaatcgactgtgctgacacatctgtcc

SEQ ID NO: 28783 - DNA, 256 bp, Homo sapiens; identical to SEQ ID NO: 28742
  misc_feature: GYAE6OF01C8XYX.13.55.E11.1.454.CMB.1.raw
  modified_base (254)..(256): a, c, t, g, unknown or other
  misc_feature (254)..(256): n is a, c, g, or t

SEQ ID NO: 28784 - DNA, 235 bp, Homo sapiens
  misc_feature: GYAE6OF01D5NLI.13.55.E11.1.454.CMB.1.raw
  modified_base (234)..(235): a, c, t, g, unknown or other
  misc_feature (234)..(235): n is a, c, g, or t
tcagtcacgtactacacgaccggtgctcgatttagcactcgcacgttgggtttgggtgccagggggaagaccgatgggcccctggtcaccgtctcctcagcctccaccaaggcccatcggtcttccccctggcaccctcctccaagagcacctctgggggcacagcggccctgggctgcctggtcaaggactacttcctagtacgtgactgagcgggctggcaaggcgcatagnn

SEQ ID NO: 28785 - DNA, 683 bp, Homo sapiens
  misc_feature: GYAE6OF01C99QX.13.55.E11.1.454.CMB.1.raw
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccggganagacggccacaattccctgtgaaggaaacaaccttagaagtcagaatgtccacgtggtaccagcagaagtcaaggccaggtcccctggtcgcgtggtacatctatacaaagntgaccaagtcgccctgaacgggactcccgtggaacgtcggaatttcctcgtggtcctacccgaaacttccgtagggaaacccttcgaaaccgcccaacttcctacgaacccacttaccgaccggaccgggaacccagggtaccgtaagttcgggaagttcgggaaggcgttacgactttaacgttcgttacggttacgaaggggtccggttaggggaacgaaccggacaacgggacctaaccgtcgaccccggtacttacggtcggttaaccgttaccggtaaaccgtcggggtaacccaaagggtcccctaacccggttactaaaccgttacgaaccggaacccccgaaaggacccccgtaaacccccg

SEQ ID NO: 28786 - DNA, 688 bp, Homo sapiens
  misc_feature: GYAE6OF01C9G6S.13.55.E11.1.454.CMB.1.raw
  modified_base (682)..(682): a, c, t, g, unknown or other
  misc_feature (682)..(682): n is a, c, g, or t
tcagtcacgtactacacgaccggtgctcgatttagcactcgcacgttgggtttggggtgatcaggactcctcagttcaccttctcacaatgagctccctgctcagctcctgggctgctaatgctctcgggtcccaggattccaggtggggattgttgtgtatgactctagttctccactctccctgcccgtcacccgttggacaggcccggcctccatcctaccgtggccgtaggtctaagtaccaacgtccctgtaatacgagtgaagtaggtaaacgtaccttacgttagtaattttggtttacagtacgaggacggcgacggtccagtacctaccggaacggtaccgtacctttaattttaacgtacggtttcggtttttaaccccgggacttacggtacgggtacccagtaccgagtacttcgacggcgacgtaggtcggtcaggtctacgtgtacgtttacaactattaacgaaactcgaaccggtaggggtaggacgtacgtaggaggttagttaggttaggttatttagtctgactagtacgactaagtcttaacgtacgttcgtacgtttccctttacggttacccgttcccggtacccgtacggtaaccgtaaggtacgtaacctaccgtagtaccgtaacgtgtccgtactacgtacaccgttctccggttntacccg

SEQ ID NO: 28787 - DNA, 699 bp, Homo sapiens
  misc_feature: GYAE6OF01AGZHH.13.55.E11.1.454.CMB.1.raw
  modified_base (317)..(317): a, c, t, g, unknown or other
  misc_feature (317)..(317): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgctattttaaaaggtgtccaatgtgagctgcagctgggtggagtctggggggagtttggtacagccgaggggcggtccctgagactctcctgtataacttctggattcaacgttggggtgattatgacttagtgaactggggtcccnccaggcctccggaggggaagggctgggacggttggggtagtttcgaagtttagggagtctaatttcgacagttcggagtacggggacaaacaggaaacttaccggccggtcggttataagggtaaaaaggcgaaagtacttaccgaacctagttcctaacgaagaggtaatacggtaacgtaccgaaggaacgtccaacgttcccgttaccgtttaccgtacggtaccaaggtattacggtaacggtacgtacccgttaggaaaccggtaccggaacggaacaaccgacgtaccgtaacttacccttaagttaaccttggacggttaccgtaagtaacggttacgttacgtacgtacgtaacggttccctaacccggtacgg

SEQ ID NO: 28788 - DNA, 625 bp, Homo sapiens
  misc_feature: GYAE6OF01DTJDA.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaagacctacttgaattggtttcagcagaggccaggccagtcctccgaaggcgaccttaatttataatcgtttttacccgggacttcgtcgggtcccagacagacttcgagcggcagtgggtcaggcactgtatttcactattagaaatcaacgagggtgaggctggaggtagtggttagggtattttagtacgtgactagtcgactaagtcttaacgtactttccgtacggttcccttttcgtaaccgttttccgggaccccgttacggggtaaccctaaaagggttcggtaaacgttaacccgtaaagttaccggaaacgtttcgggtacggtacgttcggtacccacccgttacttccgttcggttttacccc

SEQ ID NO: 28789 - DNA, 260 bp, Homo sapiens
  misc_feature: GYAE6OF01DXIK3.13.55.E11.1.454.CMB.1.raw
  modified_base (254)..(260): a, c, t, g, unknown or other
  misc_feature (254)..(260): n is a, c, g, or t
tcagtcacgtactacacgaccggtgctcgatttagcactcgcacgttgggtctgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcatcttccgccatctgatagtacgtgactgagcgggctggcaaggcgcatagnnnnnnn

SEQ ID NO: 28790 - DNA, 618 bp, Homo sapiens
  misc_feature: GYAE6OF01BJ9C8.13.55.E11.1.454.CMB.1.raw
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccggcaagtcaggcattagaaatgatttaggctggtatcgagacaagaaaccgaagggaacgcccctaagctcttgatctatggtgcatacctaaggttttaaaaaggtcggggtacccagtacgtaaggttcaggcggacgaggtggatcgtggacacgagtacttcatttccacacctatcacgacacgcctgccgacgccgtagtaacgttattttcgaaccttaactttacttacgttacgttacctaacgtaagtactaactaactaagtttaccgtaccggttacggggttacccgttaccgggaccgaaacggggtacctaaacggggttagaaaacgtaaccgtaaacgtaacgtaggtcggtacgtacgaccgtaacctacgttacttcgttccgttctacccg

SEQ ID NO: 28791 - DNA, 783 bp, Homo sapiens
  misc_feature: GYAE6OF01CC9ZN.13.55.E11.1.454.CMB.1.raw
tcagtcacgtactacacgaccggtgctcgatttagcactcgcacgttgggtttggggtgatcaggaactcctcagttcaccttctacacaactgaggctccctgctcagctcctgggctgctaatgctctgggtccaggatccagtgggatgttgtgatgactcagtctccactctccctgcccgtcacccttggacagccggcctccagtctcctgcaggtctagtcaaagcctcgtatacagtgataggaaacgaccttacttgtaactttggtttacagtcgaggacggccgagggaccaaggtcctaccgaagggtccgaccgttaagtttaacgttaattcggtttttaacccgggacttcgttcggggtaccccaaggtaacaacgtacttacgaacggtaccggactaacgggtggggtacctaagggccaacgttacggaactttttaccgaaaccgttaagtttaaacggtaaaaaccttaccgaaacccggtaagggggtttacgggaacgggtcgtaagggtaagggtaaagttgggttaggggttaactttttaacgttaaccgttgtaccgtaagttacggaccgtaaaggtccttaacgttaacgtttccgttacgggttcccttttacgtaccggttttaccggaaccccgtttaggggaaacccgttaaaggttacgggtaaccttaacccgtaaatttcccggaaacctttcggttaacgggtccttacgggtaccaacccgttacttcccggttacggtttaccc

SEQ ID NO: 28792 - DNA, 698 bp, Homo sapiens
  misc_feature: GYAE6OF01C0J1G.13.55.E11.1.454.CMB.1.raw
  modified_base (160)..(160): a, c, t, g, unknown or other
  misc_feature (160)..(160): n is a, c, g, or t
tcagtcacgtactacacgaccggtgctcgatttagcactcgcacgttggggtttggggggtctcagagaggagccttagccctggactccaaggcctttccacttggtgatcagcactgagcacagaggactcaccatggaattggggctgagctgggtnctcttgttgcttatttagaggtggccagtgtgagatgcgacgtgggtggaggttcggtggggggaggtcgttgggtccgagggccgggggggtcacgtgacgactctctgtacagcctacgagatttctattttcgaaggtaatttagttggtattggtacggtttcgggtcccgtcgtacggtccgtacccggaagggggaacggggtcgtggggaggttgggggtcggaccgaaacaaggtaaagggagggtagtagggggatacgagaactaattagttagtggttaggtagttcggtggtacggggccggggtaccgtagttaccaaccgttactttaccgaaggtaacgtaaccgaaccggaccgtaagtacgtcgtacgtaagttaactacgtacttacgaactaaagtaggaaggacgtacgtagaagtagttacgagtacggtacgtaacggacgttatacgttaagttagttggtacggtacgtaaggtagtttacgtaacgttagtttaccgaggtaccggtaaccgg

SEQ ID NO: 28793 - DNA, 653 bp, Homo sapiens
  misc_feature: GYAE6OF01BMONE.13.55.E11.1.454.CMB.1.raw
  modified_base (243)..(243): a, c, t, g, unknown or other
  misc_feature (243)..(243): n is a, c, g, or t
tcagtcacgtactacacgaccggtgctcgatttagcactcgcacgttgggtttggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatcctcctgcactgggaccagcagtgacgttcgnggtcaagctatgtctcctggtaccaacaacacccagacaaacgccccaaactcattattacgggtacaataagcgcctcagggtctttctgtactcgtcttctctcggctaccaagtcgtcggacaaccgacggtccctccctcgacctaacttctcgtcggtactccgacggcccgaggacggacggtctgtacttttacgtgtttcgttcattagtgacgtaacgggtaaggtacgttagtaatttagttcggttacgtttagggtaacggttacgggaaccgtaacgggttccgaaccggttccgtttacggtaccgtaacggtaccccgtaacggacccctaaaccccgtacgttacgtacccgtaccttacggttaccgttcccccgtcccgttccgttaaccgg

SEQ ID NO: 28794 - DNA, 551 bp, Homo sapiens
  misc_feature: GYAE6OF01AP5PA.13.55.E11.1.454.CMB.1.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (361)..(361): a, c, t, g, unknown or other
  misc_feature (361)..(361): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccggganagacggccacaattcccngtgaggaacaccttagaagtcagaatgtccactggtaccagcagaagtcaggccaggcccctgtggtggtcagtctatagggataagtaaccggccctctcgggatcccgtgaccgattctctggctccaactcggggaacncggccacctgacccatcaaacagacgacccaaggacgggatgaggctagacttattattgtcagggtgtggacagccacgacgtgatagttcggcggacggtaccaagcgtacgaccgtcgtaggtcacgcccaacggctcggcccctcggtccacctccgtcgttccccacccgttcctcgtcgtaccg

SEQ ID NO: 28795 - DNA, 636 bp, Homo sapiens
  misc_feature: GYAE6OF01BSZMS.13.55.E11.1.454.CMB.1.raw
  modified_base (289)..(289): a, c, t, g, unknown or other
  misc_feature (289)..(289): n is a, c, g, or t
  modified_base (314)..(314): a, c, t, g, unknown or other
  misc_feature (314)..(314): n is a, c, g, or t
  modified_base (598)..(598): a, c, t, g, unknown or other
  misc_feature (598)..(598): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttggcttacttgggttttccttgttgctattttaaaaggtgtccaatgtgagctgcagctggtggagtcgtggggaggtttggtacagccgagggcggtccctgagacctctcctgtataacttctggtattcaactttggggtnatttatgactatgaacgtgggtccncgaggctccgagggtagggctagggaggtggggttagtttcgagtttagggatacgtaatttcgtacaatggtaagtaggggaaacaacgaagaaacttaccggccgtacgtacgtaagtaaaacggcaaggtacttacgacaagttctagaacgtagtacgtagaacgtaccgaagaacgtacctaagtcccgtacctttacgtcgaccgaagtagtacggtaagttaccgaccgtaggaaacgaccggtaagacctacagcctaagtacttagttactagtntacgtagagtatagttacgactacgtcccgtacgtacg

SEQ ID NO: 28796 - DNA, 573 bp, Homo sapiens
  misc_feature: GYAE6OF01BHF1Z.13.55.E11.1.454.CMB.1.raw
  modified_base (461)..(461): a, c, t, g, unknown or other
  misc_feature (461)..(461): n is a, c, g, or t
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtcggctccctaagtacggactacgttactacgtgggctggactccggcacgcccgagggacgggctggagtggagtggggatagtctcgttagtaggtgggagtacgaactacaactccgtacctacgagacgtcgagtcatcatactcgtaagacgacgtcgaaggaacgtacttctccgtagaaagtgagttctgtcgacgtcgacagacgacgtctgtctattagttcgngacgagacggactaaagtgttaggttacgagggtacgttcgactacggtacgggccacgggtaaccctggtccgaccgtcgtacctcgacgtcctccgacgtacggtacccg

SEQ ID NO: 28797 - DNA, 522 bp, Homo sapiens
  misc_feature: GYAE6OF01BLNC7.13.55.E11.1.454.CMB.1.raw
  modified_base (200)..(200): a, c, t, g, unknown or other
  misc_feature (200)..(200): n is a, c, g, or t
  modified_base (512)..(512): a, c, t, g, unknown or other
  misc_feature (512)..(512): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccggganagatggacacaattccctgtgagggaaacaaccttagaagtcagaatgtccactggtaccagcagaagtcaggccaggcccctggtggtggtcatctagtagggataagtaaccgccctctgggatcccctgaccgattcctctggctcaacgtcgggaacacggccaccctgaccatcaacagacgccaagacgggatggagctagacttattatgtcaggtgaggacagcacgacgtgattagtcggcggcgggaccaagctcgaccgtcgtagtcacgccgaggctacggcccctgcactctcgtcccncctctgtacg

SEQ ID NO: 28798 - DNA, 656 bp, Homo sapiens
  misc_feature: GYAE6OF01C0ILY.13.55.E11.1.454.CMB.1.raw
  modified_base (200)..(200): a, c, t, g, unknown or other
  misc_feature (200)..(200): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccgganaggaccggccacaacttcccgtgtagaggaaacaaccttagaagtcagaatcgtccatggtaccagcagaagtcgaggccaggcccctgtcggtggtcagtctagtaggaataacgtaaccggcctacgtcgggactcccgtagaccgtacttctcgtcggcctaccgtaaccgttcgtacgggtaacctcgaacgcctacctctacgaacctactaccgacggtaccgggacccacgggctaacgtggagtacggacggtactagactttacttacgtcgtacgtacgggtcggtacgggacacgcacgccacgtccgcccgtcgttacgtcgttacgttaccgggaaccgtcgggaacccgtacgggtcccgtaacccggtaccgttaacgtcccgaccgtaaccccgaacccggtaaccccaacccctatacccggtacctccgtttaccccg

SEQ ID NO: 28799 - DNA, 678 bp, Homo sapiens
  misc_feature: GYAE6OF01DLR9H.13.55.E11.1.454.CMB.1.raw
  modified_base (185)..(185): a, c, t, g, unknown or other
  misc_feature (185)..(185): n is a, c, g, or t
  modified_base (230)..(230): a, c, t, g, unknown or other
  misc_feature (230)..(230): n is a, c, g, or t
  modified_base (268)..(268): a, c, t, g, unknown or other
  misc_feature (268)..(268): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (319)..(319): a, c, t, g, unknown or other
  misc_feature (319)..(319): n is a, c, g, or t
  modified_base (549)..(549): a, c, t, g, unknown or other
  misc_feature (549)..(549): n is a, c, g, or t
  modified_base (605)..(605): a, c, t, g, unknown or other
  misc_feature (605)..(605): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaacatggagtttgggcttacttgggttttccttgttgctaatttaaaaggtntccaatgtgagctgcagctggtggagtcgtgggggagtttggacngccgagggccgtccctgagactcgtcctgtatacttcnggattcaacgttgggtanatttagngtcttagtcgaacgtcggggtacccnccgagggtcctccgaagggggtaagggccttggggcccggttggggtccctagaagggtttatttgggtacgggtaggtgggtaaggaaacgcgtaacgagttaaccgtacgaccgacgaccgttccgggaggaaacgggtcccgggtttaacacccgtatccgtaccgaagacgaactaactaccgaaaggaacccatccgtataactcgtagaaccaaaagtcgaaanaccgtactaggacgacggacccggaggtaacccgaggtaccttaatagtttaccgnggtacgcgaagcgacggtcgagtacggcacggagacgtacgttaattaaccgttcgttacgacccggttaggg

SEQ ID NO: 28800 - DNA, 517 bp, Homo sapiens
  misc_feature: GYAE6OF01AW1JN.13.55.E11.1.454.CMB.1.raw
  modified_base (443)..(443): a, c, t, g, unknown or other
  misc_feature (443)..(443): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
  modified_base (505)..(505): a, c, t, g, unknown or other
  misc_feature (505)..(505): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggagtttggtacagccagggcggtccctgagactctcctgtataacttctggattcaacttgggtgattatgctatgaactgggtccgccaggctccagggaaggggctggagtgggtaggtttcattaggagcaattctcatgatgggacaacagaatacgcgcgtctagtaaaaaggcagattcaccatctcaagagatgagtccaagaagcatcgcctttcngcagatgagtagcctagaagaccgagacacagccatctaattcngtcnctagagagtattgnagtctacgaccg

SEQ ID NO: 28801 - DNA, 634 bp, Homo sapiens
  misc_feature: GYAE6OF01D5S40.13.55.E11.1.454.CMB.1.raw
  modified_base (265)..(265): a, c, t, g, unknown or other
  misc_feature (265)..(265): n is a, c, g, or t
tcagtcacgtactacacgaccggtgctcgattttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacgttgccggcaagtcagggcattagaatgtattaggctggtatcagcaagaaaccaggaaacnccctaagctacttgatctagtggtgactaattaccgtaaaggtttaaaaacggtcggggtaccctaagtacgtaaaggttcacggcggacgtaggtcggaattcgtaggaccaacgtacgtactttacgtactttcctaccacctataccaagaccacgtcctgacctacgtacctaaggtaacgtttacgttttacgaaccgtttaaactttaacttacttacgttaacgtaactaagtactacgtaacttaacgttaccgtacgttacgggttaccgttaccggaacggtaaccgggaacgtaaggtacgaaacgtacgaaacgtagtggtacgactagacctactacttctcgttcctacgttacc

SEQ ID NO: 28802 - DNA, 547 bp, Homo sapiens
  misc_feature: GYAE6OF01D4OZA.13.55.E11.1.454.CMB.1.raw
  modified_base (307)..(307): a, c, t, g, unknown or other
  misc_feature (307)..(307): n is a, c, g, or t
  modified_base (458)..(458): a, c, t, g, unknown or other
  misc_feature (458)..(458): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtcgtgggggaggtttggtacagccaggggcggtcctgagactctcctgtatactctggattcaacttgggtgtattatgctatgaactgggtccncgaggctccgagggaggggctggaggtgggtaggtttcagttaggagctaattctacatgagtgggacaacgagaatacggccgtcgtactaggtaaaaggcagtattcacctatcacaagagatgacgtccaagacgcatcgtcctttcngcagatgagtacgccgtagaacgacgagacacgagccattctaattcgtgtacgctaagagtagttatcgactacgtccctacgtaccg

SEQ ID NO: 28803 - DNA, 257 bp, Homo sapiens; identical to SEQ ID NO: 28735
  misc_feature: GYAE6OF01BHC2H.13.55.E11.1.454.CMB.1.raw
  modified_base (255)..(257): a, c, t, g, unknown or other
  misc_feature (255)..(257): n is a, c, g, or t

SEQ ID NO: 28804 - DNA, 582 bp, Homo sapiens
  misc_feature: GYAE6OF01BQER5.13.55.E11.1.454.CMB.1.raw
  modified_base (423)..(423): a, c, t, g, unknown or other
  misc_feature (423)..(423): n is a, c, g, or t
tcagtcacgtactacacgaccggtgctcgatttagcactcgcacgttggttttggggtgatcaggactcctcagttcaccttctcacaatgaggctccctgctcagcctcctggggctgctaatgctctgggtcccaggatccgagtggggatgttgtgatgactcagtctccactctccctgcccgtcacccttggacagccggcctccatctcctgcaggtctagtcaaagcctgtatacagtgatggaaagacctacttgaattggttcagcagaggccaggccagtctccaaggccgaccttaatttacgaaggtgtctgacaggggacctccggggtcccagacagattcagcggcaggtcgggtcaggcaactggatttccactactagtaaatcagcgagggtggagctggaggtnttaggtttagtgggtcttacgttattaagttgctatcggacaagcaaaccacgaccgtcgggtcccttaacgttaccgtttcgggacccgtacgggggtaacccacggcgttagggaacaacgttaccgaaagtaccggtaaacttgggtacggtcccg

SEQ ID NO: 28805 - DNA, 576 bp, Homo sapiens
  misc_feature: GYAE6OF01ETPAU.13.55.E11.1.454.CMB.1.raw
  modified_base (473)..(473): a, c, t, g, unknown or other
  misc_feature (473)..(473): n is a, c, g, or t
  modified_base (517)..(517): a, c, t, g, unknown or other
  misc_feature (517)..(517): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtcgtggggggaggtttggtacagccaggggcgtccctgagactctcctgtataacttctggattcaacttgggtgattatgctatgaactgggtccgccaggctccgaggggaggggctgggaggtgggtaggtttcagttagggagctaattctcagtgagtgggaacaaacagaactaccgccgcgtactaaggtaaaacggcaagtattcaaccatctacaagagatgacgtaccaagaacgcactccgtcctttcgngacagtagtagagtacgcgtaaggaacgaccgaggaccacgacnccatacttaagttcgtagtcgtagtagagtagttatacgactacgttccctacgtaccg

SEQ ID NO: 28806 - DNA, 608 bp, Homo sapiens
  misc_feature: GYAE6OF01EM1YH.13.55.E11.1.454.CMB.1.raw
tcagtcacgtactacacgaccggtgctcgatttagcactcgcacgttgggtttggggggtctcagagaggagccttagccctggactccaaggcctttccacttggtgatcagcactgagcacagaggactcaccatggaattggggctgagctgggtgctccttgttgctattttagaaggtgtccagtgtgaggtgcagcgtggtggagtcggtggggggggcttggtccagccgtggggggtccctgagactctcctgtgcagcctctggattctacgttttagtaggtattggagttggggttgggtccgccagactccgaggaggaagggctgggagttgggcgaccaaacgaagtaaaagggagagtaggaagtaggaaaagtatacgtagtggtaggactgtgtaggaacgggccattcacgtatcctacgagagaacaacgaccaaagacctacacgtgtactctgacaagatacgaccgagccgtagaggtagtacggaggagtacggtcgtggttagttaagtttagttggttggacggtaggaaggtaggtacgggggtacctaacggtaactttagttttagggtagggtaagggg

SEQ ID NO: 28807 - DNA, 685 bp, Homo sapiens
  misc_feature: GYAE6OF01BIG4K.13.55.E11.1.454.CMB.1.raw
  modified_base (374)..(374): a, c, t, g, unknown or other
  misc_feature (374)..(374): n is a, c, g, or t
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcgagttgtaatgtgtctggtgctcctaagtaggactacttactactgggctggatccggcacgcccgagggaagggctggagtggagtggggatagtctcttagtagtgggagtacgaactacaactccgtacctacaagacgtcgagtcatcaatactcgtanacgaggtaccaaggaatagtacttcctaccgtaagtaagtgtaacgttgtacgtacgtacgtccgacgtacgacgtaccggtcttacgttactttaacgtttagttggtaccggtaacggtaaccggaacggttaaaccgtaaaagtttacggtttccgggttaacgggtacgggttaacggtttaaccggtaaccggttacgggtaccgggaaccgggtaacgggttaacccggttcggtaccccgtaacccgttcccgtacccgttaccgaaccgttacccccgtaaccgtaacccgggtaaaccccgg

SEQ ID NO: 28808 - DNA, 595 bp, Homo sapiens
  misc_feature: GYAE6OF01A5SAS.13.55.E11.1.454.CMB.1.raw
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaatgatttagctggtatcagcagaaaccaggaagcccctaagctctgatctagtggtgctatacctaaggtttaaaaaggtcgggtacccatacgtaaggttcgagcggacagtggatcgtggcacgtagtaccttcactttcctacaccatcacgccacgcctagcctacgccgttagtaagttagttttacgacttaacgtttacttacttgttaccttaacgaagtaacttcaacttaattacgtacccgttacggggttaacgttaccgggaccgtaaacgggaccgtaaggtaacgaaacttaccggaaaacgtacgttggtacggtaccgtgacctacgtacttacgttcgttccttcgtacc

SEQ ID NO: 28809 - DNA, 752 bp, Homo sapiens
  misc_feature: GYAE6OF01CYFHB.13.55.E11.1.454.CMB.1.raw
  modified_base (306)..(306): a, c, t, g, unknown or other
  misc_feature (306)..(306): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagatgggcctgtcccagctgcagctgcaggagtcgggcccaggagtggtgaagccttcggagaccctgtccctcagttgtaatgtgtctggtgctccctaagtaggactacttactacgtgggctggactccggcacgcccgagggaagggctggagtggagttgggatntcgtcttagtagtgggaagtacgtaactacaactaccgtaccctanaagngtacgagtacatcatatccgtaagacgacgtaccgaaggtaacgaagtttcctacccgtaggaaacgttcgaagtttccgtaggtacgtacccggttacgaccgaacgggtaccgtaccggtccgttacggttacctttaagttttaacgtttacggttacgggaccggtaaaccgggtaacgggtaaacccgtaaaaggtttaccggttaggggtttaacccgaagggggttaaccgtttaccggaaacccgggtttacggttacccggggggaacccgtaaaccggggggtaacccccttacggggttaccccgaaccccggtttcccggttaccccgtttaccggaacccgtaccccggtacccccttaaaccggaacccgggtaaccccccg

SEQ ID NO: 28810 - DNA, 722 bp, Homo sapiens
  misc_feature: GYAE6OF01AO3GO.13.55.E11.1.454.CMB.1.raw
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgctattttaaaaggtgtccaatgtgagctgcagctgggtggagtcgtgggggaggtttggtacagccaggggcgtccctgagactctcctgtatacttctggattcaacttgggtnattatgctatgaactgggtccncgaggctccgagggaggctggaggtgggtagtttcagttaggagactaattctcagtcgagtagggacaacgagaactacggccgcgtacgtaaggtaaaacggcaagtacttccgaacctagtacctacgaaaggacgtaatacggaacgttacccgaaaggaaccgtacgtaaccgttacccgtcccgtttttacgtacggacgtaacggtacgttaacggtaacggttacggtacccggttaaggaaaacccgggtaacccgggaacgggaacccgaacccgtaacggtaccctaaacgtttaccgttaaacgttttaccggtaggttacggttaacccgttaaggtaacggttaacgtttaacggttacggtacccttaaacgggttaccccgtaaaccggtaaccccgg

SEQ ID NO: 28811 - DNA, 808 bp, Homo sapiens
  misc_feature: GYAE6OF01A17TE.13.55.E11.1.454.CMB.1.raw
tcagtcacgtactacacgaccggtgctcgatttagcactcgcacgttgggtttgggtgatcaggactcctcagttcaccttctcacaatgaggctccctgctcagctcctggggctgctaatgctctgggtcccaggatccagtggggatgttgtgatgactcagtctccacctcctcctcgcctacctccgtgacgcggccgtcctactctcctcgtcgacgtacgttacgtacgaacgaaccgtccgttagtacaacgtaggtagtaggtaaaggtaaacctaaccgtttagttaagttaaggttttcggttacgacgacgaaggaccggtacggacgacgtacgtccgtaacgacgggaccttaactttaaatttaacgttacggtttttacccgggttaaccggtcgttacgggttccccgggtaacctaacgagtaacgttacgtacgacggtcggacgtaggggttacggacggacgaccgtacgtagttaccttaacgaacttaagttaaacgaacctacccgtaaaggggtgggtaccgtaggtcaaggggtaagttcggtttaagggttagttttaatttaccgtagtccgtagtaacgttcgaaacgtaacgtacgttaacgttctttacggggtaccccttttccgttaaccgtttaccccggggttacctacccggggttaaacggtaaacgttaagggtacccggtttaaacctaacggtaaccgttaaaccggtcggtttaaggccgttaccgtaccggtaacccctaagtttccctttcggtcggtttaaccc

SEQ ID NO: 28812 - DNA, 817 bp, Homo sapiens
  misc_feature: GYAE6OF01DLIPB.13.55.E11.1.454.CMB.1.raw
  modified_base (212)..(212): a, c, t, g, unknown or other
  misc_feature (212)..(212): n is a, c, g, or t
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagagtgggcctgtcccagctgcagctgcaggagtcggcccaggagtggtgaagtccttcggacgaccctgtccctnagttgtaatgtgtcgtggtcggccttacccgtaagtacggacttacgttactacgtgggctggacgtccggcaccggccccgaaggggaacgggcgtgggtaggtcgggaaggtttggggaattacgtccgttacgtttagtagggttacgggtaacgtaaccgtaaacttaaccgtaacgttccccggttaccctaagtaaacggtacggttaccgtaagttacccgaattaccgtaagttaccgtaccggtaacggaaccgtacgggtaccgaaaggtaaaccgttaacttacccgtacccgtaaggtaaagttcgtaacgtttccgtaggtaccggtacccgttcgacgaacgtaccgtacggcctttagttacctttagtttaagttcggtacgacgggtaacgaccgggtaacttaaaaggtttacgttacgggtttaaccggaaggggttaccgtttaaccggtaaccggtttaccgggtaccgggggtaaccccgtaaaccggggttaacccttcggggttacccgtaaccccggtttccgttacccggtacctaccggtaccccctacccggaacccgggtaacccgggttaccccg

SEQ ID NO: 28813 - DNA, 906 bp, Homo sapiens
  misc_feature: GYAE6OF01BYWB2.13.55.E11.1.454.CMB.1.raw
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacgttgggttttccttgttgcttaattttaaaaggtgtaccaatgtgagtctgcagtcgtggtggagtcggtgggggtaggtttggtacagccgaggggccgtccctgacgtactcctccgtagtacttaacttcgtaggtactttaccaacgtttgggtagtaatttagtgtacttaagtacggtaaccggttcggggtccccgaccggtacgggtcccgttacccggggaagggggtaaacggggggtccttagggggtagggtttacgggggtttaaggttttaccgtaaaggtttaacggggagtaccttaaaagttttccgtacgtaagttcggtaacggtaacggggaaacctaaaacggaacgtaaaacgttacccggaccccggtaggtttaccgtaaaagggtaaaaacggtccgtaaacggttaaccttaacccgaacccttaacttaccgtaaaccgtaaaggtacggtaacgttaacggtaaccgttacccgtaaaaggacccgtaaccgttaaccgtttaccccggttaccttttaccgtacggtaaccaacggttaaggttacggtaaaccggttaccggtaaccgtaacgggaaaccggtaacccggaacggaaccctaaccggaccgtaaccctaacgtttaccgtttaacgttacggttaggtacggttaacgtaagggttaagtaacggtttagttaccggaacgttaacccgttaaccggtaccccgtaaccggg

SEQ ID NO: 28814 - DNA, 735 bp, Homo sapiens
  misc_feature: GYAE6OF01EA3OZ.13.55.E11.1.454.CMB.1.raw
  modified_base (203)..(203): a, c, t, g, unknown or other
  misc_feature (203)..(203): n is a, c, g, or t
  modified_base (224)..(224): a, c, t, g, unknown or other
  misc_feature (224)..(224): n is a, c, g, or t
tcagtcacgtactacacgaccggtgctcgatttagcactcgcacgttgggtttgggggagcctgggcctcaggaagcagcatcgggggtgccgcagccatggcctggaccgctctcctgctgagcctccttgctcactttacagcttctgtggcctcctatgagttgactcagccactctcagtgtcaggtcggccccggganaggaccggccaacaattcccngtgagggaaacaccttagaagtcagaatcgtaccactggtaccagcaagaagtcgaggccacggccccgtgtggtcggtcatctagtaggggataaacgtaacccggcctcgtgggactcccgtgaccgtattctcgtcggtcctaccgaaaccggtccggggaaccaccgggaccccacccgtacgaaccctagtaccaaacgacggaccgacccgaaaggacggggatcgggacggtctagtaacttagtttattcggtacgagggttggtacgggaactacggccgtaaccggtacgggtacggtaacgttacggttccggggccgggaacccggggtaacccgaacggtaccggtacggtacccggttaccggtacgggtccgaaccggaaccccggtaacggtcccgtccccggtaccccccggttcggttaccctacccggtttccccgttacccggttccccccggtaccccctttcccggttcccgttaccgggttacccggg

SEQ ID NO: 28815 - DNA, 746 bp, Homo sapiens
  misc_feature: GYAE6OF01B99E2.13.55.E11.1.454.CMB.1.raw
tcagtcacgtactacacgaccggtgctcgatttagcactcgcacgttgggtttggggagctctgggagaggagccccagccgtgagattcccaggagtttccacttggtgatcagcactgaacacagaccaaccaaccatggagtttgggcttacttgggttttccttgttgcttaattttaaaaggtgtaccaatgtgagctgcagctggtggagtcgtgggggagtttggacagccgagggcggtccctgagctctctgtataacttctggattcaacgttgggtgtattagtgctagtgaacgttcgggcccaccgaggtcctaccggaagggggaacgggtcgtagggacggttggggttagttttccgaagtttacgggacgtacgtaaattttccagtagtggaacgttaggggaaaccaaacgtaacggtaaacgttaccggcccgtacgtaccgtaagggttaaaaacggcgtaaaggtactttaccaaccgtaagttaccgtacgaaaggtaagtaagtacggtaacgtaacccgaaaggtaaacggtccctaaagttccccgtttcccgtttaccgtagaccgtaaggtacgttagggtaacggtaccgccggtaaggaacggaaccggtaacggaaccaaccgtacgacctacgttacttaacgtttacgtgttacggtacgttaacggtaagagttaacgttacggaacgttaccggttacccgaaccggtacg

SEQ ID NO: 28816 - DNA, 526 bp, Homo sapiens
  misc_feature: GYAE6OF01EF6I0.13.55.E11.1.454.CMB.1.raw
  modified_base (297)..(297): a, c, t, g, unknown or other
  misc_feature (297)..(297): n is a, c, g, or t
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatttagaggggatgctgtaatgactcagtctccactctcccctgcccgtcacccttggaccagccggcctccatctcctgcagttctagtcaaagcctcgtacatcatgatgggcacacctacttgaattggtttcggcagaggccaggcccaaatccnccaaggcgccttaatttataaggtgtctgacagggactccggggtcccagacagacttcagcggcagtggtcaggcactgattcactactagaaatcagcgagggtggaggcgtggagtagttgtagttggcttacttattagtgcatgactaagcaacacgtactggcctactcgtttacggaccgtagggaccaaggcgtaggagatcgaatacgaactggtgtccg

SEQ ID NO: 28817 - DNA, 536 bp, Homo sapiens
  misc_feature: GYAE6OF01C05WN.13.55.E11.1.454.CMB.1.raw
  modified_base (156)..(156): a, c, t, g, unknown or other
  misc_feature (156)..(156): n is a, c, g, or t
  modified_base (167)..(167): a, c, t, g, unknown or other
  misc_feature (167)..(167): n is a, c, g, or t
  modified_base (174)..(174): a, c, t, g, unknown or other
  misc_feature (174)..(174): n is a, c, g, or t
  modified_base (180)..(180): a, c, t, g, unknown or other
  misc_feature (180)..(180): n is a, c, g, or t
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (239)..(239): a, c, t, g, unknown or other
  misc_feature (239)..(239): n is a, c, g, or t
  modified_base (261)..(261): a, c, t, g, unknown or other
  misc_feature (261)..(261): n is a, c, g, or t
  modified_base (504)..(512): a, c, t, g, unknown or other
  misc_feature (504)..(512): n is a, c, g, or t
  modified_base (514)..(536): a, c, t, g, unknown or other
  misc_feature (514)..(536): n is a, c, g, or t
tcagtcacgtactacacgaccggtgctcgatttagcactcgcacgttgggtttgggggggtctcagagaggagccttagccctggactccaaggcctttccacttggtgatcagcactgagcacagaggactcaccatggaattgggctgagcggngtgcagtgtcntatgagngcagtngagatgcgatggtgatcgnggggngctggtccgaggccgggggcatgagctctcctgancgccctcgagtatctattttanaggtaattattgggaatggtacgggtttggggtccccgaccgtaggtttcctaccccgggtaaggggggaacggggggtacgggtacgggggtacggggtttacgggggtaggggggtacccccgtaaaacgtaaaacgggtaaaaaacgggggtaaaacggggggttaaaggggttaaacggggggttaaaccggggggttaaacccggtaaaaccgggggtaaaacggtttaaaaacgggnnnnnnnnngnnnnnnnnnnnnnnnnnnnnnnn

SEQ ID NO: 28818 - DNA, 763 bp, Homo sapiens
  misc_feature: GYAE6OF01CCX2D.13.55.E11.1.454.CMB.1.raw
tcagtcacgtactacacgaccggtgctcgatttagcactcgcacgttgggtttgggggggtctcagagaggagccttagccctggactccaaggcctttccacttggtgatcagcactgagcacagaggactcaccatggaattgggctgagctgggtgctccttgttgctattttagaaggtggccagtgtgagatgcgacgtggtggagtcgtgggggaggcgttggtccgagggcccgggggggtcacgtggagacctctccgtgtacagcctcgagtattctattttcgaaggtaattagttggattggtaggtttcgggtcccgtccgtaggttccgtaccggaagggggaacggggccgtggggtaggttgggggtacggacccgaaacgtaaggtaaaacgggagggtaaggtaggggaagtcgaagactaagttagttaagttggtagggtagttcgttgggtcgggccgggggtacccgtacgttaccgtaacccgttacgtttacccgaaggtaacgtaacccgaaaccgacccgaagtacgtaccgttacgtaagttaacttaactccgtaggaacctaaagtcgggaacggaacgtacccggtaggaacggtacggtacggtagttaggtaacgttaaccgggtaccttaacgtaagtttaacgttttagttacggttacggtaacggtaaagttaagtttacggtaaaccgtttacggttttaacccgaaggggtaacccgggtaaccgg

SEQ ID NO: 28819 - DNA, 645 bp, Homo sapiens
  misc_feature: GYAE6OF01DMCDL.13.55.E11.1.454.CMB.1.raw
  modified_base (202)..(202): a, c, t, g, unknown or other
  misc_feature (202)..(202): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcaggtcggccccggganaggaccggccaactaacttccctggtaggaacgggaaacctaaccgttaggaagtcaagaatcgtaccagtggtaccagcagaagtcaggccaggcccctggtcggtggtcatctagtaggataacgtaaccggccctcgtcgggactcccgtagaccgtattcctctcggacctccgaacgtcggggaacaccgggcccaacccgtcgacccataccaacgacgacgacccgaaggacggggatcggaggtcacgtactagtttagtgtgaggtggtaggacgagccacgacgtgtacgtagttcgggaccgggcgggaccgaacggtctacgggacccgtacgtacgtcgaccggacccgtaacggcctcccggacccccgttcggtaccctccgttaccgttcccttaccccctacccttcccgtgttaccggttaccgg

SEQ ID NO: 28820 - DNA, 614 bp, Homo sapiens
  misc_feature: GYAE6OF01BBV2V.13.55.E11.1.454.CMB.1.raw
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagatgggcctgtcccagctgcagctgcaggagtcggcccaggagtggtgaagccttcggagaccctgtccctcagttgtaatgtgtctggtcgctccctaagtaggactacttactactgggctggactccggcacgccccgagggaagggcgtggagtcggagttggggatagtctcgttagtaggtgggtaagtaccgtaataacgaactaccgtccctacaagacgtcgagtacacgtacattatccgtagacgacggtccgaaggaactaactttcctacccgtagaaacgtgtacgttcgtagtacgaccgtcgacgagaccgacggctgtacttattattgtgtcgagacggactaaagtgtagtacgtaggtcgttacgacgttagtacggggccgacggggtaccctgggtccctacccgtcttacccgtacccaacccttacccgaaccgaaccgggtccctaacccgg

SEQ ID NO: 28821 - DNA, 598 bp, Homo sapiens
  misc_feature: GYAE6OF01EI07X.13.55.E11.1.454.CMB.1.raw
  modified_base (186)..(186): a, c, t, g, unknown or other
  misc_feature (186)..(186): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagttgacccagtctccatccttcctgtctgcatctgtagganacagagtcaccatcacttgccggcagtcaggactattaacagtttatttagtctggtatacagacaaaacgaggaactcctagctctgatctatgtgctatacctaagtttggaaacgtcgggtacctagtacgtaaggttcagtaggtaagtggatcgtagggactagttacttttactcgactatacagcgaactcgtgacgtacgtcctaaggaactattagttacgaactaatagttaactttagtgtacacgtagtaacgttataactaagttaactcccgttaccacttacccgtacccgttacgggaccgtaacgggaccaaggtaccgtaggtaagtaaacgttaacgacgttagacgtacgactaacctactacgttcttaccgttacttacgcccttacccg

SEQ ID NO: 28822 - DNA, 268 bp, Homo sapiens
  misc_feature: GYAE6OF01EWAYI.13.55.E11.1.454.CMB.1.raw
  modified_base (259)..(268): a, c, t, g, unknown or other
  misc_feature (259)..(268): n is a, c, g, or t
tcagtcacgtactacacgaccggtgctcgatttagcactcgcacgttgggtctgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcactccttcccgcatctgatagtacgtgactgagcgggctggcgaaggcgacagtagnnnnnnnnnn

SEQ ID NO: 28823 - DNA, 792 bp, Homo sapiens
  misc_feature: GYAE6OF01EGFYI.13.55.E11.1.454.CMB.1.raw
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacgttgggtttttccttgttgtcttaatttttaaaaggtgtccaatgtgagctgcagctggtgagtcgtggggtaggtttgacagccgagggccgtcctgacgactctctgtactaacttcgtgtattctaacgttgggtatattagtcgtacttagtacggtaacgtcggggtcccgccgtaacgggtcctaccggggaagggggaacggggtcggtaggggtagggtttaggggtttacggtttacgtaaggttaagggacgtaacgttaaactttcccgttaagaggttaggtaacgggtaacgggaaactaaacgaagtaaaccgtaacccgggtccgtacgttaaacgtaaacggttaaaacggactaacgttacttacccgaaccttaacgtaccctaagtaaggagttaagtacggtaacctaacgaaacgacgtaccgtacgttcccgttacctttcgtagaccgtaagtacggtagtaacggtacgtaccggtaacggaaacccggtaacgaacggacccaacgaccgtaaccttagttaacctttaacgttacggttacgtaaggtacgtaaggtaacgttaaggtttaccgttaacgtaccgtaaccgttcccgttaaccggtaaccgg

SEQ ID NO: 28824 - DNA, 603 bp, Homo sapiens
  misc_feature: GYAE6OF01EMLUW.13.55.E11.1.454.CMB.1.raw
tcagtcacgtactacacgaccggtgctcgatttagcactcgcacgttgggtttgggatgctttctgagagtcatggatctcatgtgcaagaaaatgaagcacctgtggttcttcctcctgctggtggcggctcccagatggggcctgtcccagctgcagctgcaggagtcggcccaggagtggtgaagccttcggacgaccctgtccctcagttgtaatgtgtctggtggcctacccgtaagtagacttacttacgtacgtgggctggatccggcacgcccgagggacgggctggagtggagttggggattagtcgtcttagtaggtgggagtacgaactacaacgtccgtacctacaagtacgtcgagtctatcaatacgtaccgtaagacacggtaccaaggtaactaagttcctacccgtagtaaacgtgtacgttcgtgtacggtacccgtcgacgagaccgtacgtcttcgtactagtttacgtgtacgcgtagacggataaagtgtggttagacgggtatcgactcggtacgggaccgtacggtaccgtggtccgtacccgtctacccgtacgaccgcccaccaccgaacggtcccc

SEQ ID NO: 28825 - DNA, 648 bp, Homo sapiens
  misc_feature: GYAE6OF01B84FR.13.55.E11.1.454.CMB.1.raw
  modified_base (299)..(299): a, c, t, g, unknown or other
  misc_feature (299)..(299): n is a, c, g, or t
  modified_base (314)..(314): a, c, t, g, unknown or other
  misc_feature (314)..(314): n is a, c, g, or t
  modified_base (633)..(633): a, c, t, g, unknown or other
  misc_feature (633)..(633): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatccctccctgtctgcatctggtaggagacagagtcaccatcgacttcggcccgggacaacggtcgaggggctaagttaagaaagtgtaagtttaggctggtatcagacaacgaaaccgagggaacgcccctaagcctntagatcgtagtggtnactactacctaaaggtttaaaacggtcgggtaccagttacgtaaggttcgaggccggagtacggtaggtactcggtcggacacgatacttctacttacacctacctatcacggcacggtcctacgacctacgtaccgtaaggtaactttagttacgtaccttaaactttagttactcgttaacgtaacgtaagtactaaccgtaaactacgtttaccgtaccggttaccgggtaacggttacccgggacggaaaccgggtaacgtaaggtaacggaaaccgtacgaaacgtacgtaggtacgcctagaccctagtactntcttcttcgtacccg

SEQ ID NO: 28826 - DNA, 574 bp, Homo sapiens
  misc_feature: GYAE6OF01E5NSL.13.55.E11.1.454.CMB.1.raw
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (363)..(363): a, c, t, g, unknown or other
  misc_feature (363)..(363): n is a, c, g, or t
tcagtcacgtactacacgaccggtgctcgatttagcactcgcacgttgggtttggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaatcataatttatgatttcactaatcggccctnagtntatctaatcgcttcactggctcaagtctggcaacncggcctcctgaccatctcgtgggcctaccgaggacaggacggacgaggctagattattacgtgccgctccgtaggaccgtattacgacctacccttttagtcgttacgttcgggtacttggtacgaccgtaacggtccaacccgttccgtaggtccaacgccccaacggaccccaaaccccgtctcgtaccacttcccgtcgttccccccg

SEQ ID NO: 28827 - DNA, 258 bp, Homo sapiens
  misc_feature: GYAE6OF01A0X7V.13.55.E11.1.454.CMB.1.raw
  modified_base (255)..(258): a, c, t, g, unknown or other
  misc_feature (255)..(258): n is a, c, g, or t
tcagtcacgtactacacgaccggtgctcgatttagcactcgcacgttgggtctgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcatcttcccgccatctgatagtacgtgactgagcgggctggcaaggcgcatagnnnn

SEQ ID NO: 28828 - DNA, 841 bp, Homo sapiens
  misc_feature: GYAE6OF01AV6QQ.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccgaggtggggatgttgtgatgactcagtctccactcctccctgcccgtcacccgttggacacgcccggcctccatcctcctgctaggtctagtcaaacgcctgtatacagtagataggaaacgtaccttacgttagtaagtttggtttacagcaaggacggtccgaggcccaggtccgtaccgaacggtccgtacctttaatttaacgttaacgtttacggtttttaaccccgggactttccggtcggggtacccctagtaccgtagtacgttcgacggcggtaccgtagggttcgggtcgaggtacctacgttacgtaacgttttaccaacgttaagtttaacggtaaaacttccgtaaccgggtagggggtacgggtaaacgggtcgttagggtaaacgggttaggtttaggggtttaacggggtttaactttttaaacgttaccggttaggtaacccgttaagttaccggtaaccgttaacggtacccgttttaaccgttacgtttttcccgggtaccgggttttacccctttttaccggttaacccggttttccccgggaacccggtttaccggggaaacccgtttaaagggtacccggttaaacttaaccccggtaagttacccggtaaacggtttcggggtaccgtaccgttaacggtacccgtaacctttacgtttcccgttacgtttacccg

SEQ ID NO: 28829 - DNA, 601 bp, Homo sapiens
  misc_feature: GYAE6OF01D9VIQ.13.55.E11.1.454.CMB.1.raw
  modified_base (557)..(557): a, c, t, g, unknown or other
  misc_feature (557)..(557): n is a, c, g, or t
tcagtcacgtactacacgaccggtgctcgatttagcactcgcacgttgggtttgggggagctctgggagaggagccccagccgtgagattcccaggagtttccacttggtgatcagcactgaacacagaccaccaaccatggagtttgggcttacttgggtttttccttgttgcttaatttttaaaaggtgtccaatgtgagctgcagctgggtggagttcgtggggggtaggtttggtacagccgaggggccggtccctgagacctctcctgtattaacttctggtattctaacgtttgggtgtatttatgctatgtaacgtgggtcccgccgaggcctaccggagggggaaggggcgtagggaggtgggttaggtttcagttaggagactaattctcatgagtcgggaacaacgagaactacggccgcgtacgaaggtaaaaggcaagtacttacacctatactacgaagagtataggacgtacgaagaagcctagtccgtcctttctgctagatgagtacgctagaacgacgagacacgacactatctattcgngtagctaggagttaagtgttacgacttacgtcctaacgtacccg

SEQ ID NO: 28830 - DNA, 669 bp, Homo sapiens
  misc_feature: GYAE6OF01C8BY2.13.55.E11.1.454.CMB.1.raw
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccgggacagaccggccacaattccctggtagagggaaaccaaccgttagaacgtcagaatgtccactggtaccagcagaagtcgacggccacggccccctggtggtcggtcatcctagtagggataacgtaacccggccctcgtcgggactcccgtagacccgtattcctcgtcggtcctaccgacgtacggggaaccaccggccctacccgtcgaacccactacaacgacgacgacccgaaggacgggatggacgctagacttagttattcggtcgtagggtggtagggacacgaccgaccgacggtgtagttacgtccggggaccgggtcgggaaccgaacggtccgtacggtacccgtacgtaggtccgaccggtacccgacgggtccctccgggtccccccgttcggtcccttaaccgtccccgttccgggttcccccctcccctttccccgttcgttacggttacccggg

SEQ ID NO: 28831 - DNA, 589 bp, Homo sapiens
  misc_feature: GYAE6OF01DQEB0.13.55.E11.1.454.CMB.1.raw
  modified_base (272)..(272): a, c, t, g, unknown or other
  misc_feature (272)..(272): n is a, c, g, or t
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggttcgnagaggccaggcaatcacgaaggcgcctaatttactaaggtgtctgacgacgggaccgtccgggtcccagacagtacttcagcggcaaggtcggtacagggcacgtgtatttacacactagaaactcgagacgagggtcggaggacgtggaagggtagttacgttagttcgggtcttacgttaattttacgttgactagtacgacgtaagacctaacgacgtacgtcgggtacccgttactaccgttttcgggaccgtaacggggaaccaggtcgtaggagtaacgtactaaacgtaccgtaaacgtggtcggtaccg

SEQ ID NO: 28832 - DNA, 774 bp, Homo sapiens
  misc_feature: GYAE6OF01DFQX0.13.55.E11.1.454.CMB.1.raw
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgcttaattttaaaaggtgtccaatgtgagctgcagctggtggagtcgtggggggaggtttggtacagccgaggggcggtccctgagactctcctgtataacttctggattcaacgttgggtgtattatgtactatgaacgtgggtccgccgaggcctccgaggggaaggggctggggagttggggttaggtttcaagtttagggagtactaagtttctacagtgagtagggaacaaacgagaaactccggccgtacgtacgtaaggtaaaaacggcaaggtacttaccaaccgtacttaccgtaacgaaaggtaagtaagttacggaacggtacccgaaaggaaacgtccgtaacgttcccggttaccctttttacgtaggttaacgtacgttaggtaacgttaacggtacccgttaaagggaaaccgggtaaccccggtaaacgggaacccgaaccgtaaccggtaacccctaagtttaacccgttttaaacgtttaacccggtttggttacgttaacggttaaagggtaaagggttaacgtttaacgtttacggaccgtttaacccgggtttaacccccgtaaccgggtaccccttacgggg

SEQ ID NO: 28833 - DNA, 723 bp, Homo sapiens
  misc_feature: GYAE6OF01BWB55.13.55.E11.1.454.CMB.1.raw
  modified_base (201)..(201): a, c, t, g, unknown or other
  misc_feature (201)..(201): n is a, c, g, or t
  modified_base (402)..(402): a, c, t, g, unknown or other
  misc_feature (402)..(402): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccggganaggaccggccactaattccccgtgtaggaacgggaaaaccaaccgttaagaacgtcaagaatgtaccactggtaccagcagaacgtcgaggccacggcccctggtcggtcgtcatcgtagtagggtataacgtaccggccctcgtagggtactcccgtagacccgtacttctcgtacggcctaccgaacgtcggggaaccnccggtacccaccgtcgaaccacgtaccaaagacgaccgacccgaaagggacggggtactacgggacggtaccgtaggtaaactttacgtttaagttcggttaacggtaggggttcggtacggggaacgtacgacccgtaaccgtacggggtagtacgttaacggtccgggggaccgggaccgggtaaccctaagggtccctagggtacccgtaccggtacgtaccgaaccggacccgtaacggccgttacccggcccccgttaggacccttaccggttccttcccggttaccccgtccccttaccgtcgttaccggtaccg

SEQ ID NO: 28834 - DNA, 640 bp, Homo sapiens
  misc_feature: GYAE6OF01DHJPY.13.55.E11.1.454.CMB.1.raw
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccgggacagaccggccacaacttccctgtgaaggaacaccttagagtcagatgtccatgtaccagcagaagtcaggccacggcccctgtggtgtcatctagtaggataacgtaacccggcctcgtgggacttccctgaccgtattctcgtcgctaccgaacgtcggggaacaccgggacctacccgtacgacccactaccaaacgtacgaccgacccgaagggaacggggactgggaacggtctacgtacgttattacgttgtcgagggttggtacgggactacgccgaccgacgggtagtagttacggttaccgggcgggaccgggtaccaacgggtctacggtaccgtccgtacgggtcaccgtcccgaaggtcctaccgtcccccgtcggtccctacgtcccgttcccgttaccccacccctttcctcgtaacggttacccgg

SEQ ID NO: 28835 - DNA, 793 bp, Homo sapiens
  misc_feature: GYAE6OF01C7YZC.13.55.E11.1.454.CMB.1.raw
  modified_base (233)..(233): a, c, t, g, unknown or other
  misc_feature (233)..(233): n is a, c, g, or t
tcagtcacgtactacacgaccggtgctcgatttagcactcgcacgtttggggtttggggggggtctcaggaggcagcgctctcgggacgtctccaccatggcctgggctctgctattcctcactcctcctcactcaggacacagggtcctgggcccagtctgccctgactcagcctgcctccgtgtctgggtctcctggacagtcgatccaccatcctcctgcactggaaacngcagtgattcgttagggacttagagtacttgtctccgtggtaacccaaccaccaacccaggaccaaacggcccccaagacgtcacttactacgttttaggacgggggactaaacgtacgggaccgggtcccgttacggaacggggttacttttaccccgaaccgttccggtacccttttcgttccggttccgggtacccttacccgtaaacggtttccgttacgggacctaaaacccggaccgggttccccttaaccccgtaggtaaacctaacgttcccgttaccgttcgggtaccttaccccgaagggtctacggaacgggtaccggacgggtcctacggtccttaaggttaccgtgtaccttcggtacttacgtattaacgtacgtaccgttacggtttcctttacggttcgtttacgggttccggttccgggtaacgggtaccgggtaaacccgttaaggtcccgggtaacccgttacccgtagggtacccaacggtaccccgtaaggtccccgtacccggtcccccgtttaacggcccgttaccctttaccccgg

SEQ ID NO: 28836 - DNA, 240 bp, Homo sapiens
  misc_feature: GYAE6OF01BYPN6.13.55.E11.1.454.CMB.1.raw
  modified_base (233)..(240): a, c, t, g, unknown or other
  misc_feature (233)..(240): n is a, c, g, or t
tcagtcacgtactacacgaccggtgctcgatttagcactcgcacgttgggtttgggtgccagggggaagaccgatgggcccctggtcaccgtctcctcagcctccaccaaggcccatcggtcttcccctggcaccctcctccaagagcacctctgggggcacagcggccctgggctgcctggtcaaggactacttcctagtacgtgactgagcgggctggcaaggcgcatagnnnnnnnn

SEQ ID NO: 28837 - DNA, 840 bp, Homo sapiens
  misc_feature: GYAE6OF01DXP39.13.55.E11.1.454.CMB.1.raw
  modified_base (205)..(205): a, c, t, g, unknown or other
  misc_feature (205)..(205): n is a, c, g, or t
tcagtcacgtactacacgaccggtgctcgatttagcactcgcacgttgggtttggggagcctgggcctcaggaagcagcagtcgggggtgccgcagccatggcctggacccgctctcctgctgacgcctccttgctcactttacagcttctgtcggcctctatgagttgactcacgccactctcagtgtcaggtcggccccgganacggaccgccaactaacttcccgtaggtaggaacgggaaaacctaaccgttaaggaacgtcaaggtaattcggtaccctacgtacggtaacccgaaggaccgaaggtaaacgtccgacgggaccgacgggtcccccgttggtcggtacggtactacgttacgtaacggttaaggggtaacttaaaccggtaaccccgggtcccttaccggttacgggtacccttcccgtacggtaacccgttacgtttccgtacggtccggtaccctacccgtaaaccgggtaaccggggaaaccctaaccgacggtaccctaaccgtccgttaccgaacccttacgaccggaaccgggacccgggtaacccgtaacgtacccgtagtacgggtacgtacgggtacggtaccgttaggtaaccttagttaccgttacgttaccaacgttaacggacggtaacggtaaacctaacggttagttacgttaggtacgtacggtacggttcggtacggggtaccgggacggtaaccgtaacggtccgtacggtacccgttcccggtcggtaccgaccggtaccccgacgggtccccgttcccggtaccccgttaccgtaccgttacccttcccggtcccgttccccccg

SEQ ID NO: 28838 - DNA, 830 bp, Homo sapiens
  misc_feature: GYAE6OF01CM37Z.13.55.E11.1.454.CMB.1.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccggganaggacgccacaattcccngtagaggaaacaaccttagaagtcagaatgtccatggtaccagcagaacgtcacggccacggcccctggtggtggtccagtctaagtagggtaattaaacgtaacccggcccgttgtcgggtaactccccgtagacccgtatttcctacgtcggtcctacccgaaacggtaccggggaaccaccgggacccctacccgtacgaccctaactaccgaaacgaacgaaccggacccgaaagggacggggtaacgtaacgggacggtaccgtacggtaaacctttaagtttaacgtttacggttaccgtaaggggttacgggttacggggaaccgacggtaccccgaaaccggtacgggttacggtaacgttaacgggttccggggacccgggtacccggggaacccggtaacgggtccgttaccggtaaccccggttacccggttaacgggttacccggaaaccggtacccccggtaaccgggtacccggttaccccggtccccccccggttaacgggttaccccctaacccggttttcccccgttacccgggtttacccccccccgtacccccgtttccccgttaacccggttaacccgggtttaacccggg

SEQ ID NO: 28839 - DNA, 710 bp, Homo sapiens
  misc_feature: GYAE6OF01DXHSU.13.55.E11.1.454.CMB.1.raw
  modified_base (223)..(223): a, c, t, g, unknown or other
  misc_feature (223)..(223): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccgggacagaccggccaacaactttcccngtcgaagggaacaaccgttagaagtcagaatgtccatggtaccagacagaagtcaggaccacggcccctgtggtgtcatctagtagggaataacgtaacccggcctcgtgggactccctgaccgtattctctcggcctaccgaacgtacggggaacctaccggcccaacccgtcgaaccgtactaccgaaacacgacgtaccccgaaaggacggggaactggaacggtactaggtaccttaagttaacgttcgtacgtagggtacggttacgggaacacggtaccgaaccggtacgggtagaacgtttcggttaccgggcgggtaccggggtaaccaacggggtacctcgggtaaccccgttaccggtacgggtccaaaccggtcccgaacgggtcccgttcccgaccccccgggttacggtccccgtacccgttaccgtttcccgttacccccgacccctttcccgtaaccgttacggtaacccgg

SEQ ID NO: 28840 - DNA, 649 bp, Homo sapiens
  misc_feature: GYAE6OF01AGHV1.13.55.E11.1.454.CMB.1.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (303)..(303): a, c, t, g, unknown or other
  misc_feature (303)..(303): n is a, c, g, or t
  modified_base (409)..(409): a, c, t, g, unknown or other
  misc_feature (409)..(409): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccggganaggacgccacaacttccngtgaggaacaccttagagtcagaatgtccacgtgtaccagcagaagtcaggccaggcccctgtggtggtcatctataggataanaaccggccctcgtcgggactcccgtgaccgattctctggctccgaacgtcgggaacacggccctacccgtgaccactacaacacgacgacccgaaggaccgggganaggacggacgttacgaactatttagttgtacgtagggttcggtagggactaggccgaaccgtacgggtacggaagttacggtaccgggtccgggaccggggtaacccaagggtccgtacggacccgtaccgtagggtccacggtaccccgaacgggtcccgtcggaccccccgttcggtaccctaccgttcccgttaccgttcccccggccccttcccggttccgttaccggttacccgg

SEQ ID NO: 28841 - DNA, 656 bp, Homo sapiens
  misc_feature: GYAE6OF01DQ9M2.13.55.E11.1.454.CMB.1.raw
  modified_base (292)..(292): a, c, t, g, unknown or other
  misc_feature (292)..(292): n is a, c, g, or t
  modified_base (322)..(322): a, c, t, g, unknown or other
  misc_feature (322)..(322): n is a, c, g, or t
  modified_base (396)..(396): a, c, t, g, unknown or other
  misc_feature (396)..(396): n is a, c, g, or t
  modified_base (523)..(523): a, c, t, g, unknown or other
  misc_feature (523)..(523): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttggcttacgttgggttttccttgttgcttattttaaaaggcgtccaatgtgagctgcagctggtggagtcgtggggggaggtttggtacagccgaggggccggtccctgacgactctcctgtataacttctggattcaagttgggtntatttatgtcttatgaacgttcggggtccnccgagggcctaccggaagggggacggggtcgtgggaggttggggttagtttcaagtttaggagtctaattctanagtgagtgggaaacaacgagtaaactccggccgtcgtacgtaaggtaaaaggctaagtacttccaacctatcctaacaagagtagtagaacgtaccaagaacgcctaacgttcccgttcctttacgngacctaagtatcggaagtacgaccgtaggaaaccgaccggaagaccaacgtacgacctattacctagtttacgtggtacggtacgtaaggtacgtaagttcttacggacctaacggttcccctaacggtaccg

SEQ ID NO: 28842 - DNA, 785 bp, Homo sapiens
  misc_feature: GYAE6OF01ET098.13.55.E11.1.454.CMB.1.raw
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagagtgggcctgtcccagctgcagctgcaggagtccgggcccaggagtggtgaacggtccttcgggacgtacccgtcgtcccctgtacggtttagtaacgttgttcgttcgtggttcggtccttacccgtaaaggtaggtaaccttacgttacgttaccgtggggtctggtacgtccggaccgaccggcccccggaaggggaacgggcgtaggaggttggtaggttagggggacttacgtcgttacgtttagtaggtagggaacgttaacgaacttactaacgtcccgtaccctacgaagtacgtacgacgtactatacaactacgtacgtaacgtacgacggttaacccgaaggtaaccgttaacttccgtacccgtaagtaaacgggttcgtaacggtttcgtacgttaccggtaacccggttacgacctaacggaccgtaccgggttaccttacgttactttaagtttacgttggttacgacggtaacggtaaccggtataaacgttacggtttaggtaccggtaagggtcgttaaccggtacgttaccgggtacggggacccgtaacggggttaacccctcggtaccccgtacgtcccgtaccctccgtaccggtcccctacccggaacgtacccgggtaccccg

SEQ ID NO: 28843 - DNA, 771 bp, Homo sapiens
  misc_feature: GYAE6OF01BQ2W6.13.55.E11.1.454.CMB.1.raw
  modified_base (188)..(188): a, c, t, g, unknown or other
  misc_feature (188)..(188): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatccctccctgtctgcatctagtagganacagacgtccacatcacgttcgccgggcaagtcgagggctattagaaatgtattaggcttaggtatcagacgaagaaaccgaaggggaacctacccctaaggtccttacgttagattacgtagttcggtacgacctaagttaccgtaaaggttttaaaacggtccggggtaacctacgttaaccgtaacggtttccgacgggtaccggtacgtacggttacggtacgttacgtacggtaaccgtaacgtacgttacctttacgtactttacccgtacaacccgtataccgtacggaccctacggcccttaggaaccgtacggtaccgttaagtaaaccgtttattttacgaaccctttaaattttaccgtttacgtaccgttaactaaacgtagtaacttacaaaccgtttaacgttacccgttaccgggtacgggtttaacccgtaacccgggtaaccgaaacgggtaaccgtaagggttaaaccgtaaaaccggtacgtaaaaccggttggttaacgggtcgttaccgtaacgttacccgtaaccttacgtttaccgttacttacccgttccttaacccgg

SEQ ID NO: 28844 - DNA, 544 bp, Homo sapiens
  misc_feature: GYAE6OF01C45E8.13.55.E11.1.454.CMB.1.raw
  modified_base (444)..(444): a, c, t, g, unknown or other
  misc_feature (444)..(444): n is a, c, g, or t
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagatggggcctgtcccagctgcagctgcaggagtcggggcccaggagtggtgaagccttcgggagacccctgtccctcagttgtaatgtgtctggtggctccctaagtaggactacttactactggggctggatccggcagccccagggaaggggctggagtggattggggatatctctatagtgggagtacgaatacaatccgtccctcaagagtcgagtcatcatatccgtagacaggtccaggaacgaattctccctgaaagtgtagttctgtgacgtcgcagacacggctgtctattattgtgngagacggcaaatatggttcagggagttcgtataccgtggggccgaggggaaccctcggttcacccgtcttccctcaacgcctaccccaccgacgggaccc

SEQ ID NO: 28845 - DNA, 685 bp, Homo sapiens
  misc_feature: GYAE6OF01B7SLE.13.55.E11.1.454.CMB.1.raw
  modified_base (213)..(213): a, c, t, g, unknown or other
  misc_feature (213)..(213): n is a, c, g, or t
  modified_base (297)..(297): a, c, t, g, unknown or other
  misc_feature (297)..(297): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttggccggganaagtcgaggcattagaaatgtagtttaggctggtatcagcaacgaaaccgagggaacgcccctaagctacttgatctagtggtnactactaccgtaaggtttaaaacggtcgggtaccctagtacgtaaggttcgaggcggactaggtaggtatcgtaggacacgagtacctttactactttcctaccgacctacgtacgacgacgacgtccgtgaccgtacgtcctaaggtaagtttacgttttacgaacctttaaactttaactttaccgttagttacctaactaaacgtacttaacgtaaccttaaacgtttacgttacccgggttacggggtaacccgtttaacccggggaacccggtaaacggggtaacccggtaagggtaaacggaaaacttacccggtaaacggtaagttgggtacggacgttaccggacctaaccctagttccgttacgttccctttgtacccg

SEQ ID NO: 28846 - DNA, 714 bp, Homo sapiens
  misc_feature: GYAE6OF01AS76W.13.55.E11.1.454.CMB.1.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
  modified_base (352)..(352): a, c, t, g, unknown or other
  misc_feature (352)..(352): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctctagtgtcagtcggccccggganaggaccggccacaacttccctggtggaacggaaacctaccgttagaagtcagaatcgtccacgtcggtaccagacagaacgtcaggccacggccctggtggtcggtcntacgtagtaggactaacgtacccggcctgtcgggactccgtnaccgtattcgtacgtcggtacctaccgaacggtcgggaaccgtacggccctacccgtacgaacctactacgaaacgacgacgacccgtaaggggacggaactcggacgggtactcgggtaaccttaagttagttcgtacggacgggttacggacgggtaacgacggtaccgaacccggtaggtacgtaacgtcggttaccgggggaccggaccgggaaccgtacggtacgtaccgggacccggttacgtaacggtccgtaaccggtacccggaaacggtccccgtaacccgtcccccggtccgtccccgttaaccttcccgttacccgtccccctaacccgttccctcgtaaccggtaccgg

SEQ ID NO: 28847 - DNA, 889 bp, Homo sapiens
  misc_feature: GYAE6OF01B0ZOB.13.55.E11.1.454.CMB.1.raw
tcagtcacgtactacacgaccggtgctcgatttagcactcgcacgttgggtttggggactcaggacacagcatggacatgagggtccccgctcagctcctggggctcctgctgctctggctctcaggtgccagatgtgacatccagatgacccagtctccatccctcctgtctgcatcgtagtaggagacagactcaccatcacttgccaggcgagtcgaaggactaattaaacaaacttaattttaaaagttggtatacaagacaaagaaaaccgaagggttaaaacgaccccgtaaagccttaccgtagtaacttacgtacgaatcgacctaacttaccgtaagttttacggaaaaccggtacgggttaaccctaagtacgtaaacggtttactaaggggtacggtaaaggttcgggaacgttaccggttaaggggtaaacccgttaaaggttttaaacgtttttttttaacccgttttaacccgaaaacccgttaaactttaacccggaaaacggttcccggtaaaccgttccccgttaacgggaacccgtaacgggtacccccggtttaaaagggtaaaaacccggttaagtttaaacggtttaaccggaaaacccttaaaggttaaacttttaaacgttttaacgttaacgttaccgtaaaggtaaccgttaacgtttaaagttaacgttaaactttaacggttaccccttaaccccggtaaacgttacccgtttaacccgggtacccgggtaaaaccggtaaacccggggtaaaccgtaacgggtaaaccggttaacgggtaaaccgtaaaacggtttaaaacccggaagttacggttacggtacgtacggtaacctaaccgtaactttcgtcggtttaaccc

SEQ ID NO: 28848 - DNA, 779 bp, Homo sapiens
  misc_feature: GYAE6OF01D4FAJ.13.55.E11.1.454.CMB.1.raw
  modified_base (202)..(202): a, c, t, g, unknown or other
  misc_feature (202)..(202): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtcggcctcctatgagttgactcagccactctcagtgtcagtcggccccggganaggaccggccaactaacttccctgtaggaacgggaaaactaaccgttagaagtcaagaactcgtaccacgtcggtaccaagcgaagaacgtcgacggccacggcccctggtggtcggtcagtacgtaagtacgggtaactaacgtaacccggtcctcgtacgggtacttcccgtaggacccgtactttccgtcgtcggtacctacccgtaaacggtacggggaaacccaccgggtacccctaacccgtacgaaccctaacgtaccaaacgacggaaccgacccggaaagggacggggtatacgggaacggtcgtacgtaaacttagtttacgttcggtacggttagggtacggtacgggaactacgaccgaaccggtacgggttagtaacggttacggttccggggaccggggaccgggtaaccgtaacggtccgtaaccggtacccggttacggtaacgggtcccgaaccgggtacccgtaacgggtccctaccccgggtcccccggttacgggtcccttacccgtccgttacccgttaccccctaccccgtttccttaaccgtacggttaaccgg

SEQ ID NO: 28849 - DNA, 748 bp, Homo sapiens
  misc_feature: GYAE6OF01DO111.13.55.E11.1.454.CMB.1.raw
  modified_base (339)..(339): a, c, t, g, unknown or other
  misc_feature (339)..(339): n is a, c, g, or t
tcagtcacgtactacacgaccggtgctcgatttagcactcgcacgttgggtttggggatgctttctgagagtcatggatctcatgtgcaaagaaaatgaagcacctgtgttcttcctctgctggtggcggctcccagagtgggcctgtcccagctgcagctgcgaggagtccgggcccgaagggaggtggtagaagtccgttcggacgtaccccgtcgtcccctacgtagtttagttaagttggtcgttcgtgggtcgtccctacccgttaaggtacggacttacgttacgtacgtgggctaggacgtcccggacacggccccgagggacgggcgtggngtgggtacgttggggatagtcgttacgttagtaggtagggacgtaacgaacttacgtaacgtcccgtacctagtaacgtacgtacgacgtactatacgtaattacgtaccgtaagtacgtaacggtaccgaaggtaaacgtaacttccgtacccgtagaaagttacggtagtttacgtacgtacgtaccggttaccgacgaacggacgtaccggtccttagttacttagttatttggtacgtaacggtaggtaaccggattaaacgtagtttacgggttacgagggtacttacgggtaaccgtacgggtacgggtacccgtaacgggtaaccccgttggtaccccgtacccggttccgaccccgtacgtaccggaccccgtacccgtaaccggaaccggttacccccgg

SEQ ID NO: 28850 - DNA, 822 bp, Homo sapiens
  misc_feature: GYAE6OF01ASI9C.13.55.E11.1.454.CMB.1.raw
tcagtcacgtactacacgaccggtgctcgatttagcactcgcacgttgggtttggggagctctgggagaggagccccagccgtgagattcccaggagtttccacttggtgatcagcactgaacacagaccaccaacatggagtttgggcttacttgggttttccttgttgcttaattttaaaaggtgtccaatgtgagctgcagcgtggtggagtcggtggggggtaggtttggacaggccgaggggccggtccctgacgtacctctccgtgtcgccgagccttcgtcgggttccaccggtcagtccaaccacctacatggacgtcgtcgggtcccgacgacggctaccggaaggggacggggtctagggacgtcgtccgttctttagtttttaatttagttaaggttaggttaggttaacgtaactacttacccggtaccgtacaacggtaccgttcggtagggtaccgggggtaccctaagtttcccgaacccgtacttacccgtaccgaaggtaaccgtaactaaaccttacccgaaaacgtaaaccctaccggttacttttaacggttttacccttaaacgtaaaacgttacgaaaacccgtacggtacccgttaagggaacggttaaccggtacccggtaagttacccggggaaaccgtcccggggtacgtttaacgtttaacgtttaccggcgggttaggaccggtaagggaacgggtaccgggtccccggggaacccctaaacgggtaaccgtttaaccgacgtacgttagtaccggggtaccgttcgggaccgggggtaacccgtaaaccgggg

SEQ ID NO: 28851 - DNA, 763 bp, Homo sapiens
  misc_feature: GYAE6OF01BC6O3.13.55.E11.1.454.CMB.1.raw
  modified_base (739)..(739): a, c, t, g, unknown or other
  misc_feature (739)..(739): n is a, c, g, or t
tcagtcacgtactacacgaccggtgctcgatttagcactcgcacgttgggtttggggactcaggacacagcatggacatgagggtccccgctcagctcctggggctcctgctgctctggctctcaggtcgccagatgtgacatccagatcgacccagtcctccactccctcctgtctgactatcgtaggtaggacgacaggactaccaccatctacgtcgccgaggcgtacgtacgaggaactaacttaaactaaactttaagttttaaacgttggttaactaccgaagaccgtaaaacggtaaaacccgtaacgggtaaaacccgtaccccgttaaaggtccccttaccgtagtaaaccgtttaccgtaacggactaccggtacctaaacgtttaccgttaaaaggttttaaccgggaaaaccgggtccgggttaaccctagttaaacggttaaacgggtcgtaaggggtagggaaacgttcggtaacgtcggtaagggtacttaagttttaacttttacctaccaacgtataccgaagtccacgtccgttacgaccgtgttaacgaaggtaacttatacgtaacgaaactacttacgtttacgttactacgacggactaagtagttaactataaccgtccctcggtaacctactacccgttaccggacggaaaccgtaggactaccgggtaagtacccgtaaattaacccggtaacgtgtaccggacgtctaacccnctaactttcgtactttcgtaaccc

SEQ ID NO: 28852 - DNA, 806 bp, Homo sapiens
  misc_feature: GYAE6OF01CPMBZ.13.55.E11.1.454.CMB.1.raw
tcagtcacgtactacacgaccggtgctcgatttagcactcgcacgttgggtttggggggtctcagagaggagccttagccctggactccaaggcctttccacttggtgatcagcactgagcacagaggactcaccatggaattggggctgagctgggtgctccttgttgctattttagaaggtggccagtgtgagatgcgactgggtggagtcgtgggggaggtcgttggtccgagggcccgggggggtcacgtggacgacctcgtccgttgtacacgtccctcgtggtactttccaccgttttagtagtcttagttggtagtgacggtcgtacgggtcccgcgaacggtccgtcccggaaggggtaacggggtcgttagggacggttcggggtacggacccaaacgtaagtaaacggtaccgtaaagggtttacgggaaaggtagtaaacggtaaaatttaccgtaagttacgggtacggtaccttaggttacgggtagggaacggggtacccttaagttccccgaaaccttacgttaccctaccgggtaaacgaaaccggtaccctaaacccggaaccctaaacgggaaacccttcgtaacccgttaggttacctacgtacggtaactaaagtccgaaactcggtacccgttagaaccgggacgacccggtaaggacccgtaaaggggtcccttaggttaccctttaaaggtttccccgaggggttacggacccggtaagggtaaccgggttaaggggttaccgggggaaccggttaaaagggtttcgaagggtcgtaacgggg

SEQ ID NO: 28853 - DNA, 785 bp, Homo sapiens
  misc_feature: GYAE6OF01CCG3K.13.55.E11.1.454.CMB.1.raw
tcagtcacgtactacacgaccggtgctcgatttagcactcgcacgttgggtttggggagctctgggagaggagccccagccgtgagattcccaggagtttccacttggtgatcagcactgaacacagaccaccaacatggagttggcttacttgggttttccttgttgtcttaattttaaaaggtgtccaaatgtgagctgcagctggtggagtcgtgggggaggtttggtacagccgaggggcggtccctgagtactctcctgtataacttctggtattcgaacgttgggtagattaagtgtactagtagtaacgtcggggtacccgtccgaacggtccgtaccggaagggggaacggggtcgtaggggtaggttagggggttacggttttccgtaaaggtttaagggacggtacgtaaacgtttcccgtagtaacgttaggtaaggttacggggaaactaaaaccggtaaacgtaaaaccgtaccgggtacccggtaccgttacgttaaacgggtaaaaaaggcccgtaaaggtacctttaaccgaaccctacttaccgtaacgaaacgaagtaacgtaggtaacgtaaccgaaggaacgacctaagttcccgtaccttttaccgacgacgtaacgtataacggtaagtacgtacccgttaaggaaaccggaacccggaacggaccctaaccgacgtaccctaaacgttaccgttaacgttacgtaggtacgtacgtaaggtacgtaagttagttacgacgtaccgtccgtaaccggtacccg

SEQ ID NO: 28854 - DNA, 788 bp, Homo sapiens
  misc_feature: GYAE6OF01AMI97.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccaggtggggatgttgtgatgactcagtcctccactcctccctgcccgtccacccgttggacacgcccggccctccacttcctcctgcgaggtctacgtacaaacgcctcgtatacgagtagagtaggaaacgtaccttacgttagtaagtttggttacagcaggacggccaggccacgtcctacgacggtactaccttaaattttacttaacgtttccggttttaacccgggcttcggtacgggtacccaggacgtagacttcgaggcggacgtaggtcgggtcacggtactacgttagttactttaccgaaattacgttaagtaaactcccgaaacgggtacggggtaggggaagtacggtacgggtaagggttaggtttacgggttttagggttaacttttttacggtaacgttaggtaccgttaaggttcggtaaccgttaacgttacctttaacgttacggtttcccggtttaccggtttcccctttttaacggtaccccggttttacccgggaccccggtttaaacggggtaaccttaaaaccgggttacggtaaccctaaaccggttaacgttacccggtaaaggttccggtcggttaccgtaaccgacccgtaacctttcgttcgttccttttaccccgg

SEQ ID NO: 28855 - DNA, 827 bp, Homo sapiens
  misc_feature: GYAE6OF01CU2JI.13.55.E11.1.454.CMB.1.raw
  modified_base (208)..(208): a, c, t, g, unknown or other
  misc_feature (208)..(208): n is a, c, g, or t
  modified_base (557)..(557): a, c, t, g, unknown or other
  misc_feature (557)..(557): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagtcttctgtcggcctctatgagttgactcgacgccactctcgtagtgtcgagtcgggccccggganacggaccggaccaactaactttccccgtggtacggaaacgggaaaacctaaccgttaggaaacgttcgaagtaaattcgtaccctacgtacggtaaccagaccaaggtaacgtcgacggcccgaccggccccgttggtgggtcggtactaacgttccgtaagtacgggaacttaaaccgtaacccgggtcccttacggtacgggtaccttccccggtacgtacccgtacgttcctcggtccggtacccttaccgaaaccgggtaccggggaaacccgacccggtaccccgaacccgtacgaaccctacgtaaccaaaccgacgaaccggacccgaacggggacgggtanacgggacggtacgtacgtaacttagtttaacgttacggtcggtaagggttcggtaagggaccgtacgacccgtaccgtaagggttacgtaacgtttacggtaccggggaccgggtaccgggtaaccgtaacgtccgttaacggacccgttcggtaccggtaccgacccggaccggaacggttcccgtcccggtacccccgttcgggacccttacccgttcccgtttacccggtacccccctaccgtttcccgtagttaacggttacccgg

SEQ ID NO: 28856 - DNA, 733 bp, Homo sapiens
  misc_feature: GYAE6OF01DH1AT.13.55.E11.1.454.CMB.1.raw
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (352)..(352): a, c, t, g, unknown or other
  misc_feature (352)..(352): n is a, c, g, or t
  modified_base (723)..(723): a, c, t, g, unknown or other
  misc_feature (723)..(723): n is a, c, g, or t
tcagtcacgtactacacgaccggtgctcgatttagcactcgcacgttgggtttgggactcaggacacagcatggacatgagggtccccgctcagctcctggggctcctgctgctctggcctcccaggtgccagatgtgccatccagatcgaccctgtcctccatccctcctgtctgctatctggagananacgagtccaaccatccgtacgttcgggacccggataaggtccgaagggtactaagttaaggaaatggtagtttaaggcttaggtaactcgaacggaccaaaacgaaaaccggagggaaacccgtacccctaagtccttacttagtaattcgtaagtcgggtntaccgtaagttaaccgttaaaagggtttaaaaccgggtcggtaccctaagtacggtaaacggtcgaacggcggacgtaaggtacggtctacggtgaaccgtaagtaacgtaacctttctacctttaccaaccctaactacgtaccgaacgacccgtacggtacctaacggacaacggttaccggttaaattaaacgttttcgtttaacgtaaacctttaacgtttacttaacgtaccgtttaacaaacgtacgtaactaacccttaattaacgtttcgtacggacgggttactacggaaccggaggtaacgaacgttgaaacgtacgtaaacgaggtcgtacaccggtcaaccgttctaagttcttacctnttccgtaccc

SEQ ID NO: 28857 - DNA, 762 bp, Homo sapiens
  misc_feature: GYAE6OF01A49AJ.13.55.E11.1.454.CMB.1.raw
tcagtcacgtactacacgaccggtgctcgatttagcactcgcacgttgggtttggggagcctgggcctcaggaagcagcatcgggggtgccgcagccatggcctggaccgctctcctgctgacgcctccttgctcactttcagcttctgtggcctcctatgagttgactcagccactctcagtcgtcaggtcggccccgggaacggaccggccaactaactttcccgtggtagaacgggtaaaaccaaccgtttaaggaaacgtcaagtaacgtcgtaccaacgtggtacccaggacgagaacgtcacggccacggcccctgggtggtcggtactacgttacgtaagtacggggtaactaacgttaacccgggcccttacggtacgggtaccttccccgtaggaacccggtatttccgtacgtccggccttacccgtaacgtacgggggaaccctaccgggcccctaaccgttcgaacccgtataaccgaaacgtacgaccggacccgtaaaggggacggggtaacgtagggaaccggtcgtaagtaccgtttaacgtttacgttacggttacccggagggtaccggttacggggactaccgggccgtaacgggtcccgaaccgtcggtaacccggtactttacgtaccggttcgtttacggaaccgttagggaccgtaaccggtccgtaaccgttccgtaaacgcgaccgtaccacggaccctaaccgactcgtcctacgttccgtccgttccctccttcg

SEQ ID NO: 28858 - DNA, 753 bp, Homo sapiens
  misc_feature: GYAE6OF01AJ2DJ.13.55.E11.1.454.CMB.1.raw
  modified_base (113)..(113): a, c, t, g, unknown or other
  misc_feature (113)..(113): n is a, c, g, or t
tcagtcacgtactacacgaccggtgctcgatttagcactcgcacgttgggtttggggagcctgcgcctcaggaagcagcatcgggggtgcctcagccatggcatggatccctntcttcctcggcgtccttgcttactgcacaggatccgtggccctcctatgagctgactcacgcccaccctcagtcgtccgtcgtaccccaggacagacacgccagccatccaccgtgctacgtaaggtaaattaacgtggacaagtaattaaatacttaccttccgtagtactcgaagactaaggtacgtccgacgggtcccctaccggttccccctggtcgtccgttacggtacctacttccgtaactcgaaagtaccgtcggaacccgtaaccgggcccgtacccgtaggaaccggtcctcccggtagacgtcgtacttccgtcgtcgacccttaccgaacgtcggtacggtaccctcgacctcctaccgttcgtaacgacccgtacgtaccggaacccgggcccggtaaacccgtagggtaccgttaagtcgggtaacggtacggtacccgttacgtaaccgtttaacgttttaaccgttaccggttcgggtaaccgggtaccgggtacggggtaaccggacgacggtaccgacggtacccgtaccggttcccgaaccgtttcgtaccggtttacggtccggttaccgggaaccggtacggtaccgtacggtacccgtacgtaacgtacggtacccgg

SEQ ID NO: 28859 - DNA, 839 bp, Homo sapiens
  misc_feature: GYAE6OF01A3ZF3.13.55.E11.1.454.CMB.1.raw
  modified_base (89)..(89): a, c, t, g, unknown or other
  misc_feature (89)..(89): n is a, c, g, or t
  modified_base (205)..(205): a, c, t, g, unknown or other
  misc_feature (205)..(205): n is a, c, g, or t
  modified_base (227)..(227): a, c, t, g, unknown or other
  misc_feature (227)..(227): n is a, c, g, or t
tcagtcacgtactacacgaccggtgctcgatttagcactcgcacgttgggtttggggagcctgggcctcaggaagcagcatcgggggtnccgcagccatggcctggaccgctctcctgctgacgcctccttgctcactttacagtcttctgtggccttcctatgagttgactcagccactctcagttgtcaggtcggccccgganacgaccggccactaacttcccnggtagaacggtaaacctaaccgttagaacgtcaaggtaactcgtaccacgttcggtaccagacaaggaacgttcgacggacccacggtccccgtggttacggtggtcagttcgtagtaggtactaacgtaccggtccctgtacggactcccgtacgtacctattcctcgtcggaccttaccgaacgtccggggtaaccaccggtaccctaccgtacggtaacccacgtaccaaacgaccggacgtaacccgaaacggggtaccggggtactaacgggaacgtccgttaacgggtactttaaccgtttaggtttacggtaccggtaggggtttaccggggttaggaaaccccggttacggaacccggttaacccgggaacggttacgggttaacgtttaacccgggttccggggtaaccgggggtaacccccgtaagggtaaacccgggtccgttaccggggttaacccccttaccggggttaaggtaccccgtacccgggtacccgtaaaccgggtcccgttaccccgggtaccccgtacgggttcccctaacccgttccccgtttaccgtccccccgtaccctttaccggttccgttaacccggttaccgg

SEQ ID NO: 28860 - DNA, 759 bp, Homo sapiens
  misc_feature: GYAE6OF01CZNF1.13.55.E11.1.454.CMB.1.raw
tcagtcacgtactacacgaccggtgctcgatttagcactcgcacgttgggtttggggactcaggacacagcatggacatgaggtccccgctcagctcctggggcctcctgctgctctggctcccaggtgccagatgtcgccatccaagatcgaaccctagtcctccactccctccctgtctgctagtcgtggtaaggacgacgaagacgtaccaacccatcctacgttcgggccgggaacaaggtccggaagggtactaagttaagaagttaggtaagtttacggtcgtagtactacgaacgacgaaacgtaaacccgtaaacggtaaaccgaccccttaacggaccttaccgtagtaaccttaccgtaacgttacgtacgtaccctaacttaaccggttaaaacgtttaacgggaaaaccgggtcccggggtaaccttaacgttaaccgggtaaggtttccggtaaagggttaacgggtaaggttaacgtacgtaccggtaagggtactaagttttacttttaccttacgaacctagttacaacgcgtaccgccgtagtaccgacgtacgtaaagaagtagttagtacgaacgtaacttaattaacgttaccgtagaccgtagagtaacgttagtactaacttaccgacccgtactaccgttaccgtaccgtaccgacggtaaccgaagaccgtaggtaaacggtaataaaccgttaacgtgtcggtacgtactcgtaacacgttactcgtcgttacc

SEQ ID NO: 28861 - DNA, 672 bp, Homo sapiens
  misc_feature: GYAE6OF01ANIUF.13.55.E11.1.454.CMB.1.raw
  modified_base (309)..(309): a, c, t, g, unknown or other
  misc_feature (309)..(309): n is a, c, g, or t
  modified_base (336)..(336): a, c, t, g, unknown or other
  misc_feature (336)..(336): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
tcagtcacgtactacacgaccggtgctcgatttagcactcgcacgttgggtttggggggggtctcaggaggcagagctctcgggacgtctccaccatggcctgggctctgctattcctcaccctcctcactcagggcatagggtcctgggcccagtctgccctgactcagcctgcctcgtgtctgggtctcctggacagtcgatcaccatcctcctgccacgtgggaccagcagtgtacgttcgtggtacaagtactatgtctcctggtaccaacaacacccagcaacggccccaaactcataatttangtattcactaagtcggccctcgaggtntatctaatcgcttcactcggctacagtcngcacncggcctccngaccatctcgtcggtcctcgcggacacggacggacggtaggtacctagtaactttacgttaccgtcgggaccggttccttaccggtaggtaccgttaacgtttaccgaccctttacccgtttagttcggttaccgttacgggtaccgttcgttaccggaacccggtacggttaccccgtacccggttaccgttacgggtaccccaacgggtacccccgaacccggtaccccccgtaaaccccgtaccgttaccggtaaccccttccgttaccccgttccgggttacccccccg

SEQ ID NO: 28862 - DNA, 280 bp, Homo sapiens
  misc_feature: GYAE6OF01C11EC.13.55.E11.1.454.CMB.1.raw
  modified_base (269)..(280): a, c, t, g, unknown or other
  misc_feature (269)..(280): n is a, c, g, or t
tcagtcacgtactacacgaccggtgctcgatttagcactcgcacgttgggtctgggacagacttcactctcaccatcagcagcctcgagcctgaagattttgcagcttattactgtcagcagcgtagcaactggccctccggccctttcgggcggagggaccaagggtggagatacaaacgactggtggctgcaccatctgtcttcactccttcccgctatctgatagtacgtgacgtggaggcggtctggacaacgggcgacaatggnnnnnnnnnnnn

SEQ ID NO: 28863 - DNA, 752 bp, Homo sapiens
  misc_feature: GYAE6OF01DFJMH.13.55.E11.1.454.CMB.1.raw
  modified_base (601)..(601): a, c, t, g, unknown or other
  misc_feature (601)..(601): n is a, c, g, or t
  modified_base (702)..(702): a, c, t, g, unknown or other
  misc_feature (702)..(702): n is a, c, g, or t
  modified_base (730)..(730): a, c, t, g, unknown or other
  misc_feature (730)..(730): n is a, c, g, or t
tcagtcacgtactacacgaccggtgctcgatttagcactcgcacgtttgggtttggggtgctctgggagaggacgccccagccgtgagacttcccaggtacgtttccacgttggtgatcagcactagaacacacgaccaccaacagtggtagtttggtctttacgttgggttttccttgttcgtacttaaagttttaaaaggtcgtacctaagtgtagacgctgcagtcgtggtggtagtcgtggtgggtaggttgacgaggccgagggtccgtccgtaaaaaggcgtactcctctagtaacttacgttcgtagtacttactaacggttgggtacttaattagtcgtaccttagtacggtaccgttcggcccgaccgacggccgtacggaaggggaacgggtcgtagggtaggttgggttaacgtttacgaaggttacgggacgtaacgttaacgttccgtacgtaagtcggtaaggtaacgggaaacctaaaggaacgtaaaccgtccggtacccggtagtaaccggtaaaggaaaccgcgtaaacgtactacccgatagtaccgaagaaggtaatgtaacgggactaagaacgtacgtnttaaccgtccttacgtttacaggactaaagcgtaaggtacgtaccgtcgaaacggtacgaacccgtagacctacgaacgtccctaaagttccgttaacgtnacggtcgtaacgtaaggacttgttaacngtaacccggtcttaccggaccg

SEQ ID NO: 28864 - DNA, 710 bp, Homo sapiens
  misc_feature: GYAE6OF01DLITY.13.55.E11.1.454.CMB.1.raw
  modified_base (327)..(327): a, c, t, g, unknown or other
  misc_feature (327)..(327): n is a, c, g, or t
  modified_base (342)..(342): a, c, t, g, unknown or other
  misc_feature (342)..(342): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatcgacccagtctccatccctccctgtctgcatctgtaggagacagagtcaccatcctacgttcggccgggacaaggtccgaagggtactaagttaagtaaagttgtacgttttaggacgtaggttacacgagacaaaacgaaaccggaacgggtaaaccaccccgtaagtcctacgttanaacgtctaggtgtanacgtactacgtaaaggttaaaggtcggtaccctagtactaaggtcaaggcgacgtaggtagatacgcggacaacgacgttacttctaccgttctacaccatcgaacgtcacggtcctacgacgtacgtacgttaacgaacgtttatttaaccggactttaaactttaacgttccgttaacgtactaaccgggtataagtttacgtaagttaacctaacccgttcgtaaccccgttacgttaacccgtaaccggttcgggaaacccgtaagggaaacccctaggttaaaggtaacggtaaaggttaaacccgtaaaggtacccgtgtaagggtacccctacgaaccctagttaaccgtcgttttaaccg

SEQ ID NO: 28865 - DNA, 751 bp, Homo sapiens
  misc_feature: GYAE6OF01E48FO.13.55.E11.1.454.CMB.1.raw
  modified_base (644)..(644): a, c, t, g, unknown or other
  misc_feature (644)..(644): n is a, c, g, or t
  modified_base (689)..(689): a, c, t, g, unknown or other
  misc_feature (689)..(689): n is a, c, g, or t
tcagtcacgtactacacgaccggtgctcgatttagcactcgcacgttgggtttgggggtctcagagaggagccttagccctggactccaaggcctttccacttggtgatcagcactgagcacagaggactcaccatggaattggggctgagcgtgggtgctccttgttgcttattttagaaggtgccagtgtgagatgcgacgtgggtggagtcggtgggggaggtcgttcgggtccgacgggtcccgggggggtcacgtggacgaccttcctccgtacgtacgacgccgtacgagtactttctattttacgaaggttaatttagttggagtggtacgggttcgggtcccgtaccgtacggttaccggtacccgggaaggggggtaaggggtcgtacggggtagggttacggggtacggaaacccgaaacgtaaaggttaaaaagggagggtaaaggtacggggtaagttaccgaaacggtaactaagtttaagtttaggttgggttagggtacgtttcggtacgggtacgggtacccggggtaccttaccgttacccaaccctttagttacccgaacggtaacgaacccgtaaccgccgtaagacgttacgtaacgtaagttactactacgtagaacgtaagngggtaacgcgtacgtaggtacgagtagtagacgtagaccgttaanagttattagttagttacgagtacgtaagttagtacgtacgttacgttacgaggtaccgtacg

SEQ ID NO: 28866 - DNA, 558 bp, Homo sapiens
  misc_feature: GYAE6OF01BAI5B.13.55.E11.1.454.CMB.1.raw
  modified_base (419)..(419): a, c, t, g, unknown or other
  misc_feature (419)..(419): n is a, c, g, or t
tcagtcacgtactacacgaccggtgctcgatttagcactcgcacgttgggtttggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaatcataatttatgatttcactaatcggccctcaggtgtatctaatcgcttcactggctccaagtctggcaacacggcctccctgaccatctctgggctccaggcagaggacgaggctgattattacngcgctccgtggacgattacgcctaacccttttatcgttccttcgggacttggtcgaacctaaggtccaccggttccgtagggtcacggccccaacggccccaaacccctacgtcgtaccaccttccgtcgttacccccc

SEQ ID NO: 28867 - DNA, 775 bp, Homo sapiens
  misc_feature: GYAE6OF01CT2K7.13.55.E11.1.454.CMB.1.raw
tcagtcacgtactacacgaccggtgctcgatttagcactcgcacgttgggtttggggagctctgggagaggagccccagccgtgagattcccaggagtttccacttggtgatcagcactgaacacagaccacaaccatggagttggcttacttgggttttccttgttgcttaagttttaaaaggtgtccaatgtgagctgcgagtcgtgggtggagtcgtgggggtagtttggtacagccgagggccggttccctggacgtacgtctcctagttatacttcgtggtacttacgtaacgttggggtatactttagtgtacctagtcgaaccggttcggggttaccccgcgtacgggcctaccgggaaggggaacggggtccgttaggggtagggttcggggtttaggtttacgtaaggttaggggtactacgtaattccgtacgtaagttcggtaaggttaccggggaaacaaacgtaaggtaaacccgtaccgggtacccggtacggttacggttaaaacgggtaaaaacggcgtaaacgtaccgtttaccaaccgtacttaccgtaacgaagtagtagtacggacgtaccgaagacgtacctacgtcccgttccgtttcgtacgtacgtaagtaggtacggtaacggtacgaccgtaacggaaccggtaaccggacgtacgaacgtaacggaccctaacttcgttaacttacgttgtacggtacttaaggtaagttacgtagttacggtactaccggttcctaccggtaaccgg

SEQ ID NO: 28868 - DNA, 665 bp, Homo sapiens
  misc_feature: GYAE6OF01EY2VQ.13.55.E11.1.454.CMB.1.raw
  modified_base (513)..(513): a, c, t, g, unknown or other
  misc_feature (513)..(513): n is a, c, g, or t
  modified_base (519)..(519): a, c, t, g, unknown or other
  misc_feature (519)..(519): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccaccctcggtgtcagtggccccaggacagacggccaggattaccgtggtagggggaaacaactagttggaaagtaaaagtgtgcactggtaccagcaagaacgccaggcccacggcccctggtcgcgtggtccgtctagtgttgatacggcggtacccggccctagagggactcccgtgacgtcgtatttcctcgttcggttaccaacgtcgtaggggaacttaccgacggccctaacttccgtacgaacccagtacccgaacgggtactacgacgggtacttagtcgggatggaacggtctagtaacttattacgtggtacgagggtcggacgggtacncggacncggacccacgtcggcccgttacgttagttccgtacggttccggaaggttaccgggaccaaacgggttcccgtaaccgttaccgtaacgtcccgaacgaccccgaaccggtacccctaaccccacgttcgtaccctacgttaccccg

SEQ ID NO: 28869 - DNA, 781 bp, Homo sapiens
  misc_feature: GYAE6OF01BJMGA.13.55.E11.1.454.CMB.1.raw
  modified_base (549)..(549): a, c, t, g, unknown or other
  misc_feature (549)..(549): n is a, c, g, or t
tcagtcacgtactacacgaccggtgctcgatttagcactcgcacgttgggtttggggagctctgggagaggagccccagccgtgagattcccaggagtttccacgttggtgatcagcactgaacacagaccaccaaccagtggtagtttgggctttacgtttgggttttccttgttgtacttaagttttaaaaggtcgtaccaatgtagagctgcagtcgtgggtggagtcggtggggtaggtttggtacgacggccgagggtccgtcccgtgacgtacctcctcctgtaacttacgttcgtacggtactttaccgtaacgtttgggtataattagtgtacttagtacggtacgttcgggtccccgaccgacggtccgtaccgggaagggggtacggggtcgtaggggtacgggttaggggttaggttcgtaaggttaggacgtactaattcgtactaggtagtaggtacggaacaacgagtaacgtaccgcggtacgtacgtaaggtaaacgctaagtacttaccaaccgttataccgaagaaaggtntaacgtacggaacgtaccgaaaggtccgacttaccggtccctttaccgttagcgtaactaagtcgtaaggtaaccgtacggaacgtaaacggaaaccggccggaacgaccaaccgtcgtaacccgttagtttaacccttaacgttgggttaagtacggttaaaccgtaagggtaacgtttaacggttcttaccccggaagtttaccccgttaccccggtacgttaacccggg

SEQ ID NO: 28870 - DNA, 751 bp, Homo sapiens
  misc_feature: GYAE6OF01EKX1N.13.55.E11.1.454.CMB.1.raw
  modified_base (189)..(189): a, c, t, g, unknown or other
  misc_feature (189)..(189): n is a, c, g, or t
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
tcagtcacgtactacacgaccggtgctcgatttagcactcgcacgttgggtttggggactcaggacacagcatggacatgagggtcccgctcagctcctggggctcctgctgctctggctcccaggtgccagatgtgccatccagatcgaccccagtctccattccctccctgtctgcatctgtagganacagagtcacctatctacgttcggccgggactaagtcgagggtctaattaagaaattgatttaggctggtatcgagacaagaaccgaggaacncccctaagctcttgatctagtggtcnctataccgtaaggtttaaaaggtcgggtacctatacgtaacggttcacggcggtacgaggttacggactacgtcggactacgtaacgtacttactacgttcctaccaacctacgttcgacgtaccgacgtacccgtcggacctacggtaccgttaaggtaacgtttacgttttacggtaacctttaaacgttttacgtttacgttacgttaaccttaacaagtttaactaacccgttaaattaaccgtttacgttacccgttaacggggttaacccggtttaacccggggtacccggtaaacccggggtaaaccggttaaacgggtaaaccgggtaaacgtaaaccggtaaacccggttaaacgggttacggttaccggggtacctacccgtaacgtaccccgtaaacgtttcccgtttacgtttacccgtaccgttaccccg

SEQ ID NO: 28871 - DNA, 682 bp, Homo sapiens
  misc_feature: GYAE6OF01DTVYT.13.55.E11.1.454.CMB.1.raw
  modified_base (271)..(271): a, c, t, g, unknown or other
  misc_feature (271)..(271): n is a, c, g, or t
  modified_base (556)..(556): a, c, t, g, unknown or other
  misc_feature (556)..(556): n is a, c, g, or t
tcagtcacgtactacacgaccggtgctcgatttagcactcgcacgtttgggtttggggagctctgggagaggagccccagccgtgagattcccaggagtttccacttggtgatcagcactgaacacagaccaccaaccatggagtttgggctttacgtttgggtttttccttgttgtcttaagtttttaaaaagggtgttaccaatgtgagtctgcagcgttgggtggagttcggtggggggtaggtttggtacagccgaggggccgtccngagtctctctgtatacttctgacttcgtagttggtgtattagtgtctagtagtaacgtcgggtccgccgaacggtccgtacggaagggggaggggtccgtaggggtaggttaggggttaggtttctaaggtttaaggaagtactaaattctagtagttagaggtacgggaaacaaacgtaagaaacgttaccggccggtacgtacgtaaaggtaaacgcaagttactaccgaactatacgtacgaagcgtatacggactacgaagacactacgttccttcttcgnacgaagtatggtaatacgacgtaacggacggacgaacgaccaagaccgctaacttatacgttccgtggttaacgcttaagggacgtaagtttaggtactacggttacccgttccgtaacggttccg

SEQ ID NO: 28872 - DNA, 731 bp, Homo sapiens
  misc_feature: GYAE6OF01D9460.13.55.E11.1.454.CMB.1.raw
tcagtcacgtactacacgaccggtgctcgatttagcactcgcacgttgggtttggggggtctcagagaggagccttagccctggactccaaggcctttccacttggtgatcagcactgagcacagaggactcaccatggaattggggctgagctgggtgctcttgttgctattttagaaggtggccagtgtgagatgcgactgggtggagtcgtggggggaggtcgttcgggtccgagggcccgggggggttcacgtggacgactcttccgtgtacacgtcctcgtcgggttcaccgtcagtccactacctactatgacgtcgtcggggtcccgaccgacgggtcctaccggagggggaacggggcgtgggagtggcgtttctttacttttagtttagttaggttagttggtaacgtacaacttaccgtccgactacgtaccgtcggtaggacgggtccgtagttcccaacactttcccgacgaaggacgtaaactaacgttacccaaagtaccctacgttccgttttagtttaccttaacgaaagtcgtaaaccgcgtacccgtgaaacggtaccggaccgtaagttaccggaacccgtaccgggttaccgttaggttacccttaggtcgggttagaccggaagggtagtacggggtacccgggtaaccccaaacgggttaaccgttaccgtaacggtacttacgggtacccgggcggtttaacccgggg

SEQ ID NO: 28873 - DNA, 270 bp, Homo sapiens
  misc_feature: GYAE6OF01BIN6M.13.55.E11.1.454.CMB.1.raw
  modified_base (241)..(241): a, c, t, g, unknown or other
  misc_feature (241)..(241): n is a, c, g, or t
  modified_base (259)..(270): a, c, t, g, unknown or other
  misc_feature (259)..(270): n is a, c, g, or t
tcagtcacgtactacacgaccggtgctcgatttagcactcgcacgttgggtctgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcatcttcccgcatctagagtagtacgtgacgtgaggcggntggcaaggcgacagtagnnnnnnnnnnnn

SEQ ID NO: 28874 - DNA, 854 bp, Homo sapiens
  misc_feature: GYAE6OF01EE6QE.13.55.E11.1.454.CMB.1.raw
  modified_base (664)..(664): a, c, t, g, unknown or other
  misc_feature (664)..(664): n is a, c, g, or t
tcagtcacgtactacacgaccggtgctcgatttagcactcgcacgttgggtttggggagctctgggagaggagccccagccgtgagattcccaggtagtttccacgttggtgatcagcactgaacacagaccaccaaccagtggtagtttggtctttacgtttgggtttttcctttgttgtactttaagttttaaaggtgtaccaagtgtgagtctgcgtagcgttgggtggtaggttcgggttagggggtaggttttcggacgacggtaccggacggggtcccgttcccgtggacgtaccttcttccgttagtaactttaacgtttcgtaggtactttacgtaacggttttgggtattaagtttatcgtacgttacgtaggtaaccggttcgggtccccgaccgtacggtccgaccggaagggggtaacggggccgttagggtagggtttacggggttagtttacgtaaggtttaccggaagttacgttaacgttacccgtagtacggttaaggtaggtaacccggaaaacgtaaacggtaaccgtttaaacgcccggtacccggtaccgtttaaacggtaaacgggtaaaacgtcgtaacgttaaccgttaaccaactttaacctagtaaccgaaaggtactagttaggtaacgtaccgaanaccgtctaaccgttcccgttattacgcgtataaggtacttcgggaacttaaccggcgtaaaggaacccgccgtaaggaccctaaacggcgttacgttaactaccgtttaacgacgtttgtacgggaaccttagggttaaactcggtttacctaaggttcccctttaacgtacccgtaaacggtttccccg

SEQ ID NO: 28875 - DNA, 968 bp, Homo sapiens
  misc_feature: GYAE6OF01AW0AE.13.55.E11.1.454.CMB.1.raw
  modified_base (201)..(201): a, c, t, g, unknown or other
  misc_feature (201)..(201): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtcgcctcctatgagttgactcagccactctcagtgtcaggtcggccccgganaggaccggccactaacttcccgtaggtacggaacgggaaaacctaaccgttaagaaacgtcaagtaactcgtacccacgtggtaacccagaccaagaagtcgacggtccacggccccctggtcggttcggtacacgtttaccgtaagtaacgggtaactaaacgtaacccgggacccgttacgtacggggtaacttccccgtacgggtaacccgtacgtttcctccgttcgggtaccctaacccggaaaccggttacccgggggaaaacccacccgggtacccctaaccttaccgtacgaacccgtaagttaccggaaacgggttaaccggggtacggtaaaccggggtccgggggtaacttacggggtaaccggggaccccgttaacgttaaaccgttttaaccggtacgggttaaccggtaaggggttacggggttacggggtaaccctaacgggtaccggaacggcccgttaaccggtccgggaccccgttacgttaaaccgttccgggtttaacccgggtttaacccggggaaaccggtttacccggggggaaaaccccgtttaaccggggtaacccgttaacccccggtttacccgttaaaacggggtcccccgtaaccggtaaacccccccgggtaaaccgggaacccccccgtaaaacccccccggttaccgttaccccgtttaaaccccgtacccgtttaccccggtttacccccgtttaacccccccgtaccccccgttttcccgtttaaaccccggg

SEQ ID NO: 28876 - DNA, 803 bp, Homo sapiens
  misc_feature: GYAE6OF01EOAV6.13.55.E11.1.454.CMB.1.raw
  modified_base (234)..(234): a, c, t, g, unknown or other
  misc_feature (234)..(234): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgcttaattttaaaaggtgtccaatgtgagctgcagctggtggagtcgtgggggagtttggtacngccgagggcggtccctgagactctctgtatacttctggtattctaacgttgggtgtattatgtactagtacgtaacgttcgggtcccgccgacggtcctccggaaggggacgggggtcgtagggtaggggattttacgggggttaacggttttacgtaagttttacgggaagtaccgtaagttttccgtacgtaacgttagggaagtaacggggaaccaaacgtaaagtaaacgtaaccggacccggtcgttaacgtaaagggtaaaacggtactaaagtaactttaccaaccttaacttacctaacgaaaggtaacgtaaacgtacggaacgtaacccgaacggaaacgtacctaacgttacccggtttaccccgttttaccgtacggtacctaaggttacgtaagggtaacggttaacggtaacccgtaaacgggaaaccggaaccgggaaacggaaccgtaaccgtaaccgaccctaacgttaccttacgtttaacgttaggttacgttacgtaaaggtacgtaaacgtttacgtacggtacccgttacggttaacccgtaaccgg

SEQ ID NO: 28877 - DNA, 696 bp, Homo sapiens
  misc_feature: GYAE6OF01B8MXR.13.55.E11.1.454.CMB.1.raw
  modified_base (149)..(149): a, c, t, g, unknown or other
  misc_feature (149)..(149): n is a, c, g, or t
  modified_base (197)..(197): a, c, t, g, unknown or other
  misc_feature (197)..(197): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagtcttcngtggcctctatgagttgactcagccactctcagtgcagcggcccgganaggacgccactaacttccgtaggtagaaggaaaacctaacgttagaagtcagaatcgtaccacgtcggtaccagcgaagaacgtcgacggaccgacggacccctggtcggtcggtacattacgtaagtaagggactaaacgtaacccggtcctacgtacgggtacctcccgtacggaacccgtattccgtcgtacggacctaccgtaaaccggtaccggggaaaccaccgggtacccaccgtacgaaccagtaccaaacgacgaacgaccgaagggtacgggactggaacggtctagtaacttattagtcgacgtagggtacggtacgggactacgacctaaccggtaggtagacgtttacggtcgggacggaccgggtaacaacgtcgaacgacccgtacgtacggtacgaccggacccgtaacggtcccgtacccggaccccggttcggtacctcccgtcgttcccgttaccccgcctttacctacggtacgtacgg

SEQ ID NO: 28878 - DNA, 1038 bp, Homo sapiens
  misc_feature: GYAE6OF01E03RN.13.55.E11.1.454.CMB.1.raw
tcagtcacgtactacacgaccggtgctcgatttagcactcgcacgttgggtttggggactcaggacacagcatggacatgagggtccccgctcagctcctgggctcctgctgctctggctcccaggtgccagatgtgccatccagatgacccagtctccattcctcctgtctgcattctagtacggagacagacgtcaacctatctaacgttcggacccgggacaacggtaccgaaggggtacctaagtttaaggaaaatttggtaagtttttacgggtccgttagggttaacttacgaacggaccgaaacgggtaaaaacccggaaacggggtaaaaccggacccccgttaaaacggtccgtttaccgtttagtaacgtttaccgtttaacggttacgggttcgtaccgtaaacgttaacccggtttaaaacggtttttaaaaaaacggggtttccgggggtttaacccccgtaagtttaaccggttaaacggggtttacgtaacggggtccggggtaccggtaagggttaacggggtaacgttcggttccggaccgtaaccgtaacgggttattttacccccccgattttacccgtacctaaacccgtactttaaccgacggtaccgtaaccggtcccgtacggtacccgacggttacccttaacgggttaaaggtttaaccgtttttacgtaacccgtttaaaaccgtttttaacgttttacccggttttaaacggttaccctttaaaaccggaaacgggtttaaccctttaaacggtaaaccttaaacccggttttaaaccgggtttcccgggtttacccgggggtttaaaccggggtttaccccgggtaaacccggggttaaacccggggtaaaccgggttaaacggggttaaacgggaaaaacccgttaaacccggtaaaaacgggttaaccttaacgggggttacccggttaaccggtaccggtttaaaccccgaaccgtttaccgtttaacggtttccccgttttaaagttccccggttttaaacccccg

SEQ ID NO: 28879 - DNA, 698 bp, Homo sapiens
  misc_feature: GYAE6OF01E2KZ1.13.55.E11.1.454.CMB.1.raw
  modified_base (676)..(676): a, c, t, g, unknown or other
  misc_feature (676)..(676): n is a, c, g, or t
tcagtcacgtactacacgaccggtgctcgatttagcactcgcacgttgggtttggggactcaggacacagcaatggacatgagggtccccgctcagctcctggggctcctgctgctctggctcccaggtgccagatgtgccatccagatcgacccagtcctccactccctccctgtctgctatctggtaggagacagagtccaccatctacgttcgccggacaagtcgaggctatagaatcgtagtttaggcttggtactcgacgacgtaacggaaaccgaacggggaaaccacccctaacgcttacgttgtaactcgttagtcggtacactaacgtaccgttaaaggttaaaacggtcgggtaccctagtacgtagtcgacggtcggactaggtagtcgtcggtacggtacaacgtacgtacctttactacgttttacccacctaaaccgtacgttaccgacgtacccgtaccgaccgttacgaccgtacgttaccgtaaggttaacgtttacgtttacgaacctttaacgtttactacgtttactactaagtactacgtacctaacttacgtacgtccggttacggttaccggttacgacgtaaacgggtaaccggtaaggtaaacgtaaacgtaaccgtaacgtaggttacggtacgcgtacacctaccgttnttacgttacttcctactacccg

SEQ ID NO: 28880 - DNA, 836 bp, Homo sapiens
  misc_feature: GYAE6OF01D9ER7.13.55.E11.1.454.CMB.1.raw
tcagtcacgtactacacgaccggtgctcgatttagcactcgcacgttgggtttggggagctctgggagaggagccccagccgtgagattcccaggtagtttccacttggtgatcagcactagaacacacgaccaccaaccagtggtagtttgggactttacgttgggttttccttgttgtacttaagttttaaaaggtgtacctaatgtagagtctgcagcgtggtggagtcggtgggggtagtttggtacgagccgagggtccgtccgtgactctctctgtacttacttcgtagtacttacgtacgttgggtgtattatgtacttagtaacggtacggtccgggtaccctaccgtaggtcccggtaccgggaaggggggtacgggtcggtaggggtaacgggtttgggggtttacggtttacgtaaggtttagggaacgttacgttaactttcccgagtaaggtacggtaacggtaacgggaaactaaaggtacggtaaaccgtcccggtaccgtaccggttaacgtaaagggtaaaacgcgtaaagttacctaccgtaactacgttacccaaggtaagtacgagttaacgaccgtaaggaacgtaccgtacgtacgttaccccttttccgttagtaccggtaacctaggttaacgttacgggaaccggttaaccacccggggtaaacggtaaccgggtacccggaaccgaacccggtacgtaacccgtacgtttacttaccgtttaacggtttacgtacggttacggtaacggtaaaggttaggttaacccgtaggttacccaacccggttacggttacccgtacgttaccggg

SEQ ID NO: 28881 - DNA, 608 bp, Homo sapiens
  misc_feature: GYAE6OF01CU16N.13.55.E11.1.454.CMB.1.raw
  modified_base (200)..(200): a, c, t, g, unknown or other
  misc_feature (200)..(200): n is a, c, g, or t
  modified_base (220)..(220): a, c, t, g, unknown or other
  misc_feature (220)..(220): n is a, c, g, or t
  modified_base (590)..(590): a, c, t, g, unknown or other
  misc_feature (590)..(590): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccggganaggaccggccacaattcccngtgaagggaaacaaccgttagaagtcagaatgtaccatggtaccagcagaagtcaggccacggcccctgtggtggtcatctagtaggataaacgtaacccggccctcgtcgggactcccgtagaccgtattcctcgtcggcctccgaaacgtcggggaaccaccgggacccacccgtgacccactacaaacgagacgtaccgaaggacgggatggaggtctagacttagttagttgtcgaggtgtagggacagccaccgaggtagagtagttccgggacgggacgggaccaacgcgtacggaccgtccgtacggtccgacgacccgaacggcctccgcccccgtcggtccaccgtccgtaccgttccccnccttcctcgtacgtacgg

SEQ ID NO: 28882 - DNA, 654 bp, Homo sapiens
  misc_feature: GYAE6OF01AOA00.13.55.E11.1.454.CMB.1.raw
  modified_base (481)..(481): a, c, t, g, unknown or other
  misc_feature (481)..(481): n is a, c, g, or t
  modified_base (494)..(494): a, c, t, g, unknown or other
  misc_feature (494)..(494): n is a, c, g, or t
  modified_base (634)..(634): a, c, t, g, unknown or other
  misc_feature (634)..(634): n is a, c, g, or t
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagagtggggcctgtcccagctgcagctgcgaggacggtccgggcccaggagtggtgacgtccgttcggacgaccctcgtccctgtagttgtagtgtgtcgtggtcgcctaccgtaaggtacggtacttacgttacgtacgtgggctggactccggcaccggccccggaggggacgggtcgtgggagttgggtagttggggtactgttcttacgttagtaggtagggtactaacgtaacacctacgtcccgtacctagaacgtagtctagtctactacgatactcgacgacgacggtcgaaggactactcgtcctagtacgtgtattcgacggttcgacctcgganacgaccgtacgtnttcgtacttagtttcgttgtacggacggtaacgacggtaactaaagttaggttacggtacggtagggtacgtacggtacgtaccgggcgggtaccgaacgggtccctggtacccctacgttccaccgtctcccgtacccnccgaaccggccggtaccccg

SEQ ID NO: 28883 - DNA, 670 bp, Homo sapiens
  misc_feature: GYAE6OF01ALHHX.13.55.E11.1.454.CMB.1.raw
  modified_base (651)..(651): a, c, t, g, unknown or other
  misc_feature (651)..(651): n is a, c, g, or t
tcagtcacgtactacacgaccggtgctcgatttagcactcgcacgttgggtttggggtgatcaggactcctcagttcaccttctcacaatgaggctccctgctcagctcctggggctgctaatgctctgggtccaggatccaggtggggatgttgtgatgactcagtctccactctccctgcccgtcacccttggacacgccggcctccatctctgcaggtctagtacaactcctctaatacagtagagtaggaaacgtaccttattgtaatttggttcagcgagacggccaggcagtcctacgaaggtccgtaccttaatttaacgttacgtttacggttttacccgggacttccggtacgggtaccacgacgtagtacgtcgacggcggctagggtcggtacgacgctacgtagtattcataagtaacaactacgacggtagggtagacggtactaggggagttaggtttgggtttaggttacttttaaggtccctaggtctaacgttacggactactaccgtaacgactaccggtttccggacccttacccggtcgttaccctaccgggttacccgacggtaaaccgggactaaacccgggtggaagggtaacgtacctaaacggaccggttaacgtgggttaccggnttacccgaactacgttacg

SEQ ID NO: 28884 - DNA, 894 bp, Homo sapiens
  misc_feature: GYAE6OF01DBIGW.13.55.E11.1.454.CMB.1.raw
  modified_base (90)..(90): a, c, t, g, unknown or other
  misc_feature (90)..(90): n is a, c, g, or t
  modified_base (145)..(145): a, c, t, g, unknown or other
  misc_feature (145)..(145): n is a, c, g, or t
  modified_base (222)..(222): a, c, t, g, unknown or other
  misc_feature (222)..(222): n is a, c, g, or t
  modified_base (442)..(442): a, c, t, g, unknown or other
  misc_feature (442)..(442): n is a, c, g, or t
  modified_base (487)..(487): a, c, t, g, unknown or other
  misc_feature (487)..(487): n is a, c, g, or t
  modified_base (877)..(877): a, c, t, g, unknown or other
  misc_feature (877)..(877): n is a, c, g, or t
tcagtcacgtactacacgaccggtgctcgatttagcactcgcacgttgggtttggggagcctgggcctcaggaagcagcagtcgggggtnccgcagccatcggcctggaccgctctcctgctgacgtcctcctgctctacttacngtcttcgtgtcgcctctagtgtagttcgactcgacgcctacctcgtctaggttcgtcgacggtccgggccccggaanacggaccgtaccacgtaacttcccggaggtacggaaaacggaaaccttaacgtaggaacgtacaacgtacgtcgtaccgtaacgttcgaaccgagacgaggacgtcgacgggacctaccgggtccttgggtggtacggtactacggttactaaggtaacggtaaactaaccgtaccccggtcctacggtacggtaccttaccgagtactacgtcgtaccnggtaccgaccgtaaacggaacgggcggaacccgaccgtaccccgngtaaccggacaccgacggtaacggacggggaaccgggttacccgggaacggggttcgggaactaccggggtagtacccgttttaacgttcgttacgggtcggtttcggaacggggttacgggttacggtaaaccgttaaggttacgtttaagggaccggttaagtagggggttttacccgggttacgggttacccggggaccggggaaaacccgtacggttaaccggttacccggttaccccgggtaaccgggtaccgtttaccgggaacccggtaccggtaaaaccccgggttccccgggtcccccgttaaaccccggtccccggtttaaaccgtccccggtttaaccccgtccccggtttaacccccgtccccttaacccccggtttnttacccggggtaacccg

SEQ ID NO: 28885 - DNA, 787 bp, Homo sapiens
  misc_feature: GYAE6OF01EAUQG.13.55.E11.1.454.CMB.1.raw
  modified_base (139)..(139): a, c, t, g, unknown or other
  misc_feature (139)..(139): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtcgccagatgtnccatccagatcgacccagtcctccatccctcctgtctgcatcgtagtaggagacgagacgtccacatccgtacgttcggccggtactaacggtcgaagggtctaagttaacgtaaagttgtagtttaggcgtaggtaactcgacgtacaaacggtaaaaccggaacgggtaaaccgtcccccgttaaagtcctttaccgtttaggtaactttaccgttaggttcgggtacgtaccgttaacgtttaacccggtttaaaaggttttaaaaacgggtccgggttaaccctaaggttaccgtaaagggttccgacggaccggacgtaggtacggtacttaccggtagggaacttaaagtacttacctactactacaacgtactacgacgtacacgtcacgacgtacgtacgttagtaacgtttactttacgaactttaacgtttaccttacgtacgttaacccaagttaacgttaccgtttaacgtaccccgtaccttacccgttagggttaccgggttaccgggaacggggtaacggtacgtaacggggtacgtaagaaccggttaaaccgtaaacggtacgttgggaccgttccgacgtacccgttaacgttcctaacgttcggtttaacccttcgtccgttacccccg

SEQ ID NO: 28886 - DNA, 759 bp, Homo sapiens
  misc_feature: GYAE6OF01BOPJF.13.55.E11.1.454.CMB.1.raw
  modified_base (221)..(221): a, c, t, g, unknown or other
  misc_feature (221)..(221): n is a, c, g, or t
tcagtcacgtactacacgaccggtgctcgatttagcactcgcacgttgggtttgggggagcctgggcctcaggaagcagcagtcgggggtgccgcagccatggcctggaccgctctcctgctgacgcctccttgctcactttacagtcttctgtcggcctcctatgagttgactcacgccactctcagtgtcagtcggccccggaacgacgcactattccngtagaggaaacactaagatacagatcgccacgtcgtaccagacagaagtcgacgaccacggccctaggtggtcggtctatacgtaagtacggtaataacggaacccgtccctacgtacggactacccgtacgacctacttccgtcgtacgcctaccgtaacggtacggggaaccaccggacccctaaccgtacgtaaccaacgtacaaccgaaacggaccggtaacccgaaaggggaccgggtaactacgggaacgggtacgtaacggtaactttaagttacgttaggtacggtaggggttacggtaacgggacaacggtaccgaaccggaacgggtgtaacggttacggttaccggggaccgggtaccgggtaaccgacggtcgtaccggaacccgttaccgtaacgggtacccgaaccgtaaccccggaacggaccccgttaccccgtcccccgggttaaccgccccgttacccgttcccgtttaccccgggttaccccctacccccgtttccgtaccgttaaccggttacccggg

SEQ ID NO: 28887 - DNA, 1140 bp, Homo sapiens
  misc_feature: GYAE6OF01A1TB3.13.55.E11.1.454.CMB.1.raw
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagtcttctgtcggcctcctatgagttgactcagccactctcagtgtcaggtcgggccccgggacacggaccggccaactaactttcccgtggtaggaacgggaaaacctaaccgtttaaggaaacgtcaaggaaacttcggtacccaacgttcggtaacccgaaggaccgaaggaaaacggttccgaacgggccccgtaacgggccccccttgggttcggggttacgggttcctaacgttcctttaaaggttaaacggggggaaatttaaaaccggttaaaccccgggtcccccgttacggtttacggggggaaccctttcccccggttacggtaaccccgggttaacttttccgttccgttaccggggtacccgttaaccccggaaaacccgggtttacccgggggggaaaccccgaaccccggggtaccccccgtaaacccccgtttaccgggtaaacccccaaaccgtttaaccccgaaaaacccgaaacggggtaaaccccgggaaacccccccgggttaaaaagggggaaaccccggggggggtaaagttaacgggggtaaaccgggggtacccgtttaacggggttaaacccgtttaaacgtttttaaggttttacgggtttaacccggggttacgggggttaacggggtttaccgggggaaaccgtaaccgggtaccccggtaaaccccgggtaaccgggggtttaaacgtaaccgggttttaacgggtttaccccgggggacccgggggtaccccgggggaaacccggtaaacggtaccccgggttacgggtaccccgggttaccccggttaaaccggggtacccgtaaacccgggtacccccggaaacgggttcccccgttaccccgggtaacccccccccgggtttcgggttacccccttaaacccggttcccccggttttccccggttacccccccggtttacccccgtttcccgtttaccccgggttaaccggtttaaaccccgggg

SEQ ID NO: 28888 - DNA, 787 bp, Homo sapiens
  misc_feature: GYAE6OF01BGOJA.13.55.E11.1.454.CMB.1.raw
  modified_base (312)..(312): a, c, t, g, unknown or other
  misc_feature (312)..(312): n is a, c, g, or t
  modified_base (378)..(378): a, c, t, g, unknown or other
  misc_feature (378)..(378): n is a, c, g, or t
tcagtcacgtactacacgaccggtgctcgatttagcactcgcacgttggggtttgggggagctctgggagaggagccccagccgtgagattcccaggagtttccacttggtgatcagcactgaacacagaccaccaaccatggagtttgggctttacgttcgggttttccttgtttgcttaatttttaaaagggtgtccaatggtgagcttgcgagctaggtggagttcgtaggggggagtttggtacaggtccgaggggccggtacccgtgaacgacctctcctggtgcacgcctcgtgggttccaccgtnacgtcaccaccgtacactgacgtcgtcgggtcccgcacggctcccggaggggaacggggctagggngtacgtcgtttcttattttaagtttataggtagttagtagtacacgttaacctcgacgagtaccgttccggtgggaacggggccctaattaccacccgtatccctacaggacgtaactaaccttaacgaaacgtaaccacgtctttacgttttcttaaacgtaaacttacgggtaaaccgcccgtaggtaagtaaccgggttacgggaaccggggtaaccctaaccggggtaccctttcgttaaacgttttaccgttagggtacggaaaacgtaacgggaaacgtgggtaaccgaacgggtaacggggtaacccgggtaccccccgggtttaaagggtccggggggtacccgttacggggttacggttacgggggtttttcctttacggtttaccggttcgggttacgg

SEQ ID NO: 28889 - DNA, 811 bp, Homo sapiens
  misc_feature: GYAE6OF01D50QU.13.55.E11.1.454.CMB.1.raw
tcagtcacgtactacacgaccggtgctcgatttagcactcgcacgttggggtttgggggggggtctcaggaggcagcgctctcgggacgtctccaccatggcctgggctctgctattcctcaccctcctcactcagggcatagggtcctgggcccagtctgccctgactcagcctgcctcgtgtctgggtctccgtggacagtcgatcaccatcctcctgccacgtcgggaccagcaggtgtaccgttcgtggtacaagtactatcgtcctccgtacggtaaccaacaaccacccgaggaccaaccggaccccctaaactactaattaaactttatagttaactttacaacttaacgtccggtccctagtacggttagtacttactaactccgtcttaccgacgtcggtacctacgtacgttcgtacggaccaaccgacccggtcccttaccctacgaaccctacgttccgtccggtcgggtaccctaccgggacggacgaacggggtaacggaacggtacggtcgttacgttaactttacgttacgtcgggtaccgtccgttaccggtagggtaccgttacgtttaccgtaacccctttaccggttttacgttcggtttacccgggttacggtacttacggggtaaccgtaacccggttaaccggtaccccgttacccggtttaccggttaccgggtaacccgtaaccccgggaacccccggtaaacccggtaccccccgtaaaaccccctttcggttaaccccttaccctttaccccggtttccccgttcccccgggttttaccccccc

SEQ ID NO: 28890 - DNA, 837 bp, Homo sapiens
  misc_feature: GYAE6OF01BXSSB.13.55.E11.1.454.CMB.1.raw
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacgttcggccgggataagtccgagggactaagttaaggaaattgtaagtttacggcgttaggtatacgaacgaccgaaacggaaaacccgaaggggtaaaaccctacccccgtaaaggtccttacgtttacgacttaccgttaagttcgggtacgtactaaactttaaccggttaaaaggttttaaaaaaccgggtccggggttacccctaaacgttacggttaaacgggttacgacgggtaccggtaccgtaggtaggtacgttcgtacgggacctaacgtaacgtacctttacgtaacgtttccaccgtacctacgttacgacgacctacggtccgtacgaccgtacgtacccgttaaggtaaacgttttacgttttaccgaacgtttaaactttacgtttacgttaccgttaacccgtttaaacgtaactaaccgtaacctaaccgttaacgtttaccgttccggggttaacgggttaaccgggttaccccggtaaacgggaaaccgggtaaacgtaaacggggtaacgttaaaacgtaaacccggaaacggttaaccggttcgggtaccggtaccgtacggtaccccgtaaactttacggttacctttcgtttaccgttcccgttaaaccccg

SEQ ID NO: 28891 - DNA, 885 bp, Homo sapiens
  misc_feature: GYAE6OF01DODB1.13.55.E11.1.454.CMB.1.raw
  modified_base (88)..(88): a, c, t, g, unknown or other
  misc_feature (88)..(88): n is a, c, g, or t
  modified_base (203)..(203): a, c, t, g, unknown or other
  misc_feature (203)..(203): n is a, c, g, or t
tcagtcacgtactacacgaccggtgctcgatttagcactcgcacgttgggtttggggagcctgggcctcaggagcagcatcgggggtnccgcagccatggcctggaccgctctcctgctgagcctccttgctcactttcagtcttctgtcggcctcctatgagttgactcagccactctacagtgtcaggtcggccccggganaggaccggccaacaacttccctggtagaacgggaaaccaaccgtttagaacgtcagtaatcgtaccagtcggtaccagcagaacgtcacggccaggcccccgtgtacggtcggtactagtacgtaagtacgggaacttaaacgtaacccggtacccgtcgttacggggacttaccccggttacgacccggtaactttccgttaccgtccgggttacccttaaccccgtaaacccggtttacccggggggaaacctacccggggtaccccctaaccccggttaccggaaccccaacgtttaccccaaaaccgaacgggtaccgaaccccggtaacgggtaaccgggggaacgtacgggtaacgggtaccgttacggtaaaccgttttaactttaacggtttacggttaacggtaccgggttagggtacggggtaacctaacgggcccgtaaacccggtacggggttacgtaacggtttaccggtttaccgggggacccgggtaccggggtaacccgaacggttacccgttaaccggtaccccggttaccgtaaccgggttacccgaccggtaccccgaaacgggtcccgttacccggccccccgtttcgggtacccctaccgttacccgtttaccccggttacccctaccccgtttacccgtcccgttaccggttaacccggg

SEQ ID NO: 28892 - DNA, 800 bp, Homo sapiens
  misc_feature: GYAE6OF01DMXJ0.13.55.E11.1.454.CMB.1.raw
tcagtcacgtactacacgaccggtgctcgatttagcactcgcacgttgggtttgggggtctcagagaggagccttagccctggactccaaggtcctttccacttggtgatcagcactgagcacagaggactcaccatggaagttgggctgagcgtgggtgctccttgtgctatttagaggtgcagtgtgagatgcgacgtgggtggagtcgtgggggagtcgttgggtccgagggtcccggggggtcacgtgagtacctcgtccgtcgtacacgcctacgagtactttctagttttacgaggttaaatttagttagggtattgggtaacggtttcggggtacccgtccgtacggttccgtacccgggaagggggtaacggggtcgtaggggacgggttggggtacggacccgaaaggtaaggtaaagggagggtaggttaggggaagtacgaaggtaacgtaagttaagtttagtagggtacggtagttcggttagggtacgggtccggggtaccgtacttaccgtaaccgttacgtttaccgaaggtaacgaaccgtaaccgaccgtaagtacgtacgtacgtaagttacttagtaccgtagaacgtaaagtcggaaacggtacgtaccggtaggaacgggttacggtacggtaacgttaacggtaacgttaccggtacttaaacggttaacgtttaagttttaggttaagggttacggtaaaccgggttaaggttaaacggtttacggttaaaccggtttaccggtttaaccgtaaacgggtacccggttaacccggg

SEQ ID NO: 28893 - DNA, 766 bp, Homo sapiens
  misc_feature: GYAE6OF01ECP6O.13.55.E11.1.454.CMB.1.raw
  modified_base (137)..(137): a, c, t, g, unknown or other
  misc_feature (137)..(137): n is a, c, g, or t
  modified_base (611)..(611): a, c, t, g, unknown or other
  misc_feature (611)..(611): n is a, c, g, or t
  modified_base (659)..(659): a, c, t, g, unknown or other
  misc_feature (659)..(659): n is a, c, g, or t
  modified_base (758)..(758): a, c, t, g, unknown or other
  misc_feature (758)..(758): n is a, c, g, or t
tcagtcacgtactacacgaccggtgctcgatttagcactcgcacgtttgggtttggggatgctttctgagagtcagtggatctcatcgtgacaaagaaaatgaacgctcctgttcgtttccttcctctgtcgtcggnggccgcctccgaaggcgtcgggtcctcgtcccagcgtcgcagcgtcggacggaggtcggtccggaccgaggtaggtggacgacgtccgtacggacgtcccgttcgtccttagtagtttacgttagttcggttcgtcggttacgggtcgtacccttaacggtaagttacgtaacctttaacgtttaccggtcggtcgggtcgtacggccgccggtaccgcccggtaaccggtaggggaccggtcgtagggaacggttgggtacggttacggtaactttcgttacgttacggtaaggtgggtaacggtacgtaaaccgtacgtacgtacccgttaccgaaccgtagaagtaccgtagactacgtaactcgtaactcggtaactacggacgtacggaaacgtagtactacgttacccgaagtagtcgtacggttctcgtcgtacggtaccgtacgacgacaccgttgtctttacgtntacggttgtaccgggagtaacggaacgtacgtaagtacgttcggttanacccgggttagtaccggtacgtggtacccgggtagaccggtccggtaccgtacgtccggacttccgacccttcgcccgttaaccccgagtaccccggtntaccccgg

SEQ ID NO: 28894 - DNA, 816 bp, Homo sapiens
  misc_feature: GYAE6OF01DI0YC.13.55.E11.1.454.CMB.1.raw
  modified_base (601)..(601): a, c, t, g, unknown or other
  misc_feature (601)..(601): n is a, c, g, or t
tcagtcacgtactacacgaccggtgctcgatttagcactcgcacgttgggtttgggggagctctgggagaggagccccagccgtgagattcccaggagtttccacttggtgatcagcactgaacacagaccaccaaccatgggagtttggctttacgtttggtttttccttggttgactttaagtttttaaaaggtcgtaccaattcggtgacgcttgcgaggtcgtgggtggtaggttcggtgggggggttaaggtttggaaccgaggcccggtacggggtccggttacccctaggacgtacctccgttacgtagtttaactaaccgttcgtaggtacttaaccgtacggtttggggtgtaactttacgcgtaccttaagtcggtaaaccggttcggggtccccgtaccggaggttaccgtaccggaagggggtacgggtcgtaggggtacgggttggggtttagtttccaaggtttacggacgtacttaagtttccgtagtacgtagtacggtacgggaaacctaaggacgtaacctccgggccgttacggtacgtttaaaagggaaacgcgtaactacgttccaactactaccgtaanaaacgggtatacgttacgacgttaaacccgagtaactcgtaccggtttccgtccgtttagcggactaaggtctaacgggttaactcccggaacgtaaggtaaccggaaccgacggtacccgaatccccagttaactttccgaaagtttcccgtaagggcctaaggtaaggtaaagttccttaagtccgtaactacccggtacggttcccgttacg

SEQ ID NO: 28895 - DNA, 979 bp, Homo sapiens
  misc_feature: GYAE6OF01ARC9S.13.55.E11.1.454.CMB.1.raw
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggctttacgttgggttttccttgttgtacttaagtttttaaaaggtgtaccaatgtgagctgcagcgtgggtggagtcgtgggggaggtttggtacagccgaggggtccgtccctgacgacctctcctgtatacttcgaggtattctaacgttgggtatattagtcgtctagtcgtaacgtcgggtaccgaccgaggtccgtaccggagggggaacgggtcgttagggtaacgggttcggggtttaacggtttaccgaaaggtttacggggaacgttaccttaaacgttttccgtacgtaacgttaggtaacggttaccggggaaaccctaaaacgtaacggtaaccgttaaaccccggggtccggtaccggttaaaccgttaaagggttaaaaaccggcgttaaacggttaaacctttacccgaacccgtacgttaaccccgttaaacggaaacgggtaaacgtacgttaaccgggtaaccggttaacccgaaagggaaaccgtaacccgttaccggtttaccccgtttaccccgttttagtaacccgggtaccgtaaagggttaacgttaacgggtaaccggtttaaaccggtaaccccgggttaacgggtaaaaacccggacccccggggttaaacggggaaaccccctaaaccgggtaccccgttaaaccccgtttaaaccgttacccggttttaaaaccgtttacccggtttaggggtaacccgttaaccgggttaaagggtaaacccggtttaaacggtttaacggtttacccggtaaccccgggtttaaacccggtttaaccccgttaacccggggttaacccgg

SEQ ID NO: 28896 - DNA, 727 bp, Homo sapiens
  misc_feature: GYAE6OF01AXX9L.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctccgtggggctgctaatgctcgtgggtcccaggactccaggtggggatgttgtgatgactcagtcctccactcctccctcgcccgtcacccgttggaccacgccggcctccactcctcctgcgaggtctacgtacaaacgtcctacgtactacgagtgataggaaacgtaccttacgttacgtaagtttggttacgacgacgaggacggtccgaggccgtacgtccgtaccgaacggcctaccttaattttaagtaacgttttacggtttacccggacttcggtcgggtacccagacgtacgtacttacgacggtacggtcgtaggttcgggtacgacggtctaacgttcggttaactttaccgaactaagttaacggtaaacgttccgggaaaggtacgggggtacgggtaacgggtacggtaaggggaacgggttacggttacgggtacccggggtttaggggtttacctttaacggtttacgccggttaactacggtaccggtaacgtaacgtaacctaaccgtacggtaccgtcgtacccgtctaccgtccgtaaccgtcggacgacggacgacgagtaggacagtacggaaacgtgtacgagtactgaccgtacg

SEQ ID NO: 28897 - DNA, 830 bp, Homo sapiens
  misc_feature: GYAE6OF01B48SB.13.55.E11.1.454.CMB.1.raw
  modified_base (783)..(783): a, c, t, g, unknown or other
  misc_feature (783)..(783): n is a, c, g, or t
tcagtcacgtactacacgaccggtgctcgatttagcactcgcacgttgggtttggggactcaggacacagcatggacatgagggtccccgctcagctcctggggctcctgctgctctggcctcccaggtgccagatgtcgccatccagatcgacccagtcctcctactccctccgtgtctgctatcgtaggtaggagacgagtacgtccaacctataccgtaccgttcggacccgggactaacggtacgacgggtactaaagttaaaggtaaacgttggttaacgtttacggacgttaggttaacttacgaacgaaccgtaaacggaaaaccggaaccggggaaaccctaccccgtaacgtccttacgttacgtactttacgtaggttcggtactaccgtaacgttaacggttaaaagggttttaaaaccgggtccgggttaaccctaacggttaacggtaacgggttaccggacggtaccgggtacgtaagggtacgtacgtccggtagacccgtaactacgtactttacctacttacccgtacgtaacctacgtacgacgtaccgacgtacccgtagaccgtacggttaccgtaagttacgtttacgtttactaaccgtttaactttaccgttacctacgtaactaacgtaacgtacttaaccgtaacgtttaccgttaccgtaccggggtacgggtttaccggtaacgggaacggtaaaccgggtaacggtaaagggttaaccgtaaaacgtaaccggtaaacgttacgggcggttaccncgttaccaccgttaccgttattcccggtaccttcgtcccttaacccg

SEQ ID NO: 28898 - DNA, 777 bp, Homo sapiens
  misc_feature: GYAE6OF01DFLCO.13.55.E11.1.454.CMB.1.raw
  modified_base (542)..(542): a, c, t, g, unknown or other
  misc_feature (542)..(542): n is a, c, g, or t
tcagtcacgtactacacgaccggtgctcgatttagcactcgcacgtttgggtttggggatgctttctgagagtcatggatctcatgtgcaagaaaatgaagcacctgtgttcttcctctgctggtggcgctcccagagtcggggcctgtcccagctcgcagctgcgaggacggtccggccaggtagtggacgagtccgttcggacgccctcgtcccgtagtaggttagttaagtcgtgttcgtcggtcggtccttacccgttaaggtagacctttaccgttacgtacggttcgggctacggtacgttacccggaccgaccggacccggaagggggacggtcgtgggtacggtggtaggtggtatcttcgttagttaggtacgggtggaagttaaccgtaactaaccgtactccccggtacctagtaacgtacgtcgtaacgtactagtacctaataccgttacgaacgtcgtacggtacgaaaggtaacctacttcgaaccgttaggtaacttcggttacttacgtacggtacgtaccggtnaccggtagacccggtacgtctttaggttaccttttaggttagttcggtacggtacgaacgttaacggtaacttaaggtcgggtttaccgggtaagggttaccgttcgggttacccgtaaacgggtccggttaacgggggccgttaaaaccgggtcccgttcgggttaaccctacccgttcgttacccctcggtaaccccggtcccttaaaccccggcccgtaccgggttaccccg

SEQ ID NO: 28899 - DNA, 788 bp, Homo sapiens
  misc_feature: GYAE6OF01APZLA.13.55.E11.1.454.CMB.1.raw
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
tcagtcacgtactacacgaccggtgctcgatttagcactcgcacgttgggtttgggagcctgggcctcaggaagcagcagtcgggggtgccgcagccatggcctggaccgctctcctgctgacgccttccttgctctacctttacagtctttcgtgtcggccttcctagtgtagttgacctcagccactctcagtgtcacgtcggccccgganacgacgccacacttccngtacgaacggtaaactaaccgtagacgtacagtaactcgtaccacgtacgtaaccagaccgtaagaacgtaccgaacgggccaaccgggtccccgttagggtcggtacggtaccacgtttacgtaagtaacgggtaacttaaaccgtaccccgggtcccgttacggtacgggtaactccccgtacgggtacccttacgtttccgacgtccggtaccctaaccggaaaccggggttaccgggaaactccgggtacccgaccccgttaacccgttacgaaccctaacgtaaacccggaaacgaccgtaaccgggaacccgaacgggaaccgggtacgacgtacgggacgtaacgttacgttaactttaacggtcgtacggtagggttacgggtacggtacgacggtaccgaccgggtaccgtagtacggtttaccggtacgggacgggtaccgggaccgtaacgtccgtacgtacccgtacgtcggaccgacgtaccgtacgccgtacccgtccgtaccgtccaccgttccgttcccgttcccgccgttcgtccgttacg

SEQ ID NO: 28900 - DNA, 854 bp, Homo sapiens
  misc_feature: GYAE6OF01EH3CH.13.55.E11.1.454.CMB.1.raw
  modified_base (226)..(226): a, c, t, g, unknown or other
  misc_feature (226)..(226): n is a, c, g, or t
tcagtcacgtactacacgaccggtgctcgatttagcactcgcacgttgggtttggggagcctgggcctcaggaagcagcagtcgggggtgccgcagccatggcctggaccgctctcctgctgacgcctccttgctcactttacagtcttcgtgtcgccttcctatgtagttcgactcgacgccctacttctcgtagttcgtaccgacggtccgggacccccggganaacgggacccggacccaacgttaaccgtttcccgtaggtaacgggaaaccgggtaaaacctaacccgtttaaggaacgttacgaaaggtaacgttccgtacccgaacgttacggtaacccagtacgtaacggaacgtaccgacggacccgtaccggtccccgttggtcgggtacggtactacgtacgttaaggtaacgggtaactaaaccggtacccggtccttacggtacgggtacccttacccgtacggtaccgttacttccgtcgtaccggtaccctaccgtaacgggtacccgggaacctcccggaccctaacccggtcgaaccctacaaccgtaaaccgacggaacccgacccgggaaaggggtacggacgtacggacgtcgtaagttaactttacgttacgttacggtacggtaggggtcgggtaacgaccgtaccggaccgttaaccgacgggttagtacgttacgggttaccggggaccggacgggtaaccacggtaccgtacggtacccgttcggaacgtccgacccgaccggtaccgtcccggtaccccgttaccccgtcggtacccttaccgtccggttacccctaccccgttacccgtccttaggtacccgtacgg

SEQ ID NO: 28901 - DNA, 699 bp, Homo sapiens
  misc_feature: GYAE6OF01EIN68.13.55.E11.1.454.CMB.1.raw
  modified_base (277)..(277): a, c, t, g, unknown or other
  misc_feature (277)..(277): n is a, c, g, or t
tcagtcacgtactacacgaccggtgctcgatttagcactcgcacgttgggtttggggggtctcagagaggagccttagccctggactccaaggcctttccacttggtgatcagcactgagcacagaggactcaccatggaattggggctgagctgggtgctccttgtgctatttagaaggtgcagtgtgagatgcgagtgggtggagtcggtgggggagtcgttcgggtccagggccgggggggtcacgtgagactctcctgtacacgcctcgagtnttctatttcgaggtatttagtggtatggtaggttcgggtccgaccggagttccggtccggaagggggtaacggggcggttagggacgggttggggtacgggacccaaaacggtaaggtaaaaaggggtaggaggttagggggaagtaccgaaagtactaagtttaacttaagtgggttacgggagttcggtgggtcggggaccggggtaccgtagttacccacccgttaagttccggaaaggtaaccgaacgaaccgtaaccgaggtacttcgactaaggttactactcgtacgtacaaagtcggaagtcggctaggagtggtacgagtagtaccggtaccggtataacgtaagtttagttagttaggtcgtaaggaagttacttacggaagtttacccggttcgtaaggcccggttaaccg

SEQ ID NO: 28902 - DNA, 655 bp, Homo sapiens
  misc_feature: GYAE6OF01BOM1G.13.55.E11.1.454.CMB.1.raw
  modified_base (268)..(268): a, c, t, g, unknown or other
  misc_feature (268)..(268): n is a, c, g, or t
  modified_base (338)..(338): a, c, t, g, unknown or other
  misc_feature (338)..(338): n is a, c, g, or t
  modified_base (461)..(461): a, c, t, g, unknown or other
  misc_feature (461)..(461): n is a, c, g, or t
  modified_base (555)..(555): a, c, t, g, unknown or other
  misc_feature (555)..(555): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagacccaccaaccatggagtttgggctttacgttgggtttttccttagttgtcttaagtttttaaaaggtcgttaccaattggtagaagtctgcagctgggtggagtcggtggggtaggtttgtacagccgtagggccgtccngacactctcgtgtattactgtgtattcgaacgttgggtatattaagcgtactagtcgaacgtcgggaccnccgaggtccgtaccggaagggggtacgggtactcggggtaggttacgggttaggtttaccaaggtttaggactacgttaacgttctacggtagtagagtacggaactaagacgtacgtaccgngtacgtagtaggtaaagctagtacacacgactctaagactagtatacgagtaccgaagactcgtacttccgtccttacgactacgatagttacncgttacgacgttacggaagtacccggaagtaccacgacgtacctagtacttagtcgtagacgtacgagtacgtagtactcgagtacctccggtactacgg

SEQ ID NO: 28903 - DNA, 823 bp, Homo sapiens
  misc_feature: GYAE6OF01DA4LM.13.55.E11.1.454.CMB.1.raw
  modified_base (245)..(245): a, c, t, g, unknown or other
  misc_feature (245)..(245): n is a, c, g, or t
  modified_base (473)..(473): a, c, t, g, unknown or other
  misc_feature (473)..(473): n is a, c, g, or t
  modified_base (601)..(601): a, c, t, g, unknown or other
  misc_feature (601)..(601): n is a, c, g, or t
  modified_base (799)..(799): a, c, t, g, unknown or other
  misc_feature (799)..(799): n is a, c, g, or t
tcagtcacgtactacacgaccggtgctcgatttagcactcgcacgttgggtttggggtgatcaggactcctcagttcaccttctcacaagtgaggctccctgctcagctccgtgggctgctaatgctcgtcgggtcccaggtatttaaggaggggtatgcttagtaatcgactctagtctaccctaccttcctcccgtcgcccccgttacctacccgttaggaccacggtccccggtccctaccncttccgtccctggtacccgttagtttaccgtaacgttaccgaaacggtcccttaccgtaaactcttaccagtgggtagcgggtaccctaaccctaccctttaagtttaggttacgttttccgggtcggacgacggacggacccgtacgacctaactccgtacggaacggtacctaactttaaagttagtaggttctcgtacggacgtaccgggtccggtcccgggtanaagtacggtagtacgtacgacggtcggacgtggtacggtacaggttacttaacgtttctaccgaacgtacgtaaaacgtaaggtcccgggtaagggtaggggtaggacggttcgtaagggttaacggnggtaccggttagggtttaccggtttcctaaagtttccgagtaactgtacggaaactaaccgtccgttaaccgaacgttcccgggtaccttacccccgtacccggttactacccccgggtttacccggaaccggggtaccgaaacccggtacggtaccgggacgttaacgggaacttaaaccgggaagttaaccccggngtacgggtcctccgaacgtacccg

SEQ ID NO: 28904 - DNA, 919 bp, Homo sapiens
  misc_feature: GYAE6OF01AMQOF.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccaggtgggattgttgtgatgactcagtctccactcctcccgtcgcccgttccacccgttggaccacggcccggcctaccatcctccgtggcgtaggtcctagtaccgaaacgtccttacgtaatacgagtgaagtacggaaactaccttacttaggtaagttttcggtttacgagcgaacggaccggaccgtacggtacccgtacgtccgtaccgaacgggtacccttacgtttaaacttttaacgtttaacgttttacccgggttttttaaccccgggacgtttccgggtaccggggttaccccaaggtaaccgtacgtacgtttaccggacggtccggtacggtacgggttcgggtacgacgggtacctacgttacgttacgtttaccgaacgttaacgtttaaacggtaaacgttacccgtaaacgggtcggggttaacgggtaacggttacgggttaagggttaacgggttagggttttacgggtttaacggggtttaactttttttaaccgtaaccggttaggtaccgttaagggtttacgaaaccggttaacgttaccggtttaaccgtttaccgtttacccggtttaccggttttaccccgttttaccggttttaccccgggtttaccccggaccgggtttaaccgggtaacccgttaaaacgggttacgttaaacccgttaacccgttaacggttaacccggttaacgtcggggtttaccgtcccgtaaccgtccccgtaaaccgtttcgttacccgtttcgttaccccg

SEQ ID NO: 28905 - DNA, 750 bp, Homo sapiens
  misc_feature: GYAE6OF01D1NG3.13.55.E11.1.454.CMB.1.raw
tcagtcacgtactacacgaccggtgctcgatttagcactcgcacgttgggtttggggatgctttctgagagtcatggatctcatgtgacaaagaaaatgaagcacctgttgttccttcctcctgcgtggtggcggctcccgagagtcgggcctcgtcccagctgcagctgcaggacggtccggccaggagtggtgacgtccgttcggacgtaccctcgtccctctaggttagtatgtcgtcgtggtcgtcctaccgtaaggtacgtactacttacgtagtcgggctggacgtccggcaccggacccggaagggacgggcgtaggaggttggacggttaggggacttacgttcgttacgttaaggtaggtagggtaacgtaacgtaaactactaacgttcccgtacctacgtaagtacgtacgtacgtactacgtactagttaacgtacgtaagacgtacggtaccgaaaggttaaacgtacttccgtaaccgtaaggtacgttagtacgtttacgtcggtaccgtacgtacgacgtacgtacgaccggttcttacgtttacttaacgtttcgttggtacgaacgggtaaccgtaacggtaacttaagtttcgggttaacggtttacgggtaacgggtttagttacccggtaacgttacggggacgggtacccgggtaacggttaacccggtcggtaaccgtcccgttctcccgtacgtacctaccccgacgaacccggtaccgtaccccg

SEQ ID NO: 28906 - DNA, 1021 bp, Homo sapiens
  misc_feature: GYAE6OF01BZDU5.13.55.E11.1.454.CMB.1.raw
  modified_base (800)..(800): a, c, t, g, unknown or other
  misc_feature (800)..(800): n is a, c, g, or t
tcagtcacgtactacacgaccggtgctcgatttagcactcgcacgttgggtttgggggagcctgggcctcaggaagcagcatcgggggtgccgcagccatggcctggaccgctctcctgctgacgcctccttgctctactttacgacgtctttcgtggcggtcccttccgtaagttggacgtttcggaccttacgacggtccctaacttcccgtagtaaggttcggtaccgacgggttacccggggacccccggggtaacacgggacccgggcccctaaagttaaccgtttccccgtaggggttacgggaaaaccgggtaaaacccttaaccggtttaacggaacgttacaaacgggtaactttacgggtaccccgtaacgtttacggggtaacccgtaagggaccgtaaacgggttaaccgggttacccgtaacccgggggtaacccggtacccggggtacccccggttttaggggttacgggggttaaccggtttaccgtaaaccggttccgttttaaaagggaacggggtttaaaccgtttaaaacccggtaacccgggtcccgttacgggtttaaccgggggtaaccctttccccgggttaacgtaccggttaactttccggttaccgtccggtaacccggttaacctaaacggggggtacccgggtaaaccgcccggtaaccccgtaccccgtaacggaacctaccgtaacgaaaccccggagggaacccgacggaacggggaacgggttagacgggtacgacgttaggtactttaagttacggtagtaccgggngggtacggtacgggacgtacgaccgtacgtacgtagtacggtcgggttaccggggacggggacccgtacggtaccgtacgttaccggtacccgtccggtaacgggtactacccggacccggtaaaccggtccgtaccccgtacccgggttcccgtaaacgttccccgttcccgtacccgttcccccggttacccgtccgttccggttaaccgttaccgggg

SEQ ID NO: 28907 - DNA, 702 bp, Homo sapiens
  misc_feature: GYAE6OF01EYYEC.13.55.E11.1.454.CMB.1.raw
  modified_base (157)..(157): a, c, t, g, unknown or other
  misc_feature (157)..(157): n is a, c, g, or t
  modified_base (669)..(669): a, c, t, g, unknown or other
  misc_feature (669)..(669): n is a, c, g, or t
tcagtcacgtactacacgaccggtgctcgatttagcactcgcacgttgggtttggggactcaggacacagcatggacatgagggtccccgctcagctcctgggctcctgctgctctggcctcccaggtcgccagatgtgccatccagatcgaacccngtcctccactccctccctgtctcacagtcgtagtaggacgaacgaggactaccaaccatacctacttccggacgtaggacgtacgtacgaaggtactaaactttaaactaattaaagttttaagttgtaactacctaacgactaaacgaaacgtaacggtaacgacccctaagtccgtacctagtactcgtaacgcgtcacctaataaccgttaacgtttacgggaaaccgttacgggtacctaacgtacgtaacgggtactaaggtagggtaacggtgaacgttcggtagtacttaagtttccgttttactaccgactagtactacgacgtcgacgttcgacgactacgtaagtactaagtagtacaacttaacctaagttacgtcgtaacgtgaacgtatacgtaacgtataccttaagtcccctacgtaccgttaccgtaccgttaacggaccgttaaacggaccgaacgttaccggaaagtaacggtaaactaaccgggtagtaccgnggtacactacctactactcttcgtcttaacccg

SEQ ID NO: 28908 - DNA, 910 bp, Homo sapiens
  misc_feature: GYAE6OF01D1FUH.13.55.E11.1.454.CMB.1.raw
tcagtcacgtactacacgaccggtgctcgattttagcactcgcacgttggggtttgggggagcctgggcctcaggaagcagcagtcggggggtgcccgcagccatggcctggaccgctctcctgctgacgcctccttgctctactttacagtcttctgtcggccttctatgtagttgactcacgcctactctcgagtgtccgacgggtccgggccccgggaacacggacccggacccaacgttaaccgtttcccgtagggtaacggaaaccgggtaaaacctaaccgttaaggaacgtctaaggaacttcgtaccctacggttacggtaccacggacgaaggaacggtaccgaccgggacccgaccgggttcccccgttaggttccggggttacggtaccctaagtttacccggttaagtaacggtaaacggtaccgtaccggaacccgtaacgggtacccccgtaccccggtacgggaaccggggttaccctcccgggtaagtaccggtaccggtttactttcccggtccggtacggtacccttaccccgtaaaccggtttccgggtaaccggtaacccgtaccgtacccgtacccttaacccgttaccgtacccgaaccgtaccgtaccggtacccgggaccccgggtacgtaacggtacgtaggtacggtagtacggtacgtaccgttacgtaacctttaggttacgtcggtacgggacgggtcggtacggagacggtccgacgtaccgccggtaccggtacccgtacgttccggttacggtttacccgggtaacgggtaacccgggtacccggtaaccggttaacccggttcccggaaccccgttaaccgtaacccggacccgaacccggtaacccccggacccggtaacccctaaccccggtacg

SEQ ID NO: 28909 - DNA, 347 bp, Homo sapiens
  misc_feature: GYAE6OF01C8TGO.13.55.E11.1.454.CMB.1.raw
  modified_base (177)..(177): a, c, t, g, unknown or other
  misc_feature (177)..(177): n is a, c, g, or t
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
  modified_base (306)..(307): a, c, t, g, unknown or other
  misc_feature (306)..(307): n is a, c, g, or t
  modified_base (309)..(347): a, c, t, g, unknown or other
  misc_feature (309)..(347): n is a, c, g, or t
tcagtcacgtactacacgaccggtgctcgatttagcactcgcacgttgggtctgggacagacttcactctcaccatcagcagcctcgagccctgaagtattttgcagtctttattactgtcagcagcgtagcaactggccctccggccctttcgggcggagggaccaagggtggaanataccaaaacgatggtggctcgaccaccagtccttgtcctttacacttccttccccgactacttcgtagtattacgtaacgtgaccgtggaggccgggntacggacgaacgggcctggaataggntganntnnnnnnnnnnnnnnnnnnnnnnnnnnnnnnnnnnnnnnn

SEQ ID NO: 28910 - DNA, 750 bp, Homo sapiens
  misc_feature: GYAE6OF01CZQ01.13.55.E11.1.454.CMB.1.raw
  modified_base (89)..(89): a, c, t, g, unknown or other
  misc_feature (89)..(89): n is a, c, g, or t
  modified_base (214)..(214): a, c, t, g, unknown or other
  misc_feature (214)..(214): n is a, c, g, or t
  modified_base (365)..(365): a, c, t, g, unknown or other
  misc_feature (365)..(365): n is a, c, g, or t
tcagtcacgtactacacgaccggtgctcgatttagcactcgcacgttgggtttggggagcctgggcctcaggaagcagcatcgggggtnccgcagccatggcctggaccgctctcctgctgagccctccttgctcactttacagtcttcgtgtcggccttccgtatggtattgactcacgcctactctcagttcgtcaggtcgggaccccgganaggaccgcactaacttccgtagtgaacgggaaacctaacttaggaactcaagtaactcgtaccagtcggtacagacagtaacgcacggccacggtaccccgtgtcgggtgtcatactagtaggaactaacgtaccggccttcgacggtacnccgtacgtcgaacttcgtctgtactaccgaacgtccgggaacgtacgacccaccgtcgacctaacgccaaacgtacgacgacccgtaagggacgggacgtaggaccgtacgtacggtacgtttacgtaagtttcggtagtgggtttaccggtgggaacctacggtcccgaaggtaccgttaaggacgtttacgggaaccgggccggtaacccgggtaaccgaaggttcccgaccgtaccgggttaccggtaacgtacccggaaccggttaacccggaccgggttactaccccggggttacccccgtcgggtaccccgtttacccgttcccttacccccggtttacccctaccccggttccccgtaaaccgttcgtttaaccccgg

SEQ ID NO: 28911 - DNA, 783 bp, Homo sapiens
  misc_feature: GYAE6OF01CWTBD.13.55.E11.1.454.CMB.1.raw
  modified_base (510)..(510): a, c, t, g, unknown or other
  misc_feature (510)..(510): n is a, c, g, or t
  modified_base (516)..(516): a, c, t, g, unknown or other
  misc_feature (516)..(516): n is a, c, g, or t
tcagtcacgtactacacgaccggtgctcgatttagcactcgcacgttgggtttggggactcaggacacagcatggacatggacgggtccccgctcagcctccgtggggcctcctgctcgctcgtggcctcccgaggtcgaccaggtatgtcgccctatcccaagacgtccgaaccccgtagtccctacctacttcccctcccgtgtcctgctacttcggttaggacggaacgacgaggtaccgtaccaaccgtactaccgtacgttccgggaccgggactaaggtacggaaggtatagttaacgaagttgtagttagcgtagtaactcgagaacgaacggtaaaccgaacggaacctccgtaatcgttactagtacttacgtagtcggactacaacgtttacggttaaaggttaacggcggtaacctaggtacggtacggttacgacggtcgtacggtacgtagtctacggcgaactaccgttacgttaactttcgaacttcccgtaacncgtacnccggacttccgaccggtcacggaccgtaacgttacgttaaggttacctttagttaccgttaacctttaaacgttttcgacccgttaagttaaaccgaattaaaccgttactaaacccgttaagtttaacggtttccccgggtacgggttaacccgggtaacggttacccgggaagggttaacccgaggttaaagaccgtaaaccgtacggaagttacggtcgaaggacccttgaaccttacgtcttaggtaccttcctcgttacccg

SEQ ID NO: 28912 - DNA, 774 bp, Homo sapiens
  misc_feature: GYAE6OF01BCSYU.13.55.E11.1.454.CMB.1.raw
tcagtcacgtactacacgaccggtgctcgatttagcactcgcacgttgggtttggggagcctgggcctcaggaagcagcatcggggggtgccgcagccatggcctggaccgctctcctgctgagcctccttgctcactttacagtcttctgtcggcctcctatgagttgactcagccactctcagtgtcaggtcgggccccggacacggaccggccaactaacttcccgtggtacggaacgggaaaacctaaccgttagaagtccaagtaatcgtaccacgtacgtaccgagacgagaacgtcgacgggccgaccggccccgttggtcggggttacggtacctaagtaccggttaagttaacgggggaacttaaaaccgtaaccccgggcccgtttacggtacggggtacctcccggtacggtacccgtaatttccgtccgtcggtaccctaccgaaaccggtaccggggaaaccgacccgggacccctaacccgtacgacccaactaccaacgaggaccgaccggaaggggacgggactcgggacggctagtaacttagttacgtggtcgtagggttggacggacacgtcaacggttacggtagtaacggtcggtacggggcccgggaacgggtaaccacggtaccgtaccggaccgtccggtaacggtacctaccggacccggtacggtcccgtacccccggtccccgttcggccctacccgttcccgttacccgtttcccccaccccgtttccgtaccgttccggtaccgg

SEQ ID NO: 28913 - DNA, 755 bp, Homo sapiens
  misc_feature: GYAE6OF01BIK7M.13.55.E11.1.454.CMB.1.raw
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatcgacccagtctccactcctcctgtctagcatctggtaggagaccagacgtcaccagtcctacgtcggccggataagtcgaggctaagttaagaatgtagtttagcgtagtatcgagacgaagaaccggaggaacgtcccctaagtctagttgacttacgtagtggactacgtaacgttaacgtaaacggttttaaacggtcccgggtacctaagttacgaaacggtttcgacggtcggtacaggtcggtacgtcgaggaacacgtaacgttcctttacgacctttccgacctaacctacgtacctacgccgtaaccgtcgtaccggtaccgtaacggtaccttaggttaacgtttacgtttaacgttaacccgtttaaacgttttacgtttaccccttaggttaaccttaagtaaaccgtaacgttacctaacgtttaaccggtaccgttacgggtaccggttaaccgttaaccgggtaccgtaaaccgggaacggtaacgggttaacgtaaaaccttaaaccgggaaacggtttacgtacggggtaccttacggttaccgaacccgttacgttacttaccggtttacttcccgttaacgttccccg

SEQ ID NO: 28914 - DNA, 793 bp, Homo sapiens
  misc_feature: GYAE6OF01E3FX1.13.55.E11.1.454.CMB.1.raw
  modified_base (184)..(184): a, c, t, g, unknown or other
  misc_feature (184)..(184): n is a, c, g, or t
  modified_base (439)..(439): a, c, t, g, unknown or other
  misc_feature (439)..(439): n is a, c, g, or t
  modified_base (494)..(494): a, c, t, g, unknown or other
  misc_feature (494)..(494): n is a, c, g, or t
  modified_base (577)..(577): a, c, t, g, unknown or other
  misc_feature (577)..(577): n is a, c, g, or t
  modified_base (747)..(747): a, c, t, g, unknown or other
  misc_feature (747)..(747): n is a, c, g, or t
  modified_base (758)..(758): a, c, t, g, unknown or other
  misc_feature (758)..(758): n is a, c, g, or t
tcagtcacgtactacacgaccggtgctcgatttagcactcgcacgttgggtttgggggactcaggacacagcatggacatggacgggtccccgctcagctcctggggctcctgctgctcgtcggctccgaggtgccagtatgtcgccatccagatcgaccagtccacactcctccgtgtctcgntatcgtaggtacggaacgacgagtacgtaccactactcgacgttcggaccggataacgtcggacggtactaagttaaacgaattcggttaagtttagggcttacggttaagtacgaacggtaccgaaaccggaaaaccgggaacgggtaaccccgtacccgttaaagtccttacgttacggtacgttacgttaggtacggtactacgtaacggttaaccgttaaaacgggttttaaacgggtccggtaaacccgngttaaccgggtaaccgtacggtaggtccgtaacgtggtaacgggtcttaccgganacccgtaagtacgttactaccttaccgtcacctaacagacctagacttccgcgtacacggtacgttaggactttaaacgtttnttaacaaccggtttattacgttacgtatacgtaaacagttaacccttctaaagttaccgtttccggtcggggttaaccgttccggaaccgggtacgaaaggttaacggaaagggtttaacccgaaaactttacggggaaacggttcctaagggtacccgcgtttaaaccncccggtttaanacttcgtttttaacccgcttaacccggttaccccg

SEQ ID NO: 28915 - DNA, 257 bp, Homo sapiens
  misc_feature: GYAE6OF02F4XQ5.13.55.E11.1.454.CMB.1.raw
  modified_base (254)..(257): a, c, t, g, unknown or other
  misc_feature (254)..(257): n is a, c, g, or t
tcagtcacgtactacacgaccggtgctcgatttagcactcgcacgttgggtttgggacagacttcactctcaccatcagcagcctcgagcctgaagatttgcagcttattactgtcagcagcgtagcaactggcctccggccctttcggcggagggaccaaggtggagatcaaacgaactgtggctgcaccatctgtcttcatcttcccgccatctgatagtacgtgactgagcgggctggcaaggcgcatagnnnn

SEQ ID NO: 28916 - DNA, 253 bp, Homo sapiens
  misc_feature: GYAE6OF02GXIAT.13.55.E11.1.454.CMB.1.raw
  modified_base (252)..(253): a, c, t, g, unknown or other
  misc_feature (252)..(253): n is a, c, g, or t
tcagtcacgtactacacgaccggtgctcgatttagcactcgcacgttgggtctgggacagacttcactctcaccatcagcagcctcgagcctgaagatttgcagcttattactgtcagcagcgtagcaactggcctccggccctttcggcggagggaccaaggtggagatcaaacgaactgtggctgcaccatctgtcttcatcttcccgccatctgaagtacgtactgagcgggctggcaaggcgcatagnn

SEQ ID NO: 28917 - DNA, 256 bp, Homo sapiens; identical to SEQ ID NO: 28728
  misc_feature: GYAE6OF02I58WZ.13.55.E11.1.454.CMB.1.raw
  modified_base (254)..(256): a, c, t, g, unknown or other
  misc_feature (254)..(256): n is a, c, g, or t

SEQ ID NO: 28918 - DNA, 257 bp, Homo sapiens
  misc_feature: GYAE6OF02JG26U.13.55.E11.1.454.CMB.1.raw
  modified_base (252)..(257): a, c, t, g, unknown or other
  misc_feature (252)..(257): n is a, c, g, or t
tcagtcacgtactacacgaccggtgctcgatttagcactcgcacgttgggtctgggacagacttcactctcaccatcagcagcctcgagcctgaagatttgcagcttattactgtcagcagcgtagcaactggcctccggccctttcggcggagggaccaaggtggagatcaaacgaactgtggctgcaccatctgtcttcatcttccgcatctgatagtacgtgactgagcgggctggcaaggcgcatagnnnnnn

SEQ ID NO: 28919 - DNA, 531 bp, Homo sapiens
  misc_feature: GYAE6OF02J1WN6.13.55.E11.1.454.CMB.1.raw
  modified_base (200)..(200): a, c, t, g, unknown or other
  misc_feature (200)..(200): n is a, c, g, or t
  modified_base (516)..(516): a, c, t, g, unknown or other
  misc_feature (516)..(516): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccggganagacggccacaattccctgtgagggaaacaaccttagaagtcagaatgtccactggtaccagcagaagtcaggccaggcccctgtggtggtcatctatagggataataaccggccctctggggatcccctgaccgattctctggctccaactcggggaacacggccacctgaccatcaacagacgcccaaggacggggatggaggctgactattattgtcaggtgtgggacagcaccgaggtgatacgttcggcggtcgggaaccagctgaccgtctaggccagcccaggctcgcccctgccacgtctcggtcccnccctctcgtagtacg

SEQ ID NO: 28920 - DNA, 530 bp, Homo sapiens
  misc_feature: GYAE6OF02II0GP.13.55.E11.1.454.CMB.1.raw
  modified_base (200)..(200): a, c, t, g, unknown or other
  misc_feature (200)..(200): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccggganagacggccacaattcccctgtgagggaaacaaccttagaagtcagaatgtccactggtaccagcagaagtcaggccaggcccctgtggtggtcatctatagggataataaccggcctctgggatccctgaccgattctctggctccaactcggggaacacggccaccctgaccatcaacagacgcccaagacgggatgaggctgactattattgtcaggtgtgggacagcacgacggtgatagtcggcggcgggacaagctcgaccgtccgtagtcacgcccgaaggctcgcccctcggtcacgtctcgttcccaccctcctctagtacg

SEQ ID NO: 28921 - DNA, 256 bp, Homo sapiens; identical to SEQ ID NO: 28727
  misc_feature: GYAE6OF02HLV31.13.55.E11.1.454.CMB.1.raw
  modified_base (255)..(256): a, c, t, g, unknown or other
  misc_feature (255)..(256): n is a, c, g, or t

SEQ ID NO: 28922 - DNA, 488 bp, Homo sapiens
  misc_feature: GYAE6OF02GI5FQ.13.55.E11.1.454.CMB.1.raw
  modified_base (484)..(484): a, c, t, g, unknown or other
  misc_feature (484)..(484): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtgggtcccatcaaggttcagcggcagtggatctggcacagacttcattctcaccatcagcagcctgcagcctgaagattttgactaacttattactgtctacaagatcactaattatcctgggacttcggccaagggaccaaggtgaaatcaaacgaactgtagctgcacatctgtcttntacg

SEQ ID NO: 28923 - DNA, 264 bp, Homo sapiens
  misc_feature: GYAE6OF02H8GOA.13.55.E11.1.454.CMB.1.raw
  modified_base (249)..(249): a, c, t, g, unknown or other
  misc_feature (249)..(249): n is a, c, g, or t
  modified_base (256)..(264): a, c, t, g, unknown or other
  misc_feature (256)..(264): n is a, c, g, or t
tcagtcacgtactacacgaccggtgctcgatttagcactcgcacgttgggtctgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcactcttcccgcatctgatgtacgtgactgagcgggctggcaaggtcncataggnnnnnnnnn

SEQ ID NO: 28924 - DNA, 260 bp, Homo sapiens
  misc_feature: GYAE6OF02GDOKV.13.55.E11.1.454.CMB.1.raw
  modified_base (239)..(239): a, c, t, g, unknown or other
  misc_feature (239)..(239): n is a, c, g, or t
  modified_base (255)..(260): a, c, t, g, unknown or other
  misc_feature (255)..(260): n is a, c, g, or t
tcagtcacgtactacacgaccggtgctcgatttagcactcgcacgttgggtcgtgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcatcttccgccatctgatagtacgtgactgagcgggntggcaaggcgcatagnnnnnn

SEQ ID NO: 28925 - DNA, 258 bp, Homo sapiens
  misc_feature: GYAE6OF02J2YGA.13.55.E11.1.454.CMB.1.raw
  modified_base (252)..(258): a, c, t, g, unknown or other
  misc_feature (252)..(258): n is a, c, g, or t
tcagtcacgtactacacgaccggtgctcgatttagcactcgcacgttgggtctgggacagacttcactctcaccatcagcagcctcgagcctgaagatttgcagcttattactgtcagcagcgtagcaactggcctccggccctttcggcggagggaccaaggtggagatcaacgaactgtggctgcaccatctgtcttcatcttcccgccatcgatagtacgtgactgagcgggctggcaaggcgcatagnnnnnnn

SEQ ID NO: 28926 - DNA, 498 bp, Homo sapiens
  misc_feature: GYAE6OF02JE0UY.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctcctggggctcctgctgctctggctctcaggtgccagatgtgacatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatgttgcatccactttgcaaagtgggtcccatcaaggttcagcggcagtggatctgggacagaattcactctcacaatcagcagcctgcagcctgaagattttgctaacttattactgtacaacagtacttaatacgttacccgcttacagtttcggacggaagggaccaagggtggagagtacaaacgtaactagtggctgacc

SEQ ID NO: 28927 - DNA, 256 bp, Homo sapiens; identical to SEQ ID NO: 28728
  misc_feature: GYAE6OF02GXHBJ.13.55.E11.1.454.CMB.1.raw
  modified_base (254)..(256): a, c, t, g, unknown or other
  misc_feature (254)..(256): n is a, c, g, or t

SEQ ID NO: 28928 - DNA, 252 bp, Homo sapiens
  misc_feature: GYAE6OF02F4PTZ.13.55.E11.1.454.CMB.1.raw
  modified_base (251)..(252): a, c, t, g, unknown or other
  misc_feature (251)..(252): n is a, c, g, or t
tcagtcacgtactacacgaccggtgctcgatttagcactcgcacgttgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgccatgatagtacgtgactgagcgggctggcaaggcgcatagnn

SEQ ID NO: 28929 - DNA, 260 bp, Homo sapiens
  misc_feature: GYAE6OF02JEE99.13.55.E11.1.454.CMB.1.raw
  modified_base (255)..(260): a, c, t, g, unknown or other
  misc_feature (255)..(260): n is a, c, g, or t
tcagtcacgtactacacgaccggtgctcgatttagcactcgcacgttgggtctgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcatcttcccgccatctgatagtacgtgactgagcgggctggcaaggcgcatagnnnnnn

SEQ ID NO: 28930 - DNA, 503 bp, Homo sapiens
  misc_feature: GYAE6OF02IXIKB.13.55.E11.1.454.CMB.1.raw
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
  modified_base (347)..(347): a, c, t, g, unknown or other
  misc_feature (347)..(347): n is a, c, g, or t
  modified_base (379)..(379): a, c, t, g, unknown or other
  misc_feature (379)..(379): n is a, c, g, or t
  modified_base (405)..(405): a, c, t, g, unknown or other
  misc_feature (405)..(405): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaancccgtaagctcttgatctatggtncatccagtttaaaaagtgggtccatcaagttcagcgcagtggatcgtggcacagacttnattctacacaatcagcagctgcagcctgaagnttttgcaactttatactgtcctaaanaagtatactaactagttactcgtacggtacgtcgacgaacggacgtaagtagtaactaacgaacgtaatggtagctacgacactatctacttctctac

SEQ ID NO: 28931 - DNA, 519 bp, Homo sapiens
  misc_feature: GYAE6OF02HFSXW.13.55.E11.1.454.CMB.1.raw
  modified_base (301)..(301): a, c, t, g, unknown or other
  misc_feature (301)..(301): n is a, c, g, or t
  modified_base (364)..(364): a, c, t, g, unknown or other
  misc_feature (364)..(364): n is a, c, g, or t
tcagtcacgtactacacgaccggtgctcgatttagcactcgcacgttgggtttgggggggggtctcaggaggcagcgctctcgggacgtctccaccatggcctgggctctgctattcctcaccctcctcactcagggcacaggatcctgggctcagtctgccctgactcagcctcgctcagtgtccgggtctcctggacagtcagtcaccatctcctgcactggaaccagcagtgatgttggtgttataactatgtctctggtacaacaacaccagcaaacgccccaaaatcatgatttangatgtcagtaagcggccctcgacggggtccctgatcgcttctctcgcctcaagtctggcaacncggccctcctgaccatctcgtcgggctccgaggctggaggatgagttcgtgtatttatactgctgctacatagtcgcgaggccagtctactacgtgtactacggttcggacggaggaccaagccgtcgaccgtccgtaggtcacgaccctaacgg

SEQ ID NO: 28932 - DNA, 537 bp, Homo sapiens
  misc_feature: GYAE6OF02GBJ2U.13.55.E11.1.454.CMB.1.raw
  modified_base (369)..(369): a, c, t, g, unknown or other
  misc_feature (369)..(369): n is a, c, g, or t
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagatgggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtcctcaagagtcgagtcatcatatccgtanacaggtccaggaacaattctccctgaaagtgagttctgtgaccgtgcagacacggctgtctattattgtgcgagacggcaaatagtggttcagggtattcgactacgtggggccaagggaacccttgggtccaccgtctcctcgacgccctaccaccgagggtacccc

SEQ ID NO: 28933 - DNA, 503 bp, Homo sapiens
  misc_feature: GYAE6OF02HP2KE.13.55.E11.1.454.CMB.1.raw
  modified_base (379)..(379): a, c, t, g, unknown or other
  misc_feature (379)..(379): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccaggtaaagcccctaagctcctgatctacgatgcatccaatttggaaacaggggtccatcaaggttcagtggagtggatctgggacagtattttacttcaccatcagcagcctgcagcctgaanatattgacaacattattactgtcagcagtatgaataatctccgtatcctaccttcggaccaagggaccacgactagggaataacttaaacgaacttgtacggctcggacctaccatctgttacc

SEQ ID NO: 28934 - DNA, 539 bp, Homo sapiens
  misc_feature: GYAE6OF02ID9NK.13.55.E11.1.454.CMB.1.raw
  modified_base (358)..(358): a, c, t, g, unknown or other
  misc_feature (358)..(358): n is a, c, g, or t
tcagtcacgtactacacgaccggtgctcgatttagcactcgcacgttgggtttgggggactcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagccccgaactcctgatctacggtacatccactttgcacagtgggatcccatcaaggttcagtggcagtagatcgtaggaacagtacttttacccncaaccatcgaaggggtctacagcctgaaagattttcgcgtacttactatttcgtacaacagtacgttacccttcctcccccggtacgttccggccaacgggaaccgaacggtaggaacgtacaagacgaactagtgctgacaccgatcctgtccttcactcttcccgccatctagatacgg

SEQ ID NO: 28935 - DNA, 260 bp, Homo sapiens
  misc_feature: GYAE6OF02G8116.13.55.E11.1.454.CMB.1.raw
  modified_base (255)..(260): a, c, t, g, unknown or other
  misc_feature (255)..(260): n is a, c, g, or t
tcagtcacgtactacacgaccggtgctcgatttagcactcgcacgttgggtcgtgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcatcttccgccatctgatagtacgtgactgagcgggctggcaaggcgcatagnnnnnn

SEQ ID NO: 28936 - DNA, 522 bp, Homo sapiens
  misc_feature: GYAE6OF02HZGVK.13.55.E11.1.454.CMB.1.raw
  modified_base (307)..(307): a, c, t, g, unknown or other
  misc_feature (307)..(307): n is a, c, g, or t
  modified_base (376)..(376): a, c, t, g, unknown or other
  misc_feature (376)..(376): n is a, c, g, or t
  modified_base (388)..(388): a, c, t, g, unknown or other
  misc_feature (388)..(388): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
  modified_base (442)..(442): a, c, t, g, unknown or other
  misc_feature (442)..(442): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggaggtttggtacagccagggcggtccctgagactctcctgtataacttctggattcaacttgggtgattatgctatgaactgggtccncaggctccgagggaagggctgggagtgggtaggtttcagtttaggagcaattctcatgagtgggacaanagaatacgccgngtctagtaaagcagattcacatcncaaganatgagtcagaagcatcgcctttcngcagatgagtacgcctagaacgacgaggacacacgaccatctatactgtagctagagtatagtgactacgtcctagtccg

SEQ ID NO: 28937 - DNA, 256 bp, Homo sapiens
  misc_feature: GYAE6OF02F76FP.13.55.E11.1.454.CMB.1.raw
  modified_base (250)..(256): a, c, t, g, unknown or other
  misc_feature (250)..(256): n is a, c, g, or t
tcagtcacgtactacacgaccggtgctcgatttagcactcgcacgttgggtcgtgggacagacttcactctcaccatcagcagcctcgagcctgaagattttgcagcttattactgtcagcagcgtagcaactggcctccggccctttcggtggagggaccaaggtggagatcaaacgactgtggctgcacatctgtcttcatcttccgcatctgatgtacgtgactgagcggctggcaaggcgcatagnnnnnnn

SEQ ID NO: 28938 - DNA, 742 bp, Homo sapiens
  misc_feature: GYAE6OF02IAAYF.13.55.E11.1.454.CMB.1.raw
  modified_base (214)..(214): a, c, t, g, unknown or other
  misc_feature (214)..(214): n is a, c, g, or t
tcagtcacgtactacacgaccggtgctcgatttagcactcgcacgttgggtttgggggacgaccctgggccctcagggaagcacgcatcgggggtgccgcagccatggcctggaccgctctcctgctgtagcctccttgctcactttacagcttcctgtcggccttcctatgagtttgactcagccactctcagtgtcagtcggccccgggganagacggccacaattcccctgtgagggaaacaaccttagaacgtcagaatgtccactggtaccagcagaagtcacggccaggcccctgtggtagtcatcgtagtagggataagtaaccggccctcgtagggactcccgtgaaccgtattcctacgtcggacctacccgaaacgtccggggaaaccaccgggacccaacccgtaggacccaacgtacaaaccgacgaccgacccgaaacggaacggggactacggaacgggtctacggtaaccgttaatttagttacggtacccggaaggggttaggttacggggaaccacgggtccaacccgacggtacgtaagttacgttaccggggccgggaccggggtaaccgaaggttccgttacgggaccccggttaccgtacgggtaccaccgggacccggtaacgggtccttaccgggtccccccgttacgggttaccctaccgtttccgtccggtttacccccaccccggtttccccgttacccggttacggttaacccgg

SEQ ID NO: 28939 - DNA, 256 bp, Homo sapiens; identical to SEQ ID NO: 28727
  misc_feature: GYAE6OF02GVM7D.13.55.E11.1.454.CMB.1.raw
  modified_base (255)..(256): a, c, t, g, unknown or other
  misc_feature (255)..(256): n is a, c, g, or t

SEQ ID NO: 28940 - DNA, 570 bp, Homo sapiens
  misc_feature: GYAE6OF02IGHDU.13.55.E11.1.454.CMB.1.raw
  modified_base (459)..(459): a, c, t, g, unknown or other
  misc_feature (459)..(459): n is a, c, g, or t
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctccctaagtaggactacttactacgtgggctggatccggcacgcccccgagggaagggctggagtggagttgggatagtctacttagtagtgggagtacgaactacaagtccgtacctacaagacgtcgagtcgatacatatccgtagacgtaggtaccgaggtaacgaacttctaccctagtaaagtgaacgttcgtgtcgacgtcgcagacacggtctgtctattntgtgcgagacgacaaatgtgtacgaggtagtcgacgtacgtagggccgaacgggtaccctcggtcgtaaccgtcctccgtacaccgtcccgtacccaccggtaggaccccg

SEQ ID NO: 28941 - DNA, 525 bp, Homo sapiens
  misc_feature: GYAE6OF02HBDCL.13.55.E11.1.454.CMB.1.raw
  modified_base (361)..(361): a, c, t, g, unknown or other
  misc_feature (361)..(361): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgattaggctggtatcagcagaaaccagggaaagcccctaagctcttgatctatggtgcatccagtttaaaaagtgggtcccatcaaggttcagcgcagtgatctggcacagacttcattctcacatcagcngcctgcagcctgaagtattttgactaactttattactgttactacaaagtactacaactaatttaactccttaggggtaccgtttgggaccctaaaggggaccaagggtgaaactacgaaaacgtactaggtacggctggacctacgattcgtagtcttctacc

SEQ ID NO: 28942 - DNA, 662 bp, Homo sapiens
  misc_feature: GYAE6OF02ILV62.13.55.E11.1.454.CMB.1.raw
  modified_base (201)..(201): a, c, t, g, unknown or other
  misc_feature (201)..(201): n is a, c, g, or t
  modified_base (335)..(335): a, c, t, g, unknown or other
  misc_feature (335)..(335): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccggganagaccggccacaattccctgtgaggaaacaccttagaagtcagaatgaccactggtaccagcagaagtcaggccaggcccctgtggtggtcatctagtagggaataacgtaccggcctacgtagggactcccgngaccgtattctctcggctccaacgtcgggaaccacggaccaccgtcgaccactacaacgacgacgacccgaaggacggggacgtaggacgactaggaacttaattacgttggtaccgtagggttggttacggggaacgacggaccgtaaccgtacgggtagtaacgttaaggttccgggacggggaccgggacgaacgccgtacggacccgtaccgtacgtaccgacgacccgaacggtccgtcccggacccccgttcggaccctaaccgttcccgttccggttacccccgtaccccgttccccgttaccgtacccgttaacccggg

SEQ ID NO: 28943 - DNA, 256 bp, Homo sapiens; identical to SEQ ID NO: 28727
  misc_feature: GYAE6OF02GHXKQ.13.55.E11.1.454.CMB.1.raw
  modified_base (255)..(256): a, c, t, g, unknown or other
  misc_feature (255)..(256): n is a, c, g, or t

SEQ ID NO: 28944 - DNA, 255 bp, Homo sapiens
  misc_feature: GYAE6OF02H4NOK.13.55.E11.1.454.CMB.1.raw
  modified_base (253)..(255): a, c, t, g, unknown or other
  misc_feature (253)..(255): n is a, c, g, or t
tcagtcacgtactacacgaccggtgctcgatttagcactcgcacgttgggtttgggacagacttcactctcaccatcagcagcctcgagcctgaagatttgcagcttattactgtcagcagcgtagcaactggcctccggccctttcggcggagggaccaaggtggagatcaaacgaactgtggctgcaccatctgtcttcatcttcccgcatctgatagtacgtgactgagcgggctggcaaggcgcatagnnn

SEQ ID NO: 28945 - DNA, 497 bp, Homo sapiens
  misc_feature: GYAE6OF02FSG65.13.55.E11.1.454.CMB.1.raw
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaatattttgctaacttattactgtactacaagatacactattactcctgggtaccgttcgaccgaaggaccaaggtagaatacgaaacgaactggtagctagcacgatctgtcttctac

SEQ ID NO: 28946 - DNA, 528 bp, Homo sapiens
  misc_feature: GYAE6OF02FOFUL.13.55.E11.1.454.CMB.1.raw
  modified_base (406)..(406): a, c, t, g, unknown or other
  misc_feature (406)..(406): n is a, c, g, or t
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctcccctgcccgtcacccttggacagccggcctccatctcctgcaggtctagtcaaagcctcgtatacagtgatggaaagacctacttgaattggtttcagcagaggccaggccagtctccaaggcgcctaatttataatgtttttacccgggactcgtgggtccccagacagattcagcggcaggtgggtcaggcactgatttcacattagaaatcaccgagggtggaggntggaggatggtgggtatttatactgcatgcaagctactattctggtccttttcaccgttttcggtcctagggacctaagtggaactaacccaagtccgaatgtgctgccaccattctgtacc

SEQ ID NO: 28947 - DNA, 528 bp, Homo sapiens
  misc_feature: GYAE6OF02J2IWC.13.55.E11.1.454.CMB.1.raw
  modified_base (307)..(307): a, c, t, g, unknown or other
  misc_feature (307)..(307): n is a, c, g, or t
  modified_base (361)..(361): a, c, t, g, unknown or other
  misc_feature (361)..(361): n is a, c, g, or t
  modified_base (446)..(446): a, c, t, g, unknown or other
  misc_feature (446)..(446): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggaggtttggtacagccagggcggtccctgagactctcctgtataacttctggattcaacttgggtgattatgctatgaactgggtccnccaggctccgagggaaggggctggagtgggtaggtttcagttaggagcaattcncatgatgggacaacagaatacgccgcgtctagtaaaaggcagattcaccatctacaagagatgagtccaagagcatcgcctttcngcagatgagtagcctaggaacgaccgaaggacacacgccatctatctgtgctagagtagttatgactacgtccctagtaccg

SEQ ID NO: 28948 - DNA, 565 bp, Homo sapiens
  misc_feature: GYAE6OF02JEOUF.13.55.E11.1.454.CMB.1.raw
  modified_base (169)..(169): a, c, t, g, unknown or other
  misc_feature (169)..(169): n is a, c, g, or t
  modified_base (199)..(199): a, c, t, g, unknown or other
  misc_feature (199)..(199): n is a, c, g, or t
tcagtcacgtactacacgaccggtgctcgatttagcactcgcacgttgggtttgggagcctgggcctcaggaagcagcatcgggggtgccgcagccatggcctggaccgctctcctgctgagcctccttgctcactttacagcttctgtggcctcctatgagttgactnagccactctcagtgtcagtggccccggganagacggccacaattccctgtgagggaaacaaccttagaagtcagaatgtccactggtaccagcagaagtcaggccaggcccctgtggtgtcatctatagggataataacccggcctcgtgggactcccgtgaccgattctctggcctaccaacgtcgggaacaccggccaccctgaccatcaacagacacccgaagacgggatgaggctgtactattatgtcgaggtgtggacagccacgacggtgagtagtcggcggcgggacaagctgaccgtccgtagtcgacgcccgaaggtccgtaccgccccgtcggtccgtaccttccgttccgttccccctaccccttcccgtaccttacgttaccgg

SEQ ID NO: 28949 - DNA, 514 bp, Homo sapiens
  misc_feature: GYAE6OF02F8Q2R.13.55.E11.1.454.CMB.1.raw
  modified_base (327)..(327): a, c, t, g, unknown or other
  misc_feature (327)..(327): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatgtgcatcctaagtttaaaagtgggtacccatcaagttcagcgnagtgatctggcacagacttcacttctcaccatcagcagcctgcagcctagaatattttgctaactttattactgtactaacaagactcaactaattactccgtaggtacgttcggaccgaagggaaccaaggtaggaactacgaaacgtactggtaggtctcgacaccagtctcgttacttctaccg

SEQ ID NO: 28950 - DNA, 560 bp, Homo sapiens
  misc_feature: GYAE6OF02G17MU.13.55.E11.1.454.CMB.1.raw
  modified_base (200)..(200): a, c, t, g, unknown or other
  misc_feature (200)..(200): n is a, c, g, or t
  modified_base (362)..(362): a, c, t, g, unknown or other
  misc_feature (362)..(362): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccggganagaccggccacaattccctgtgagggaaacaaccttagaagtcagaatgtccactggtaccagcagaagtcaggccaggccccctgtggtggtcatctatagggataataaccggcctctgggactccctgaccgtattctctggctccaacgtcgggaacncgccacctgaccatacaacagacgacccaaggacgggatggacggctgacttattagttgtcgaggtggtgggacagcaccgacggtgatagtcgggcggcgggaccgaagcgtcggaccgtccgtaggtccacgcccaacggccctcggccccctcggtacctcctccgtccttcccaccctcctactacgtaccgg

SEQ ID NO: 28951 - DNA, 760 bp, Homo sapiens
  misc_feature: GYAE6OF02HOS6N.13.55.E11.1.454.CMB.1.raw
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtcgtgggggaggtttggtacagccagggcggtccctgagactctcctgtataacttctggattcaacttgggtgattatgctatgaactgggtccgccaggcctccgaggggaaggggctgggagttggggtaggtttcagttaaggagctaattcgactagtgagtggggaacaacgaagtaaacgtacgcccggacgttccgtaaggttaaaaacgggccaagggtaactttaccgaaaccctagttacccttaccgaaaaggacgaagttacggaacgttacccgaaaggtaaacggacccgtaacgttacccggttacccccttttttcgtacggtaccgtaaggtaagttacgggtaaacggttaacggcccgttaagggaaaccgggtaaccccggaagggaaaccctaaaccgaaccgggtacccctaagtttacccgtttaaagtttaacccgtaggtttaccggtaccgtttaaaggaggttaaggttaacggttttccggaaccgttaaccggtttaccccgttaaccgtaccccggg

SEQ ID NO: 28952 - DNA, 563 bp, Homo sapiens
  misc_feature: GYAE6OF02I5AEO.13.55.E11.1.454.CMB.1.raw
  modified_base (200)..(200): a, c, t, g, unknown or other
  misc_feature (200)..(200): n is a, c, g, or t
  modified_base (547)..(547): a, c, t, g, unknown or other
  misc_feature (547)..(547): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccggganagacggccacaattccctgtgaggaaacaaccttagaagtcagaatgtccactggtaccagcagaagtcaggccaggcccctgtggtggtcatctatagggataacgtaaccgggcctcgtcgggactcccgtgaccgtattctctcggcctaccgaacgtcggggaaccaccgggcccaacccgtcgaaccactacaaacgagacgacccaaggacgggatgaggctagacttattagttgtcgaggtggtaggacaggcaccgacggtgagtacgttcggcggcggacagctcgaccgtcgagtcacgccaaggctccgcccctcgtccacgtcctcgttccccncccttctcgtagtacg

SEQ ID NO: 28953 - DNA, 556 bp, Homo sapiens
  misc_feature: GYAE6OF02IOBIM.13.55.E11.1.454.CMB.1.raw
  modified_base (456)..(456): a, c, t, g, unknown or other
  misc_feature (456)..(456): n is a, c, g, or t
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattgggggatagtctcttagtagtgggagtacgaactacaatccgtccctcaagagtcgagtcatcatatccgtagacaggtccaggaacgaattctccctagaaagtgagttctagtgaccgtcgcagacacggctgtcttattatgtgcgagacgnaaatatggttcagggtagttcgacgtacgtgggcccgagggaacccctgggtaccacccgttctcccgtcacgtcccctaccacccgaacgggtaccccg

SEQ ID NO: 28954 - DNA, 541 bp, Homo sapiens
  misc_feature: GYAE6OF02FYJBN.13.55.E11.1.454.CMB.1.raw
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccggganagacggccacaattcccngtgagggaaacaaccttagaagtcagaatgtccatggtaccagcagaagtcaggccaggcccctgtggtggtcatctatagggataataaccggccctctgggactccctgaccgattctctggctccaacgtcggggaacacggccacctgaccatcaacagacgcccaagacgggatggaggctgactattattgtcaggtgtgggacagcaccgaggtgatagttcgggcggcgggaccaagcctagaccgtcgtaggtcacgcccaaggctcgccccctggtccacgttcctcgttccccgccctcctcgtagtaccgg

SEQ ID NO: 28955 - DNA, 712 bp, Homo sapiens
  misc_feature: GYAE6OF02I6JC5.13.55.E11.1.454.CMB.1.raw
  modified_base (201)..(201): a, c, t, g, unknown or other
  misc_feature (201)..(201): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccggganagacggccacaattccctgtgaacgggaaacaaccttagaagtcaagaatgccactggtaccagcagaagtcaggccacggtcccctggtggtggtcatcgtagtagggataacgtaaccggcctcgtcgggactcccgtagacccgtattccgtcgtcggacctaccgaaacgttcgggggaaaccacccgggtacccaacccccgttaggaaacccctaacgtacccgtaaaaccgacgggaacccgacccccgtaaaagggggaaccgggggtaacttacggggaacggtacccgtaagggtaaaccttaacgtttaattcggtaccgtaggggtcggtacgggacgtacgaccgaccgtacggtgaacgtagttccgggacgggccgggaaccgagcgtcggacccgtaccgtaggtccacgacccgaacggtccgtaccggtccccgttacggtcccaccgttccgttcccgttaccccacccgttccttaccgtaccgttaccgg

SEQ ID NO: 28956 - DNA, 626 bp, Homo sapiens
  misc_feature: GYAE6OF02ID7CH.13.55.E11.1.454.CMB.1.raw
  modified_base (426)..(426): a, c, t, g, unknown or other
  misc_feature (426)..(426): n is a, c, g, or t
  modified_base (455)..(455): a, c, t, g, unknown or other
  misc_feature (455)..(455): n is a, c, g, or t
  modified_base (467)..(467): a, c, t, g, unknown or other
  misc_feature (467)..(467): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggtttccttgttgctattttaaaaggtgtccaatgtgagctgcagctggtggagtctgggggaggtttggtacaggccagggcggttccctgaggactctccgttgtactaacttcgtgtagttcaacgttgggtgtagtttatgctagtgaacgttggggtccgccgagggtcctccgaagggggaacggggtctgggtaggtggggttaggtttcgagttacgggagtactaattcgtactagtgagtggaacacagaatacgccgngtacgtagtaaacggcaagacttacactntactagaaacgngattagagtaccagaacgcagtacctctttacagtacagtacgtcgacgttacgccgttaagaaccgtaccggacggtaacaccgtaacgcctacttcgtaacttcggtagttagaccttaaggagttacgttcgtagacgtacgtaccgtaccgtacg

SEQ ID NO: 28957 - DNA, 261 bp, Homo sapiens
  misc_feature: GYAE6OF02I3KRU.13.55.E11.1.454.CMB.1.raw
  modified_base (249)..(249): a, c, t, g, unknown or other
  misc_feature (249)..(249): n is a, c, g, or t
  modified_base (256)..(261): a, c, t, g, unknown or other
  misc_feature (256)..(261): n is a, c, g, or t
tcagtcacgtactacacgaccggtgctcgatttagcactcgcacgttgggtctgggacagacttcactctcaccatcagcagcctcgagcctgaagattttgcagcttattactgtcagcagcgtagcaactggcctccggccctttcggcggagggaccaaggtggagatcaaacgaactgtggctgcaccatctgtcttcattcttcccgcatctgactagtacgtgactgagcgggctggcaaggngcatagnnnnnn

SEQ ID NO: 28958 - DNA, 542 bp, Homo sapiens
  misc_feature: GYAE6OF02ISJFH.13.55.E11.1.454.CMB.1.raw
  modified_base (201)..(201): a, c, t, g, unknown or other
  misc_feature (201)..(201): n is a, c, g, or t
  modified_base (446)..(446): a, c, t, g, unknown or other
  misc_feature (446)..(446): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccggganaggaccggccacaattccctgtgagggaaacaaccttagaagtcagaatgtccactggtaccagcagaagtcaggccaggcccctgtggtggtcatctatagggataataaccggcctctggggatcccgtgaccgattctactggcctaccaactcggggaacacggccaccctgaccatcaacagacgcccaagacggggatgaggctgactattatgtcgaggtggtggacgagcacgacgngagtagtcggcggcgggaccaagctggaccgtcgagtcacgccaaggctccgccccgtcggtccacgtcctcgttccccaccctctactagtacgg

SEQ ID NO: 28959 - DNA, 799 bp, Homo sapiens
  misc_feature: GYAE6OF02HSYLK.13.55.E11.1.454.CMB.1.raw
  modified_base (782)..(782): a, c, t, g, unknown or other
  misc_feature (782)..(782): n is a, c, g, or t
tcagtcacgtactacacgaccggtgctcgatttagcactcgcacgttgggtttggggtgatcaggactcctcagttcaccttctcacaatgaggctccctgctcagctcctggggctgctaatgctcgtgggtcccaggatccgaggtggggatgttgtgatgactcagtctccactcctcctcgcccgtcaccgttggacacgccggcctaccatcctccgtgccgaggtctaagtacaaacgtccttagtaatacagtgaagtaggaaacgtaccttacgttagtaagtttggttacagcgaaggtaacggccacgggacctacggtacctaccgaaacgggtcctaacctttaaattttaacgtaacgttttaccgggttttttaacccgggaactttccggttaccgggggttacccctaagggaaccgtaggtaactttaccgagggaccgggtacgtaggggtttacgggtacgaacggacctaacgtcggttaactttaccgaacgtaacgtttaagtaaaactccgtaaaccggtaagggggttacggaacggtacgttaaggaaggttagttagggtttagggttaaattttaagtttaccgagtacgtagtacgaaccgtaagtaccttaaacgtagtttaccgtaccggtttacccgtttacgttacccggtttccggaaccccgttaacggggtaaaccctaaggttaccggtactaaaccgtaaccgtacgttaaccgtcggttacgtaccgtacgtacccaaccgttnttacccgttggttaccc

SEQ ID NO: 28960 - DNA, 598 bp, Homo sapiens
  misc_feature: GYAE6OF02IOC1R.13.55.E11.1.454.CMB.1.raw
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggacgaccctcgtccctcagttgtaatgtgtctggtggctccctaagtaggactacttactacgtggggctggatccggcacgcccccgagggaggggcgtggaggtggagttggggattatctcttagtaggtgggagtacgaactacactcccgtcctacaagagtacgagtcatcatataccgtagacgaggtaccaaggaaccgtaattcctaccgtagtaaagtgtagttctagtcgaccgtcgacacgaccacggctgttccttatttcttgtcgcgacgacgataaatagttggttacgagggtagttacgacgtacggtcgggaccgtagggtaacccgttggtacccgacccgttctcccgtacgaccgtcccctacccgaccgaccggtcccg

SEQ ID NO: 28961 - DNA, 259 bp, Homo sapiens; identical to SEQ ID NO: 28744
  misc_feature: GYAE6OF02HFFB6.13.55.E11.1.454.CMB.1.raw
  modified_base (255)..(259): a, c, t, g, unknown or other
  misc_feature (255)..(259): n is a, c, g, or t

SEQ ID NO: 28962 - DNA, 607 bp, Homo sapiens
  misc_feature: GYAE6OF02G3092.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagcccggcctccatctcctgcaggtctagtcaaagcctcgtatacagtgataggaaagacctacttgaattggtttcagcagaggccaggccagtctaccaaggcgaccttaatttataattcgttttacccggacttcgtcgggtcccagacagtattcagcggcagtggtcaggcacgtgtatttcactatagaaatcacgagggtaggagctaggaggtagtggttggtatttagttactgtactagtgacgaacgtctaacttatttcgtacggttacccttttcgtaccgtttccggacccgttagggtaacccgtaaggttcggtaaccttaaccgtaacgttaccggtaacgttacggtacggtccgttacgtaccgtaccctaagttccgtacgtttacccg

SEQ ID NO: 28963 - DNA, 573 bp, Homo sapiens
  misc_feature: GYAE6OF02JEU6J.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcgaggcacgtgactttcactactagaaaatcagcgagggtggaggacgtggaggagtggtttaagttgggtcttcgttacgtttagttgtacctagtgacgtaacgacaacgacaacgtcggtacccgttacttaccgttttcggcccgtaacggggacctaaacggcgttagggacgtacttaccgaattacggaaccgttggttacggg

SEQ ID NO: 28964 - DNA, 572 bp, Homo sapiens
  misc_feature: GYAE6OF02IHMG8.13.55.E11.1.454.CMB.1.raw
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
tcagtcacgtactacacgaccggtgctcgatttagcactcgcacgttgggtttggggatgctttctgagagtcatggatctcatgtgcaagaaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctcctaagtaggactacttactactggggctggatccggcagcccccagggaagggctggagtggattgggataatctcttatagtgggagtacggaactacaatccgtcctcgaagaagtcgagtcatcatatcgtagacaggtaccaggaaacgaattcgtccctagaaaacgtgaacgttctgtgaaccgtcgctagacacggctgtctattntgtncgagtacggacaaatattaggttacaagggtactttacggacttacgtaggggtccaacgggtaaccctgggtccgtaaccgtcgtcctacgacgtccctaccacccgtaagggtaccccg

SEQ ID NO: 28965 - DNA, 713 bp, Homo sapiens
  misc_feature: GYAE6OF02FWMF4.13.55.E11.1.454.CMB.1.raw
  modified_base (199)..(199): a, c, t, g, unknown or other
  misc_feature (199)..(199): n is a, c, g, or t
tcagtcacgtactacacgaccggtgctcgatttagcactcgcacgttgggtttgggagcctgggcctcaggaagcagcatcgggggtgccgcagccatggcctggaccgctctcctgctgagcctccttgctcactttacagcttctgtggcctcctatgagttgactcagccactctcagtgtcagtggccccggganagacggccacaattccctgtgagggaaacaaccttagaagtcagaatgtccatggtaccagcagaagtcaggccaggcccctgtggtggtcatctatacgggatagtaacgtaccgtcctcggtaggtacctccgtacgacgtacttcctcgtcgtcctaccgtacggtaccggaaccgaccgaccctaccgtaccgaactactaaccgaacgaacgaccgaaccgaacgggaaccggtagtacgggacgtacgtacgtaacgttaatttacgttcgtacggtgggttgggtacggtaacgacggaccgaccggtaggtacgtagttacgggttaccgggaccggggacccggaaccgaaccgtacggtaccggtacccgttaccgggttaccgtacgacccggtaaccggtaaccggtccgtacccccggtcccccggtttaccgggacccttacccgttccggtttccccggtacccccggttccccgttaccccgttaccgttaacccggg

SEQ ID NO: 28966 - DNA, 578 bp, Homo sapiens
  misc_feature: GYAE6OF02I0A5T.13.55.E11.1.454.CMB.1.raw
tcagtcacgtactacacgaccggtgctcgatttagcactcgcacgttgggtttgggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccaagggaacgcccctaagctcttgatctatgtgcatctagtttaaaagtcgggtccatcagttcagcggcagtgatcgtggcacagtacttcattctccacctatcagctacgctcgacacgtctagtaaacgttatttttacgaccttaactttactttactcgtactaacgaagtactacaactaattacttccggtaggtaccgttacggaccgtaaacgggaaccgtaaaggttcggaaaactccgtaaaaggtaccttacggtagggccctaggaaccctacccaattcccgttacggttacctttacccgtaaccg

SEQ ID NO: 28967 - DNA, 558 bp, Homo sapiens
  misc_feature: GYAE6OF02FFI8W.13.55.E11.1.454.CMB.1.raw
tcagtcacgtactacacgaccggtgctcgatttagcactcgcacgttgggtttggggggtctcagagaggagccttagcccctggactccaaggcctttccacttggtgatcagcactgagcacagaggactcaccatggaattggggctgagctgggtgctccttgttgctattttagaaggtggccagtgtgagatgcgactggtggagtctgggggaggcttggtccaggccgggggggtcacgtgagactctcctgtacagcctcgagatttcatttttcaggaatttattggatgaggttgggtccgccagtctccgaggggaaggggctggagtggggtggcccaaacgataaaagggaggagtggggagtcagacatattatgtggagtcgtggtggcgggccattcacctatttcccgagacgacaacgccaagactcgtcagtatatctgacaaagtgaggacgccgtggagtagcgagtgatacggctaacattattagttgtgcgtaagtagttggaaccgttagttttcccgaggtaccggtaccg

SEQ ID NO: 28968 - DNA, 578 bp, Homo sapiens
  misc_feature: GYAE6OF02ILRIE.13.55.E11.1.454.CMB.1.raw
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttcgccgggcaagtcagggcattagaaatgatttaggctggtatcagcagaaccagggaaagcccctaagctctgatctatggtgcatccagtttaaaagtgggtaccatacaaggttcagcggcagtgatcgnggacacagacttcattacncaccatcagcacgcctgacacgtcctagaacgttatttgacttaaacttattactgtactaacaagtactacaactaaacttactacccgttagggtaccgtttccgggaacgtaaacgggtaaccgtaagggtacggaaaacgttaccgaaaaacggtacgttacggttacggtacctacggtactaaccgtacttaccgtttacgttcctttacgtaaccg

SEQ ID NO: 28969 - DNA, 524 bp, Homo sapiens
  misc_feature: GYAE6OF02F0KIU.13.55.E11.1.454.CMB.1.raw
  modified_base (200)..(200): a, c, t, g, unknown or other
  misc_feature (200)..(200): n is a, c, g, or t
  modified_base (485)..(485): a, c, t, g, unknown or other
  misc_feature (485)..(485): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccggganagacggccacaattccctgtgagggaaacaaccttagaagtcagaatgtccactggtaccagcagaagtcaggccaggccccctgtggtggtcatctatagggataataaccggcctctgggatccctgaccgattctctggctccaactcggggaacacggccaccctgaccatcaacagacgcccaaggacggggatggaggctggactattatgtcaggtgtgggacagcaccaggtgatagttcggcggcgggaccagctgaccgtcaggtcagccaggcncgcccctcggtcactcgtcgtcccgccctctcgtgtacg

SEQ ID NO: 28970 - DNA, 593 bp, Homo sapiens
  misc_feature: GYAE6OF02I8VZI.13.55.E11.1.454.CMB.1.raw
  modified_base (200)..(200): a, c, t, g, unknown or other
  misc_feature (200)..(200): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccggganagacggccacaattccctgtgagggaaacaaccttagaagtcagaatgtccactggtaccagcagaagtcaggccacggcccctgtggtggtcagtctatagggataacgtaaccggcctcgtgggactcccgtgaccgtattcctcgtggcctacccgaacgtccggggaaccaccggcccaccctgaccatcaaacagacgacccaaggacgggatggaggctgactatatgtcgaggtggtgggacagccaccgacggtagacttagtcggcgggcggaacacgctcggacccgtcgtacggtcacgcccgaacgggtcctaccggcccccttacggtccctacgttcccgttcccgttacccccacccttccccttacgtacgttaccg

SEQ ID NO: 28971 - DNA, 514 bp, Homo sapiens
  misc_feature: GYAE6OF02FX0Q2.13.55.E11.1.454.CMB.1.raw
  modified_base (309)..(309): a, c, t, g, unknown or other
  misc_feature (309)..(309): n is a, c, g, or t
  modified_base (364)..(364): a, c, t, g, unknown or other
  misc_feature (364)..(364): n is a, c, g, or t
tcagtcacgtactacacgaccggtgctcgatttagcactcgcacgttgggtttgggggggggtctcaggaggcagcgctctcggggcgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccagtgacattggtgattataattatgtctcctggtaccaacagtgcccaggcaaagcccccaaactcataatttttacngtcagtcatcggccctcagggtttctaatcgtttctctggctcagtctggcaacncggcctcctgaccatctctggctccgagctgaagcgaggctgattatactgcagctcatatacaagcgacagctctctttatctcgttcggaggtggaccagtctaaccgtctaagtcacgcccaaggcccaacccatcgtccacttccg

SEQ ID NO: 28972 - DNA, 257 bp, Homo sapiens; identical to SEQ ID NO: 28735
  misc_feature: GYAE6OF02FFQDO.13.55.E11.1.454.CMB.1.raw
  modified_base (255)..(257): a, c, t, g, unknown or other
  misc_feature (255)..(257): n is a, c, g, or t

SEQ ID NO: 28973 - DNA, 594 bp, Homo sapiens
  misc_feature: GYAE6OF02GQ9X3.13.55.E11.1.454.CMB.1.raw
  modified_base (200)..(200): a, c, t, g, unknown or other
  misc_feature (200)..(200): n is a, c, g, or t
  modified_base (426)..(426): a, c, t, g, unknown or other
  misc_feature (426)..(426): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccggganagacggccacaattccctgtgagggaaacaaccttagaagtcagaatgtccactggtaccagcagaagtcaggccagtccctgtcgctggtcatctatcaagatgccaagcggccctgagggactcccgtagacgcgtattctagtcggctcccaacgtcgtacgggaacaccgggtcccaacccgtgaacccataccaaacgagacgacccgaaggacggggtanaggacggtcgtagacttaagttactgtccgagggcgtcgggacaggtacaccgacggtagacttacgttcgggcggacgggtaccaagtcgtacgacccgttcgtaacgtccgaaccgtacccgaacggaccccaaccccgtaacgtcgtaccctacttcgttacccg

SEQ ID NO: 28974 - DNA, 608 bp, Homo sapiens
  misc_feature: GYAE6OF02JAG3W.13.55.E11.1.454.CMB.1.raw
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattaagaatgtattaggctggtatcagcaacgaaaccgagggaaaccgccctaagcttcttagactctagtggtgacagtaccgtaaaggtttaaaacggtcgggtacccagtacgtaaggttcaggtcggcgaggtggatcgaggacanagtacttnacttaccncacctagacagactagcctaggactacgaccgtagttaagttactttagaccttaactttacttacgtacgttaacctaacgaagtaacttaccgtaacttaactttacgttaccggtacgggtaccgttaccgaaccggtaaagggaccgtaaggtacgtaaactacgaaaccgtagtggtaccgtatacgacctactacgttcgtacgttctactaccc

SEQ ID NO: 28975 - DNA, 489 bp, Homo sapiens
  misc_feature: GYAE6OF02FQL9P.13.55.E11.1.454.CMB.1.raw
  modified_base (482)..(482): a, c, t, g, unknown or other
  misc_feature (482)..(482): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtacccatcaaggttcagcggcagtggatctggcacagacttcattctcaccatcagcagcctgcagcctgaagattttgactaacttattactgtctacaagatcacaattatcctggacgttcggccaggggaccaggtagaaatcgaaacgacgtgtggctgcacatcgtntctctac

SEQ ID NO: 28976 - DNA, 660 bp, Homo sapiens
  misc_feature: GYAE6OF02G9UF2.13.55.E11.1.454.CMB.1.raw
  modified_base (201)..(201): a, c, t, g, unknown or other
  misc_feature (201)..(201): n is a, c, g, or t
  modified_base (404)..(404): a, c, t, g, unknown or other
  misc_feature (404)..(404): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccggganaggaccggccacaacttccctgtaggaagggaaacctaaccgttagaagtcaagaatgtaccatggtaccagcagaagtcaggccaggcccctggtcggtggtcatctagtagggataacgtaaccggccctcgtcgggatcccgtgaccgattctctggcctaccgaacgtcgggaacacggccacccgtgaccataccaanacgacgacccaaggacgggatggacgggctacggaaccttatttagttgtacgtagggttggtacgggaaccaggccgaaccgtacgggtacgaacttacgggttaccgggaccggggccgggtaaccaacggctacgggtaaccccgtccgtagggtaccacggaccccgtaagggccctaccgcccccggtacggtccaccgttccgttaccccggttaccccgccccttacccgttccgttaaccggtaccgg

SEQ ID NO: 28977 - DNA, 530 bp, Homo sapiens
  misc_feature: GYAE6OF02FWIAP.13.55.E11.1.454.CMB.1.raw
tcagtcacgtactacacgaccggtgctcgatttagcactcgcacgttgggtttgggggggtctcagagaggagccttagccctggactccaaggcctttccacttggtgatcagcactgagcacagaggactcaccatggaattggggctgagctgggtgctccttgttgctattttagaaggtggccagtgtgagatgcgactggtggagtctgggggaggcttggtccagccgggggggtcactgagactctcctgtacagcctcgagattcattttcaggaattattggatgagttgggtccgccagtctccgagggagggctggagtgggtggccaacagtaaaggaggagtggggagtcagacagtattatgtgagtctgtgcgggcgattcaccatttccagagacaacgccagatcgtcagtatatctgacaaatgaaggagccgtagagagtgatgagtacggctacattaattagttgtagtagtagtattgaccgttagtttaccgacggacggtaccgg

SEQ ID NO: 28978 - DNA, 652 bp, Homo sapiens
  misc_feature: GYAE6OF02G8YVR.13.55.E11.1.454.CMB.1.raw
  modified_base (502)..(502): a, c, t, g, unknown or other
  misc_feature (502)..(502): n is a, c, g, or t
tcagtcacgtactacacgaccggtgctcgatttagcactcgcacgttgggtttggggtgatcaggactcctcagttcaccttctcacaatgaggctccctgctcagctcctgggctgctaatgctctgggtcccaggatccagtgggatgttgtgatgactcagtctccactctccctgcccgtcacccttggacagccggcctccatctcctgcaggtctagtcaaacgccttacgtatactagtgagttaggaaaacgtacccttacttagtaagtttggtttcagcagaggccaggccagtcctaccgaagggccgtaccttaatttataagttcgtttttacccgggacttcgtcggggtacccagacagtacttcgagcggcgaggttggtcaggcacgtgtattcatagttagaaactcgaacgtagggtggaggtcgtaggaggtagttgggtttagggtaattttagttacgtagcgtaagtcgacgtaacgtnttaactagttttccgtcggtttacctttccgttaccggttttccggacccgttagggtaaccctaagggttacgtaacttaacccgtaagtaccgtaaacgttcgggttacgtaccgtcggtaacctacccgtattccgttagtttaccg

SEQ ID NO: 28979 - DNA, 664 bp, Homo sapiens
  misc_feature: GYAE6OF02IP22O.13.55.E11.1.454.CMB.1.raw
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggcattagaaatgatttaggctggtatcagcagaaaccagggaagccctaagctcttgatctatggtgctataccgtaaaggtttaaaaggtcgggtacccatacgaaggttcgacggcggcgtaggtaggtatcgtggaccaacgagtacttactactttcctacacctatacgacgactaacgcctgaccgacgtcctagtaaagttacttttacgacttaaactttaacttacttacgtactaaacaaagtacttaacctaaacttaaacgtttacgttaccggttaggggttaacccggtttaccgggaaaccggtaaacggggtaacccgtaaaggggttaacggtaaaaccgtaaccggtaaaaccgggtaacgttcgggttacggtaccgtacggacctaacccgttagttaccgtttacggttacccttacttaacccg

SEQ ID NO: 28980 - DNA, 263 bp, Homo sapiens
  misc_feature: GYAE6OF02GD8VE.13.55.E11.1.454.CMB.1.raw
  modified_base (260)..(263): a, c, t, g, unknown or other
  misc_feature (260)..(263): n is a, c, g, or t
tcagtcacgtactacacgaccggtgctcgatttagcactcgcacgttgggtctgggacagacttcactctcaccatcagcagcctcgagcctgaagattttgcagcttattactgtcagcaatattatagtactcctccgaggctcactttcggcggagggaccaaggtggagatcaaacgaactgtggctgcaccatctgtcttcatccttcccgccatctgatagtacgtgactgagcgggctggcaaggcgcatagnnnn

SEQ ID NO: 28981 - DNA, 601 bp, Homo sapiens
  misc_feature: GYAE6OF02I1QRN.13.55.E11.1.454.CMB.1.raw
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctccctaagtaggactacttactactgggctggatccggcacgcccccgagggagggctggagtggagttggggatatctcttagtaggtggagtacgaactacaactccgtccctacgaagagtcgagtcatcatactccgtaagacaggtccaaggaaccgtaattcctaccctagaaagtgtagttctgtcgaccgtcgcacgacgacggcttcgtcttattattggtgcgagacggactaaagttgttggttacgagggtagttacgtaacgtacggtcggggaccgtaagggtaacccgttgggtaccctacccggttccgttcccgtcgaccgtccccttacccgacccggtacgggtacccccg

SEQ ID NO: 28982 - DNA, 781 bp, Homo sapiens
  misc_feature: GYAE6OF02HRN9O.13.55.E11.1.454.CMB.1.raw
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtcgtgggggaggtttggtacagccagggcggtccctgagactctcctgtataacttctggattcaacgttgggtgattatgtctagtgaactgggtccgccaggctccgaggggaacggggcgtagggaggttggggttaggttttcgaagtttagggagtactaaagtttctacgaagttgagtcggggaacaaacgaaggaaacgttaccgcccggtacgttacgtaacgggtaaaaacggctaaggtaactttaccgaaccctaactttaccgtaccgtaaaggtaacgtaacgttaggtaaacgtacccgaaaggaaacgtaccgtaacgtttcccggttacccgttttttacgacgtacgtaagggtaacgttaggtaacggtacggtacccgttaagggaaacggaacccgggtaaaggggaacccaaaccgtaaccggaccccttaacgtttacctttaaaccgtttaccgttacggttacggtaaccgtttaacgggtaaggtaacggtttaacgttccggttaacccggtaacggtttaccccgtaacccggtaacccgg

SEQ ID NO: 28983 - DNA, 257 bp, Homo sapiens; identical to SEQ ID NO: 28735
  misc_feature: GYAE6OF02GL4Z4.13.55.E11.1.454.CMB.1.raw
  modified_base (255)..(257): a, c, t, g, unknown or other
  misc_feature (255)..(257): n is a, c, g, or t

SEQ ID NO: 28984 - DNA, 256 bp, Homo sapiens; identical to SEQ ID NO: 28727
  misc_feature: GYAE6OF02GK0OT.13.55.E11.1.454.CMB.1.raw
  modified_base (255)..(256): a, c, t, g, unknown or other
  misc_feature (255)..(256): n is a, c, g, or t

SEQ ID NO: 28985 - DNA, 765 bp, Homo sapiens
  misc_feature: GYAE6OF02IRSOR.13.55.E11.1.454.CMB.1.raw
  modified_base (258)..(258): a, c, t, g, unknown or other
  misc_feature (258)..(258): n is a, c, g, or t
  modified_base (321)..(321): a, c, t, g, unknown or other
  misc_feature (321)..(321): n is a, c, g, or t
  modified_base (388)..(388): a, c, t, g, unknown or other
  misc_feature (388)..(388): n is a, c, g, or t
tcagtcacgtactacacgaccggtgctcgattagcactcgcacgttgggtttgggggtcgtcagagaggagccttagccctggactccaaggcctttccacttggtgatcagcactgagcacagaggactcaccatggaattggggctgagctgggtgctcctgttgctatttagaacggtggccagtgtgagatgcgactggtggaggtcgtgggggaggtcgttggtaccgaggccgggggggtcacgtgagctcnctgtacagcctcgagattactattttcaaggtattagttggaacttggtagtttcggggtccncctaggtccgtacggaggggtaaggggctggggaggtcggggtacggaccaaaggtagtaaaagggngggtaatcgggggaagtacaggtaactagtacgtttagtgggtaggtacggttcgtcggggttacggacgggggtacccggtacgtttacccgtaaccgttaaccgttttaccggaacggtaacgaacccgtaacggacccgtaacggtacgttaccggtacgtaaggttaacctaagttacccggtagtaaccgtaaaggtacggtacggaaccggtaccggttaggaacggtacggttacggtaacgtacgggtaacgtaaccggttacgtaaacttaacggtttaacggtttacgttacggtacggttaaccgtaaggtaccggtttaacggtcggtttaaccggtttacccggtaggtaccccgggttaacgg

SEQ ID NO: 28986 - DNA, 813 bp, Homo sapiens
  misc_feature: GYAE6OF02GZYI8.13.55.E11.1.454.CMB.1.raw
tcagtcacgtactacacgaccggtgctcgatttagcactcgcacgttgggtttggggagctctgggagaggagccccagccgtgagattcccaggagtttccacttggtgatcagcactgaacacagaggactcaccatggagttgggactgagctggattttcctttggctatttaaaggtgtccagtgtgaagtgcagctggtgagtcgtagggggtagtcttggtacaggcctggcacgggtccctggacgtactcgtcctgtcgcctaaggtcctacgtagggtactttccgaccgttttggaacttcggtaactttacgtcggtacccgtagttcggtacctacggtcggggtacccgtactaacggtccgttacccggaaggggtaacggtcccgttagggtacggttcgggtacctacggtaacggttacgttacggtacgggtaaacttcgggttacgggtaacgtaccgtaacgttaacggtaccgttaaggtcggtaccgggtaaccttcggtacgggtaacggtaacgggttccgttagttacccgtaaccgtacgtttaccggtaccgtaacggaccgtaaccgtaaacccggtaccgaaacgttaacccgttccgttaacgtacgttccgtacggtaaccttaaacgtccgtaacgtacgtaccgttagaacgggtaccgacggtttaaccggacggttaccgtaccgggtccgtttaaggttacttaacggttacggtacgttaaccgtaaacggttccgtaaccccgtttaacccggttaggtttaacggtttacggg

SEQ ID NO: 28987 - DNA, 638 bp, Homo sapiens
  misc_feature: GYAE6OF02HBXP9.13.55.E11.1.454.CMB.1.raw
  modified_base (201)..(201): a, c, t, g, unknown or other
  misc_feature (201)..(201): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccggganaggacggccacaattccctgtgagggaaacaaccttagaagtcagaatgtccactggtaccagcagaagtcaggccaggcccctggtggtggtcatctagtagggataacgtaacccggcctcgtgggactcccgtagaccgtatttcctcgtcggcctaccgaaccggtcggggaaacaccgggcccacccgtagacccataccaaacgacgacgaccccaagggacgggatggaggctagacttagttagttcgtacgaggtggtacgggacacggccgaaccgtacgggtgtaagtacggttacgggaccgggaccgaaccgaagtccgtacggacccggtccgtaggccgacgacccgaaggtcccgtaccgtccccgtcggtcccaccgttccgtcccgttaccccctaccctccttaccgttacgtaccgg

SEQ ID NO: 28988 - DNA, 617 bp, Homo sapiens
  misc_feature: GYAE6OF02GEQ3N.13.55.E11.1.454.CMB.1.raw
  modified_base (247)..(247): a, c, t, g, unknown or other
  misc_feature (247)..(247): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcattttacagcttctgtggcctcctatgagctgactcagccaccctcagtgtccgtgtccccaggacagacagccagcatcacctgctctaggaaataattggacagataaatntaccttctggtatcagcagaagtcaggccacgtccctgtcgctggctatctatcaagatgccaagcgcctgacggctcccgtagcgtacgtattcctacggtcgtcctacctaacgttcgtacgggtaactccgacgtaccactcgtacgaacctactccggaacggcccgggaacccacgggtcttacgtagggacttagggcggtactgtaacgttacgtacgttcggtaccggtacgggtacgggttacgggactacggtcgaacgtccgacttccgggccgttaccgttagttcggtacccggttaccggaacggttaccgggaaccgtaaccgggtacctaacccgggttaccacggtaaccccg

SEQ ID NO: 28989 - DNA, 671 bp, Homo sapiens
  misc_feature: GYAE6OF02GT713.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctcccctgccccgtcacccttggacagccggcctccatctcctgcaggtctagtcaaagcctcgtatacagtgatggaaagacctacttgaattggttcagcagaggccaggccagtctccaaggcgacctaatttataattcgttttacccggactcgtggggtcccagacagattcagcggcaggtgggtcaggcacgtgatttcactattagaaaactcaacgtaggggtggaggctggaaggagttggttaggggtaattttaagttacgtggtactaagttcgacgtaaagtccttaactaagtttccgtacgggttaccctttttaccgtaacccgttttccgggtaacccccgttacggggaaaccccgtaaaaggttaccgggtaaacgttaaaccccgtaaagtttacccgggtaaaaccgtttcgggtaacgggtacccgttacggtaaccccgtaaccgtaaccgttttcgttacggttttacccc

SEQ ID NO: 28990 - DNA, 1018 bp, Homo sapiens
  misc_feature: GYAE6OF02JMDVU.13.55.E11.1.454.CMB.1.raw
tcagtcacgtactacacgaccggtgctcgatttagcactcgcacgttgggtttgggggtagtgctttcttgagagtcatggatctcatgtgcaagaaaatgaagcacctgtggttcttcctcctgctggtggcggctcccagatggggcctgtcccagctgcagctgcaggagtcgggcccaggagtgggtgaagccgttcgggagacccgtgtccctctagtgtaatgtgtctggtggcctcctaaggtaggacttacttactacgtgggtctggacgtccggacaccgacccccgaggggtaacgggcgtgggtacggtacgggtaggttacgggggattagtaccgttacgttttaaggtacgggtagggggtaacgttaacggtaaaaccgttaacgtaaaaccggtttccccggttaacccccggttaacgaaaacccggggttaaaggttaccgggtaaaaccggggttttaccgtaaacgttaccttaaacggttttaaaaccggttcccccgggtttaaaaaggtaaccccggggttaaaccggggttaaccccgggttaaaaaccgggggtaaaaacccgtttaaacccggtttttaaaacccgttccccccggtttaaaagggttaaaaaacgggtttacgggtttaaaaccgggttttcccgtttaaaacggggttccgggtaaccccggggttacgtaacccggaaaaccggttaaccggaaaccggggtttccgttaaccgttttaccgttaacggtttttaaaccgtttgggttccgggtaaacgtacgggtaaacccggtaagttaaaacgttaagggtttaccgggtttcgggtaaacggggttaccgtttacccgggtaactttaccggggtcggggggtaccccggtaaaacgggggtaacccgtttaccgggggttaaccctccccggtaacggtttacccccgttacgggaaaccccggttccctaacccccggttacggaaaccccgggttcccccg

SEQ ID NO: 28991 - DNA, 716 bp, Homo sapiens
  misc_feature: GYAE6OF02G1VIX.13.55.E11.1.454.CMB.1.raw
  modified_base (303)..(303): a, c, t, g, unknown or other
  misc_feature (303)..(303): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtcgtggggggaggtttggtacagccagggcggtccctgagactctcctgtgcagcctcgtgggttccaccgtcacgtcaacacctacatgngctgggtcccgccgaggcctccggaggggaacggggctgggagtgccgttcttctttttattagtaggttgtggttaagtacatacctccgacagtccgtccggtggacggggtccctacttccgaaccctagttccctaccgacgaacggaacctaaacgtttacccaaaagtaaaccacgtaccttttacggttttacccttaacgttaaaacgttcggtaaacccaacgtcccgttaggaaacggacgggtacccgtaagtcggaacccgtaccgggtcccgttagttaacgtttaccgtaggttacgacggtagaccggtagggtcccgggggaccctaacgggtaaaccgtttaccgtaccggtcgttacggtcgggtaccggtccgggtagggacccgtaaccgggg

SEQ ID NO: 28992 - DNA, 666 bp, Homo sapiens
  misc_feature: GYAE6OF02G4OUA.13.55.E11.1.454.CMB.1.raw
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
  modified_base (353)..(353): a, c, t, g, unknown or other
  misc_feature (353)..(353): n is a, c, g, or t
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacacgccggcctccatcctcctgcaggtctagtcaaacgcctcgtatacagtgataggaaagacctacttagaattggttcagcagaggccaggcagtcncaggcgcctaattanaggtntctgacagggactccggggtccagacagattcagcggntaggtgggtacaggcacgtggtacttttcaacgtacgtagaaaatcgaacggtacggaacgggttgggacggtcgtaggaacgggtagttaggtttaggtttcgggactttaccgttaagtttacgtttcggtacgtacgttaggtaccgtaaaggtacccaaacgtaacccgtaaccggttaccggggtaacccgttaccggttacccgtttttacgggaacccggtaacgggggtaaccgtaacggtaccggtagggtaacgtacgttaacccgttaagtacccgggttaaacgttcgggtaggtacccgg

SEQ ID NO: 28993 - DNA, 840 bp, Homo sapiens
  misc_feature: GYAE6OF02J0QNA.13.55.E11.1.454.CMB.1.raw
tcagtcacgtactacacgaccggtgctcgattagcactcgcacgttgggtttgggagctctgggagaggagccccagccgtgagattcccaggagtttccacttggtgatcagcactgaacacagaccaccaaccatggagtttggcttacttgggttttcccttgttgtacttaagttttaaaaggtgtaccaatgtgagctgcagctggtgagtcgtgggggtagtttggacaggccgtagggtccgtccctagagtacctcgtccttaggttacttaaccgttcgttagggtactttaccgtaacggtttgggtacgttagttagtcggtaccttaagttacggtaaccggtttcgggtacccggaccgttttaaccggggacggttacccgggacggtaaagggggacttgggggtaagggttttcgggtaaggtttttaccgggaagtttacgggtaaaggttccctaaacgttcgtccggtaaatttggggaacccttaacgggggaacctaaaccgttaacgggaaccgttaccggtacccggtacggttaaaaccgtcgttaaaaagggccttaacgaaccgttactacccgtataacccgtagaaagtaggaattaccggaagttaaccgaacgtaacgtccgtaacgtttccgtaccttacgtgtaacgtacggaacgttcggtaaaccgtacgtaaccgtaacggaaccggaacccgttaacgggaacctaccgaacgttaccctattaccgtttagtacgttaccgtaggtacgttacggtagttcgtaacgtacgtacccgttaccggtacccgttacgtaacccgg

SEQ ID NO: 28994 - DNA, 904 bp, Homo sapiens
  misc_feature: GYAE6OF02GBRQI.13.55.E11.1.454.CMB.1.raw
tcagtcacgtactacacgaccggtgctcgatttagcactcgcacgttgggtttggggactcaggacacagcatggacatgagggtccccgctcagctcctgggctcctgctgctctggctcccaggtgccagatgtgccatccagatgacccagtctccatcctccctgtctgcatctgtagagacagagtcaccatcacttgccgggcaagtcgaggctattaagaagtgtagtttaggcttaggtactcgacgtacgaaacgaaaaccgaagggaaaccgacccccgttaaagtcctttacgttacggtaacttacgttaggttcgggtacgaccttaaccgtaaccgtttaaaaggttttaaaaacggggttcccggggttaaccctaacgtttaaccggtaaacggtttaccgaacgggtaccggtacgtaagggttacggttaacgttccggaacgggtacccgtaacggtaaccgtttaaccgtttaccgttaaaccgttttccctaacccgtaacccgttaacgtttacccgaacggttcccgaaaccgttaccccgttggaacccgttaacggtaaccgttaaggttaaacgtttacgttttaccgtaaacctttaaacgttttaactttaccgtttaaccggttaaccttaaacggtaaacggtttcaaacccgtttaaaactttaaacgttttttacccggtcccgggttttaacggggtttaaccccggggtttaaccggaaaccccgggtaaaacggggttaacccggttaaacgggggttaacttaaacccggtaaaccgggttaaaccggtaccgttaaggggtccgtaaccgttaccggaacccttaaccgtttacgtaccgtttccgttaccggttacctttaccccg

SEQ ID NO: 28995 - DNA, 672 bp, Homo sapiens
  misc_feature: GYAE6OF02IYJW7.13.55.E11.1.454.CMB.1.raw
  modified_base (182)..(182): a, c, t, g, unknown or other
  misc_feature (182)..(182): n is a, c, g, or t
tcagtcacgtactacacgaccggtgctcgatttagcactcgcacgttgggtttggggatgctttctgagagtcatggatctcatgtgacaagaaaatgaagcacctgtgttcttcctcctgctggtggcggctcccagagtgggcctgtcccagctgcagctgcaggaggtcggcccaaggngtggtagacgtccgttacggagtaccctcggttccctagagttagtatgtgtcgtggtcgcctacccgtaagtacgtactactactacgtgggtctgactcgcgaccgccccggagggaacgggctagggtagtacggtagttagggtactacgtcttactagtacggtagggtacgtaacgaacgtacaccgtcgtacccgtagacgtacgtacgactacgactagtatacgtcgtacacgaacggtaccaaggtactaacttaccgttacctaaggtaacgtagtacgttacgtagtacgtacgttacggacgtacgtaccgacggtttctacgttacgtagtttacttggtcgaacggacggtaagtaccgtaaagttgttacggttaacgaggtaacgttacggaaccttgggaaccggtccggtaacggtacccggttatcgtaacccgtcttacgtacacctacgtacccggacgagtaccccg

SEQ ID NO: 28996 - DNA, 680 bp, Homo sapiens
  misc_feature: GYAE6OF02G4UQB.13.55.E11.1.454.CMB.1.raw
  modified_base (201)..(201): a, c, t, g, unknown or other
  misc_feature (201)..(201): n is a, c, g, or t
  modified_base (218)..(218): a, c, t, g, unknown or other
  misc_feature (218)..(218): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccggganaggacgccacaattccngtgaggaaacacttagagtcagaatgcatggtaccagcagagtcacggcaggcccctgtggtggtcatcgtagtaggataagacccggccgtcgtcgggactcccgtagaccgtattacgtctcggactaccgaacgtaccggggaacaaccggccccaacccgtacgaacccgtaactacctaaacgaacgaccgttaccgaacgggacgggaagtaggacggtaccgtgtaaccttagttagttcgtaacgaggttggtacgggactacggaccgtaccggtacggtagtaacgttacggtaccgggaccgggacggaaccggacggtacgtcggaaccgtccggtaaggtacccgacggtacccgtaacgggccttaccggtcccccgtggttacccgtaccgttacccggttcccggttaccccgtccccgtacccgttcgtttacccggtaaccggg

SEQ ID NO: 28997 - DNA, 635 bp, Homo sapiens
  misc_feature: GYAE6OF02HLH99.13.55.E11.1.454.CMB.1.raw
  modified_base (263)..(263): a, c, t, g, unknown or other
  misc_feature (263)..(263): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccggcaagtcaggcattagaatgattagctaggtatcgagacaagaaaccgaggaacnccctaagctacttgatctagtggtagcatacctaaggtttaaaaggtcgggtaccatacgaagttcagcggacaggtgatcgtagacacgagtacttacgtacttctacacctatactagctacgcctagactacgtccgtagtaacgttacgttttagaccttaaactttattaccgttagtaaccttaacaacgtaactaccgtaacttaaacgtttacttaccggtacgggttaccgttaccgggaccgtaaacgggtaaccgtaaggggtaacggtaaacgtaacggtaaaaccggtacgtaacgggtacggtaccgtacggtaccgtaaccgtacgttacccttacggttaccttaccgttaacccg

SEQ ID NO: 28998 - DNA, 646 bp, Homo sapiens
  misc_feature: GYAE6OF02HZI0P.13.55.E11.1.454.CMB.1.raw
tcagtcacgtactacacgaccggtgctcgatttagcactcgcacgttgggtttgggggggtctcagagaggagccttagccctggactccaaggcctttccacttggtgatcagcactgagcacagaggactcaccatggaattggggctgagctgggtactccttgttgctattttagaaggtggccagtgtgagatgcgactggtggagtcgtgggggaggcttggtccaggccggggggtcacgtgagactcctctgtacagcctcgagattcatttttcaggaattatgatgagttggtccgctagtctccaggggaagggcgtggagtgggtgaccaacagtaaaggaggatgggagtcgagacatattagtagtggagtcgtgtggccggggccgtaagttccaaccctacgtttaccaaggtacgaacaaacgccgaagacgtacgtacgtaagttagttacttacgttagacctaaaagtcgaagggtaacgtacctaggagtagtccggtaagtcgaacgttaccgggacttacgaagttaacgtttacgtttaggtacggtacggtaacgttaacgtttaggtaaccgttaacggttttttacccggaacggttaccggggaccgtttaaaccggg

SEQ ID NO: 28999 - DNA, 642 bp, Homo sapiens
  misc_feature: GYAE6OF02G3KYM.13.55.E11.1.454.CMB.1.raw
  modified_base (220)..(220): a, c, t, g, unknown or other
  misc_feature (220)..(220): n is a, c, g, or t
  modified_base (340)..(340): a, c, t, g, unknown or other
  misc_feature (340)..(340): n is a, c, g, or t
tcagtcacgtactacacgaccggtgctcgatttagcactcgcacgttgggtttgggggggggtctcaggaggcagcgctctcgggacgtctccaccatggcctgggctctgctattcctcaccctcctcactcgaggcagtagggtcctgggcccagtctgccctgactcagcctgcctccgtgtctgggtctcctggacagtcgatcaccatcctcctncactgggaccagcagtcgtacggttcgtggtacaagactatgtctcgtacggtaccaacaacaccgagacaaccgacccaactcaataattgtatattactactaagtccgacctgagtntatactaacgtctctacacgtcgcctacacgtcgtacgacaccgtaccggcccttcctacgaacctactccgttacgtcggtcctaccgacggacgaacgggtacggacgacggtcgtacgtacgtttaacttacggtcgtcgtccgtcgtacggtacggtacgttaaccgtaccttacctttacgttcgttacgttaccgtacgtcgtacgaacgtaacgtcccgtacgtaccgtacggtaccgaaccggtccaaccggacccaacccgtacgtcctacgtacccttccgtccgtcccccg

SEQ ID NO: 29000 - DNA, 583 bp, Homo sapiens
  misc_feature: GYAE6OF02HCCNV.13.55.E11.1.454.CMB.1.raw
  modified_base (575)..(575): a, c, t, g, unknown or other
  misc_feature (575)..(575): n is a, c, g, or t
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagatggggcctgtcccagctgcagctgcaggagtccgggcccaggagtggtgaagccttcggagaccctgtccctcagttgtaatgtgtctggtggctccctaagtacggactacttactacgtggggcttggatccggcacgccccccgaggggaaggggctgggagtgggagttggggaaatcgaatcagtaggtggaagcaaccaactaccaacccgtcctacaacgagtcgagtcaccatactcagtacgacacgtccaaagaccagttcctacctgaactctgtagttctgtcgaccgccgcagtaccacgggcctgtacttacgtgtcgcgcgacgaggtggacgtcgtgggccaagggccgcggtacacccgtctccctcgacggccctacccgaaccgtacgggccctaacgtccggttcccttcccccgnggtccccg

SEQ ID NO: 29001 - DNA, 662 bp, Homo sapiens
  misc_feature: GYAE6OF02HCWFV.13.55.E11.1.454.CMB.1.raw
  modified_base (266)..(266): a, c, t, g, unknown or other
  misc_feature (266)..(266): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctggtaggagacagagtcaccatcacttcgccggcaagtcagggcatagaatgatttagctggtatcagacaagaaaccgaagggaacncccgtaagtctctagactctagtggtgactagtaccgtaaggtttaaaacggtcgggtaccctagtacgtacggttcgacgcggacgaggtacggtatcgtcgactactagtacttacgtacttcctactacctatcgacgacacgtcgtacgcacgacctagaagttacgttttacgaccttaaacgtttacttacgtacgttacctaagtaaacgttactaaccgtaactttaacgttacccgttaccgggttacggttacccgtttaccgggaaccggtaaacgggtaccgaaagggttacgtaaacggtaaccgaaaccgttaacggttcgggtaacgttcccggtaacgtacccgtaacccgtgttacccgttcgttccttaccgtacccg

SEQ ID NO: 29002 - DNA, 637 bp, Homo sapiens
  misc_feature: GYAE6OF02HKK80.13.55.E11.1.454.CMB.1.raw
  modified_base (289)..(289): a, c, t, g, unknown or other
  misc_feature (289)..(289): n is a, c, g, or t
  modified_base (314)..(314): a, c, t, g, unknown or other
  misc_feature (314)..(314): n is a, c, g, or t
  modified_base (374)..(374): a, c, t, g, unknown or other
  misc_feature (374)..(374): n is a, c, g, or t
  modified_base (493)..(493): a, c, t, g, unknown or other
  misc_feature (493)..(493): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtcgtgggggaggtttggtacagccagggcggtccctgagactctcctgtataacttctggattcaacgtttgggtanatttatgctatgaacgtgggtcccncaggcctccgaggggagggctgggaggtggggttaggtttcagttaggagtacaatttcncatgagtgggaacaacagaacgtaccgccgtacgtacgtaaggtaaaacggcaagtacttacacctatccacgaaagagatagacgtaccgaagaacgctacgttccgtccttttacgngactagtagtacggtaacgtacgacccgttaggaaacggtacccggaagggaacccaacggacgtaccctagttaccttaacgtttacgtcgtaggtacctaaggagtacgttacgtcgaccgtaccgttacccgtacgtaccg

SEQ ID NO: 29003 - DNA, 707 bp, Homo sapiens
  misc_feature: GYAE6OF02JHN6X.13.55.E11.1.454.CMB.1.raw
tcagtcacgtactacacgaccggtgctcgatttagcactcgcacgttgggtttggggggtctcagagaggagccttagccctggactccaaggcctttccacttggtgatcagcactgagcacagaggactcaccatggaattggggctgagctgggttttccttgttgctattttaaaggtgcccagtgtgaggtgcagctggtggagtctggaggaggtcttgatccagccgtcgggggtccctgagactctccgtgtgcagcctcgtcggttcaccgtcacgtccactacctacatgacgcgtcggtccgcgacgcgtaccgaaggggacgggcgtggagtcggtcgttcttactttttaagttagttacggttaggtaggttaacgtacctacgttacccgttccgacgtacgtaccgttccggtacgggaccggggtaccgtactttcccaaccgtactccctaccggaacgaacgaacctaacttaccgaaacgtaccgtaccgttctttacgttttaccgtaactaaacgtacgaactacgtccgtaagaggaccgtaccgtaataccggaaccgtcgggtaccgtttacgtaacgttaccgttggaccggtacgaaggtaaccgtaggggtacccggtaacccgtaacggttaaccggttaccgtacgtaccgttagggtaccgggtaccgttacgggg

SEQ ID NO: 29004 - DNA, 840 bp, Homo sapiens
  misc_feature: GYAE6OF02JXRR5.13.55.E11.1.454.CMB.1.raw
  modified_base (205)..(205): a, c, t, g, unknown or other
  misc_feature (205)..(205): n is a, c, g, or t
  modified_base (480)..(480): a, c, t, g, unknown or other
  misc_feature (480)..(480): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtcggcctcctatgagttgacctcagccactcgtcagtgtcaggtcggccccggganacggaccggccaactaacgttccctggtacggaacgggaaacctaaccgttaaggaacgtcaagtaacgtgtacctacggtacggtaacctaggaccgaaggtaacgtccgaacgggacccgaacgggtcccccgttaggtcgggttacggtccaacggttacgtaggtaacgggtaacttaaacgtaacccgggtccctacggtacgggtactcccgtacggtaaccgtatttccggtacgtcgtaccgtaccgaacggtaccggggtaaaccnccgggtacccctaccggttacgaaccgtaacgtaccgaaacgtacggaccgaaccggaacgggacgggtaacgtacgggacgtaccgtagtactttaacgttagttaccggacggtagggtacggtacggtaagaccgggttaccgaacggtaacccggttagtaaccggttacgggttaccgggaccggggtaccgggaaaccggtaccgtaccggttacgggtacccgttaccggtaaccgggtccgaccgggacccgtaccgggcccttaccggtccccggtacccgggttactcccggttacccggtttaccgacccccctttaaccggtaccccttaccgggtaccgttaccggg

SEQ ID NO: 29005 - DNA, 849 bp, Homo sapiens
  misc_feature: GYAE6OF02IZE2X.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctcctggggctgctaatgctcgtgggtcccaggatccaggtggggatggttgtgatgactcagtctccactctccctgcccgtcacccttggacagccggcctccatcctcctgccaggtctacgtcaaacgcctacgtatacagtgataggaaacgacccttattagtaatttggtttacagaccaggacggaccgacgggtccaagtccgtaccgaacgggccggtaccttaaattttaattaacgtttcggtttttaaccccgggaccttcggttcggggtaccccagactaggactttacgaggtccgggactacgggttcgggtacgaggtactaacttcggttaactttccaacgtttaagtttaacgtaaaacctaccggaaccggtaaacggggtacggggtaacgggtacggttagggaaaggggtagtttaggggtttagggtttaagttttaaacgtttaccgtttaggaccgttaagttaccgggtaacccgtaaaggttacccttaaccgttaacttttacccggttcggtttcccccgtttttaacggtttacccggttttaccccggttaaccccggggttaacgggggtaaaccttaaacggggttacggtaaaacctttaacccggtaaaacggtttccccgggtaaaagtttccgggttaccgggttaaccgtttaaccggtaacccgttaccgtaacggttttacccgttaccggttttacccg

SEQ ID NO: 29006 - DNA, 589 bp, Homo sapiens
  misc_feature: GYAE6OF02FO1QV.13.55.E11.1.454.CMB.1.raw
  modified_base (198)..(198): a, c, t, g, unknown or other
  misc_feature (198)..(198): n is a, c, g, or t
  modified_base (212)..(212): a, c, t, g, unknown or other
  misc_feature (212)..(212): n is a, c, g, or t
  modified_base (404)..(404): a, c, t, g, unknown or other
  misc_feature (404)..(404): n is a, c, g, or t
  modified_base (423)..(423): a, c, t, g, unknown or other
  misc_feature (423)..(423): n is a, c, g, or t
  modified_base (434)..(434): a, c, t, g, unknown or other
  misc_feature (434)..(434): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtgcctcctatgagttgactcagccactctcagtgtcagtggccccggangacgccacattccngtgaggaacacttagaagtcagaatgtccactggtaccagacagaagtcacggccagcccccgtgtggtggtcatctaagtagggataagtaacccggccctacgtgggactcccgtgaccgtattctcgtgcctaccacgtacgggaacacggcccacctcgaccatacaacagaccaccgaaggacggangaggctagatattatgtcnggtgtacgganacgcaaccacggtgagttacgtcgggcgggacggaaccgaacggtcgtacgcccgtacgtacgtccgacgaccacggtcctaccgcccccgttacgtcccgtaccgttccgttacccgttccccctaccccgttcccttccgtacggttacccgg

SEQ ID NO: 29007 - DNA, 787 bp, Homo sapiens
  misc_feature: GYAE6OF02F6HKC.13.55.E11.1.454.CMB.1.raw
tcagtcacgtactacacgaccggtgctcgatttagcactcgcacgttgggtttggggatgctttctgagagtcatggatctcatgtgcaagaaaatgaagcacctgtggttcttcctcctgctggtggcgctcccagagtgggcctgtcccagctgcagctgcaggagtcgggcccaggagtggtgaacgtccgttacgggacgtaccccgtcggttccccctagtaggtttagttaagtcggttgttcgtggggtcggtaccttacccgttaaggtacggtacttaccgttacgttacgtggggctggtacgtccggacctaccggcccccggaaggggacggggtcgtagggtagggttcggtaggtttaggggacttacgttaccgttacgtttaaggtagggttacggggtaacgttaaccggtaaaccgttaacgtaaccgttccccggttaccctacgtaaacggtaccggtacgaaccggttactactacgtaacgttaaccgtaccggtaacgaaccggtacggtaacccggtaaggtaaacccgttaagttcccgttaacccgtaaggtaaacgttcggtaacgtttcgtacggtacgtaccgttacgacgacgtaccgtcggtacttcgtacttagttgttcggtcgtacgacggtacgtaactaagttacgtggttcgtaaggtcgttacgacgtacggcggtaccggtacggtaccgtcggtaccctaccgttccgacgtccgtacgtcccgtacccgtaacggacccgtacccg

SEQ ID NO: 29008 - DNA, 566 bp, Homo sapiens
  misc_feature: GYAE6OF02ITDDY.13.55.E11.1.454.CMB.1.raw
  modified_base (407)..(407): a, c, t, g, unknown or other
  misc_feature (407)..(407): n is a, c, g, or t
  modified_base (452)..(452): a, c, t, g, unknown or other
  misc_feature (452)..(452): n is a, c, g, or t
tcagtcacgtactacacgaccggtgctcgatttagcactcgcacgttgggtttggggagcctgggcctcaggaagcagcatcgggggtgccgcagccatggcctggaccgctctccctgctgagcctccttgctcactttacagcttctgtggccctcctatgagttgactcagccactctcagtgtcagtggccccgggacacgacggccacaacttccctgtgagggaaacaaccttagaagtcagaatgtccactggtaccagcagaagtcaggccacggcccctgtcgctggtcatctatcaagataccaagcgccctcaggctccctgagcgattctcgtggcctccactcgtggaacacgacgcccactcctgaccatccgacgcgggacccaggcctggnggtatggacggcttagacttacttacgtgtcgaggcggtgggacngcagccacgtcgcccttacgtccggaacgtcgggaaccctagggtccctacccggttacgtaactaccgaccggacccgaacggtccccaaaccccctagtcggtacctacccg

SEQ ID NO: 29009 - DNA, 626 bp, Homo sapiens
  misc_feature: GYAE6OF02GB937.13.55.E11.1.454.CMB.1.raw
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagatgggcctgtcccagctgcagctgcaggagtcgggcccaggagtggtgaacgtccgttcgggacgaccctggtcccctcaggtttgtaactgtgtctggtcgcttacccgtaaggtacggtactacttactacgtgggctggatccggcacgcccccgagggaggcgtggagtcggagttggggatagtctcttagtaggtggagtacgaacgtacacgtcccgtcctagaagcgtcgagtcatcatacgtacgacgacgacggtaccaaggtaactaacttcctccgtaagtaagtagtacgtttctagtcgtaccgtcgacgagaccgcggtcttacgtacttagttgttcggtgacgagacggtaacttaaagtacgttggtacgaagggttacgttacgacgttacggcgggaccgtaacgggtacccgtggtaccctaccgttccgtccgtacgtccgaccctccgtaaccgacggtaccccg

SEQ ID NO: 29010 - DNA, 669 bp, Homo sapiens
  misc_feature: GYAE6OF02FJYT2.13.55.E11.1.454.CMB.1.raw
  modified_base (311)..(311): a, c, t, g, unknown or other
  misc_feature (311)..(311): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgctattttaaaaggtgtccaatgtgagctgcagctgggtggagtcgtgggggaggtttggtacagccaggggccggtcctgagactctcctgtataacttctggtattcaacttgggtgattatgctatgaactgggtccncagggctccgaggggagggctgggagtgggtagtttcattaggagcaattctcatgtatgggaacaacgagaaatacggccgacgtccgtaggtaaaaagggcaagtactttaccgacctatcctacaagtacgtaagtgaacgttccaaggaacgtcaacgttccgttacctttccgtagcctaggtacttaggacgtttacgaccgttaggaaaccggtaccggaacggaccgtaaaccgaccggacctaacgttacccgtaacgtttaacgtacggttacggtaccgttaaacggacggttaaacgtttacggttacgtaaccggtaccggtttacccgtaacccggttaacccg

SEQ ID NO: 29011 - DNA, 707 bp, Homo sapiens
  misc_feature: GYAE6OF02FXLGF.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagtccggcctccatcctcctgcaggtctagtacaaagtcctgtatacagtgagtaggaaagtacctacttagaagttggtttacagcgagacggccgaggcagtcctaccgaaggtccgtaccttaaactttagtaacgtttcggttttaacccgggacttccggtcggggtacccagtacgacgtattcacggccggacgtaggtcggtgacgactacgtgtactttcacgtagtaacgaaacttacgaccggtagggtcggacgtgtacggacggtagttacgggttagggttattttaacgttacgtcggacttacgttgaaccgttaagtaccctaacgttgtttaacccgttcggtttaaccccttttacgtaccccgtttccgggacccgttaacggggtaaaccctaagggttcggtaaaccgtaaccggtaaaccgttacggtaacgttacggtaccggtcttaccgggacccttaaccgtacgttccgttacggtttaccc

SEQ ID NO: 29012 - DNA, 542 bp, Homo sapiens
  misc_feature: GYAE6OF02GER6C.13.55.E11.1.454.CMB.1.raw
  modified_base (459)..(459): a, c, t, g, unknown or other
  misc_feature (459)..(459): n is a, c, g, or t
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggagttgggggatatctcttagtaggtgggagtacgaactacaatccgtcctcaagacgtcgagtcatcatatccgtagacaggtccaggaacgaattctaccctagaaagtgagttctgtcgaccgtcgcagacgacggctgtctattatgtgcgagcgganaagtatggtcaggtattcgactcgtgggccgacgggaacctggtacaccgtctccgtcgacgtcctccaccgacggtaccccg

SEQ ID NO: 29013 - DNA, 690 bp, Homo sapiens
  misc_feature: GYAE6OF02FM7ET.13.55.E11.1.454.CMB.1.raw
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
tcagtcacgtactacacgaccggtgctcgatttagcactcgcacgttgggtttggggtgctctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctggtggggtaggttttggtacgaggccgaggggcggttcccgtgaggacttctccctgtataacttcgtggtattcaacgttgggtntattatgctatgacgtgggtcncaggctccgagggagggctgggagtgggtagtttcgagtttaggagtcgtaacttcgtactagtggagtacgggtaaacaaacgtaggaaacgtaccgccggacgttacgtaaggtaaaaggctaagtcttaccaactctacgaacgtaacgagtactacggtaagtcccgaagtaagtccgtaacgttcccgttccctttccgcgtacgtacgtatacggtaagtccgaaccttacggggaaacgaacccggtaacgggaaccaccggtaacgtacccaacgtttacctaaggttaaccctttcgggtactaacggttaaggtagtaacgttttaagttccggacttaccggttaccctaacccgg

SEQ ID NO: 29014 - DNA, 747 bp, Homo sapiens
  misc_feature: GYAE6OF02JV87P.13.55.E11.1.454.CMB.1.raw
  modified_base (328)..(328): a, c, t, g, unknown or other
  misc_feature (328)..(328): n is a, c, g, or t
  modified_base (622)..(622): a, c, t, g, unknown or other
  misc_feature (622)..(622): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgcttatttaaaaggtgtccaatgtgagctgcagctggtggagtctgggggtaggtttggtacaggccgaaggggccgttcccgtagagaccgttcctccgtcggttaataaccgtttcgtcgggtattactaaaccgtttggggtataagttttacgngtaccttattaggtaaccgttcggggtacccggtcccaaggggtcccttacccggaagggggtaacggggtccgttggggtaacgggttacggggttaacggtttctaaggtttaagggacgtacttaaagttccgtatagttacgaagttcgggaaaactaacgaacgtaacgtacggccgtaccggttacgtaaacggtaaagggtccagtacttacaccgttactcgtaacgaacggtgaatggacgtcaacgtaagctacttacccggtctttaacgcgtacggacgtanacggtacgacgtccgttaaggaaaccgtaaccgacggtaccaacgtacgccttactacgttaactacgtggtaccgcgttaaggacgtaggtttacttacggaccttaacgggtcctaacggtcg

SEQ ID NO: 29015 - DNA, 536 bp, Homo sapiens
  misc_feature: GYAE6OF02GYPOY.13.55.E11.1.454.CMB.1.raw
  modified_base (352)..(352): a, c, t, g, unknown or other
  misc_feature (352)..(352): n is a, c, g, or t
  modified_base (376)..(376): a, c, t, g, unknown or other
  misc_feature (376)..(376): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
  modified_base (513)..(513): a, c, t, g, unknown or other
  misc_feature (513)..(513): n is a, c, g, or t
  modified_base (525)..(525): a, c, t, g, unknown or other
  misc_feature (525)..(525): n is a, c, g, or t
tcagtcacgtactacacgaccggtgctcgatttagcactcgcacgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcacgcccccagggaaggggctgggagtggattgggggatagtctcttagtagtgggagtacgaactacaatccgtaccctnaagagtcgagtcatcatatcgtanacgagtccaaggaacgtaattcctcccgtagaaagtgagttctgtgaccgtcgcagacacgctgctattatgtgcgagcgctaaatntggttnaggtattcgatacgtgggaccagggacctggtccaccgtctccncgcgccctaccnccgaggtcccg

SEQ ID NO: 29016 - DNA, 649 bp, Homo sapiens
  misc_feature: GYAE6OF02IF28K.13.55.E11.1.454.CMB.1.raw
  modified_base (408)..(408): a, c, t, g, unknown or other
  misc_feature (408)..(408): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgcttaattttaaaaggtgtccaatgtgagctgcagctgggtgagtcgtgggggaggtttggtacaggccgaggggccggtccccgtgacgactcctccgtagttaactaacttctggactttctaacgttgggtgtattatgctatggaacgtgggtcccaccaggcctaccggagggggtaacggggtcgtgggaggttgggtaggtttcagttagggatctaaatttcacagtagngtagggaactaaacgagaaactccgaccgacgtactaaggtaaacggcaaagtacttcgaacctagtacctacgaaagacgtagtagacgtaccaaggaatacctacgtccgtcccttttcgacggtaccaaggtacgttagaacgtcaccgttaggaacgtaccggaagaccaagctaccattcttaagtcgtacgcgactagaagttctaagttcgacgttaactcccgtaacggtacc

SEQ ID NO: 29017 - DNA, 798 bp, Homo sapiens
  misc_feature: GYAE6OF02HO1K3.13.55.E11.1.454.CMB.1.raw
  modified_base (256)..(256): a, c, t, g, unknown or other
  misc_feature (256)..(256): n is a, c, g, or t
tcagtcacgtactacacgaccggtgctcgatttagcactcgcacgttgggtttggggtgatcaggactcctcagttcaccttctcacaatgaggctccctgctcagctcctggggctgctaatgctcgtgggtcccaggactccgaggtggggatgttgtgatgactcagtcctccactcctccctcgcccgtctacccgttggacacggcccggcctccatcctcctgctaggtctacgtacaaacgcctcgtanacgtagtgagtaggaaacgtaccttacttaggtaatttcggtttacacgacgacggacggccgacggacccaggttccgtaccgaacgggtccgttaaccgtttaaattttaacgttaaacgttttccgggtttttaaccccgggacgttccggttaccggggtaccctaaggaaccgtacggttacttaccgacggtcgggacgtacgggttagggtacgaggtacgtaacgttagttactttacctaagtaagtttaacgaaactaccgaaccgggtaggggtacggacgggtcgtagggtacggttagtttagggtttagggttaacttttaacgttacgtggttacagtacggtacttagtacccttaagttactttacgttaccggtttcttttacccgtaaccgggttttcccggaacccgggttagggaacccttaagggttaccgtaaccgtaaccgttaacggtaccggttaacgttcgggttaccggtacgtaccggtacccttaacggtaccgtttacgtccgtttacccg

SEQ ID NO: 29018 - DNA, 770 bp, Homo sapiens
  misc_feature: GYAE6OF02HICGL.13.55.E11.1.454.CMB.1.raw
  modified_base (202)..(202): a, c, t, g, unknown or other
  misc_feature (202)..(202): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggcccccggganaggaccggccaacaactttccctgtgagggaaacaaccttagaagtcagaatgtccatcggtaccagcagaacgtcacggccaggcccctaggtggtcggtctatctaagtacgggaataacgtaacccggcccttcgtacgggactccccgtgacccgtattccgtcgtcggtcctacccgaacggttccgggggaaacctacccgggaccctaaccccgtacgacccgtaactaccgaaacgacggaaccgacccgtaaagggaccggggatacgggacgggtactacggtaacctttaaagttacgtttacggtacggtagggttagggttaacgggacgacggaccgaaaccgtacgggtacgtaacgttcgggttaccgggacggggtaccgggaaccctaacgggttcctacgggtacccggttaccgttaacgggtcccaaccgggtcccgtaacggggtccctacccggtaccccccggttacgggtaccccttaacccgttcccgttacccggtacccccttaccccgtttaccttacccggttaaccggttacccggg

SEQ ID NO: 29019 - DNA, 679 bp, Homo sapiens
  misc_feature: GYAE6OF02FRVIR.13.55.E11.1.454.CMB.1.raw
  modified_base (212)..(212): a, c, t, g, unknown or other
  misc_feature (212)..(212): n is a, c, g, or t
tcagtcacgtactacacgaccggtgctcgatttagcactcgcacgttgggttttgggggatgctttctgagagtcatggatctcatgtgcaagaaaatgaagcacctgtggttcttcctcctgctggtggcgctcccagatggggcctgtcccagctgcagctgcaggagtcgggcccaggagtggtgaagccttcggagaccctgtccctnagttgtaatgtgtctggtggctaccctagtacggactacttactactggggctggatccggcacgccccgagggagggctggagtggagttggggatatctcttagtagtgggagtacgaactacaacgttccgtcccgtacgaaggtacgtacgtagtacatactattacgtaccgtagacgtacggtaccaaggaaaccgtaacttccttacccgttagtaaacggttcggtagtttccttaggtacgtaccggttcgacgtaacgactaccggtcttcgttacttaagtttacttggtcggacgaaggtaccggactaaaacgttgtttcgggttaagaggggtatttacggtacgttacggtacggggaccggtaaccgggtaacccgttcgggtacccttaccggttccgttacccgtacgtaccggttccccctacccgtaaccggtaccgggtacccccg

SEQ ID NO: 29020 - DNA, 732 bp, Homo sapiens
  misc_feature: GYAE6OF02ISUFJ.13.55.E11.1.454.CMB.1.raw
tcagtcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggattgttgtgatgactcagtcctccactcctcctgcccgtcacccttgacacgaccggcctcatctcctgcaggtctagtaccaaacgcctacgtaatacagtgagtaggaaacgtacccttacttagtaacgtttggtttcaaggacaggacggccacggcctagtacctaccgaaggtccgtaccttaatttactaagtttaccggttttacccgggacttcggtaccgggtacccaagtacgtagtacttcgacggtccggaccgtagggtccgggcacgggctaacgttcgttacttaccacgttaattacgaaaacgttcccgtaaccgggtaaggggtaggggtacggacgtagggtaaggttaggttgggttaggttaagttttactcgttcgagtagtagaaccgaagttcctaacgttaccgtttcgttaccggtttccctttacctttaccgggtttcccgacccggttacgggtaaccgtaaggtccggttaacctaacggttaaccgtacgtaacggttacggtacgttaccgtacggtaccctaacccgttagttacccgtgttttacccg

SEQ ID NO: 29021 - DNA, 874 bp, Homo sapiens
  misc_feature: GYAE6OF02F6ICK.13.55.E11.1.454.CMB.1.raw
  modified_base (201)..(201): a, c, t, g, unknown or other
  misc_feature (201)..(201): n is a, c, g, or t
tcagtcacgtactacacgaccggtgctcgatttagcactcgcacgttgggtttggggtgatcaggactcctcagttcaccttctcacaatgaggctccctgctcagctcctggggctgctaatgctcgtgggtcccaggatccaggtggggattgttgtgatgactcagtctccactctccctgcccgtcacccttggacngccgctccatctccgtgcacggtctagtacaacgtcctacgtatacagtgagtaggaaactacccttatttagtaatttcggttaacttacgaacgcggtaacgggcggaccggacggtaccggttaccgttaccgaaccggaaccgggtacccttaaacgtttttaaactttaaacggttttaccggtttttaaaccccggggttttaacccgtccggttaccggggtttaccccgggaacccgtaaggaaccgttaacgttaacggttaaccgggacggtaaccgggttacggtacgggttaccgggtacgacgggtaccttacgttacgtttaactaacctacgttaaagtaaacgtaaacctaccggtaaaggggtacggtagggtacctaggggtaaacggttagggttagggttttacgggtttaatttaacgttttacgtttaaggccgttaagtacggtcgtaaacgtacggttaacttaaccgttcgttttccgggtttacccgttttacgtttaacccgtttaccccgggtttacccggaccgggtaaaacggtttaaccgggtaaggtaacccgtttaaaccgtaaccgtaaaccggttaaccggttacgttagggtaccggtcctaacccggttaaactcccgttacgtttcgttaacccg

SEQ ID NO: 29022 - DNA, 655 bp, Homo sapiens
  misc_feature: GYAE6OF02GVWXB.13.55.E11.1.454.CMB.1.raw
tcagtcacgtactacacgaccggtgctcgatttagcactcgcacgttgggtttggggggtctcagagaggagccttagccctggactccaaggcctttccacttggtgatcagcactgagcacagaggactcaccatggaattggggctgagctgggtgctcttgtgctatttagaggtgccagtgtgagatgcgactggtggagtcgtgggggagcttggtccgaggcccgggggggtcacgtgagactctcctgtacagcctcgagattcattttcaggtaattattggatgtaggttgggtccgccagtcctccgagggaacggggctggagtgggtggaccaaagaagtaaaggaggacgtaggggagtacgaagtacatacgttatggtaggagtgtgtcggcggggtacgacttccgacctacgtttaccgagtaacgacgaacgaccgacgtactacgtaccgagttaacttacgtacgtacgtacgaaacgttagggaaacgggtacgtccgtagggaacggtaacggtacggtagttaggaaccgtaacggtctaaacgttagttaacgtttacggtttaggtacggacgttaaggtaacgtttacggttaaccttaggttttacccgagggttaccggtaaccgg

SEQ ID NO: 29023 - DNA, 612 bp, Homo sapiens
  misc_feature: GYAE6OF02HHZ70.13.55.E11.1.454.CMB.1.raw
  modified_base (348)..(348): a, c, t, g, unknown or other
  misc_feature (348)..(348): n is a, c, g, or t
tcagtcacgtactacacgaccggtgctcgatttagcactcgcacgttgggtttgggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatcctcctgccacgtcgggaccagcagtcgacgttcgtggtacaagactatgtcctcgtaggtaccaacaacacccaggcaacggcccccaaacgtcataatttatgtatttcactaatccgcctcagtgtatctaanctcttcactcgctcaagtctgacaacgcgcctccgtgacctatctcgtcgcctaccaggacaggagacggacggtctagtacttaagttacgcggtaccggtcgtacgtcggtaactagttacgccttacctttagtcgttaccgttggtactggtccgtaaccgtaacggtcctaaccggttccgtaacggtccgaaccgtaccccgaaccggacccaaaccccgttcgtacgtaccctccgttaccgttcccgttacccccg

SEQ ID NO: 29024 - DNA, 799 bp, Homo sapiens
  misc_feature: GYAE6OF02F5ZLC.13.55.E11.1.454.CMB.1.raw
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgctatctgtaggagacagagtccaccatcacgttcggccgggacaaaggtccgaggggacctaagttaagaaattggtaacgtttaggtcgttggtaactcgaacgtaccgaaacggtaaaaccgaaggggaaaaccgtacccccgttaaaggccgtttaccgttagtacgttaccgttaggtacgggttacgacctaacgttaccgttaaaaagggttttaaaaacgggtccggggttacccctaattaccggtaacgggtttacgacgggaccggtacgtagggttacggacgttcgtacggacctaaacgtaacggttaccctttacgtactttacccgtacctaacctacgtacaacgttacctaaccgttcccgtagccctaaacggtcccgttaaaggtaaacgttttacgtttacggtaacccttttaaattttaacgtttacgttaacgttacgtaaacgtaacgtaacttaaccgtaaactttaacgttcgtacccgggttaacggtaaccgttccgggaaacgtaaacggaccgtaaggacgtaactaccgtaaacggtacgtggtaaccggtctacgtaacctcccgttagttacctcgtttacgacctacccgg

SEQ ID NO: 29025 - DNA, 701 bp, Homo sapiens
  misc_feature: GYAE6OF02JLK46.13.55.E11.1.454.CMB.1.raw
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (307)..(307): a, c, t, g, unknown or other
  misc_feature (307)..(307): n is a, c, g, or t
tcagtcacgtactacacgaccggtgctcgatttagcactcgcacgttgggtttgggggggggtctcaggaggcagcgctctcgggacgtctccaccatggcctgggctctgctattcctcaccctcctcactcagggcatagggtcctgggcccagtctgccctagactcagcctgcctccgtgtctgggtcctccgtgacagtcgatcaccatcctctncactggaccagcagtgacgttcgnggacaagacttagtgtctcctggtaccaacaacaccagcaacggaccctaactacataattanagtattcgaacttacaccggtccctgtacggtgttatacgttaactcgtacttccgactggacctacgacgtactggacaaccgacggtccctacccgcgtaaccctactacctccgtacgggtccctaccgtacgggccgtaacggacggaccggaggtacctacgtaacttagttaaccgtcggtacccggtccttaccgttacggaacgttaaccgttacgtaaccttaccccgttttaggtacctttccggttacggtaccgttacggtacgtaacccgtaggttacccgtacccggtacgtaccggtaacgtaccggtacccgaaccggtaccccgttaaacccctacgggtacctacccggtaccgttcccgttacccggtccccccg

SEQ ID NO: 29026 - DNA, 635 bp, Homo sapiens
  misc_feature: GYAE6OF02FWFVL.13.55.E11.1.454.CMB.1.raw
tcagtcacgtactacacgaccggtgctcgatttagcactcgcacgttgggtttggggggtctcagagaggagccttagccctggactccaaggcctttccacttggtgatcagcactgagcacagaggactcaccatggaattggggctgagctgggtgctccttgttgctattttagaaggtggccagtgtgagatgcgactggtggagtctgggggaggcttggtccagccgggggggtcacgtgagactcctcctgtacacgcctcgagtattctattttcgaggtaattagttggatgtaggttcgggtccgccagtcctccgaggggacgggtcgtgggtaggtggggtcggaccgaaacgagtaaagggaggtagtgggagtcgaagacgtagtaattagtggtaggagttcgtaggtcgggccggggcctattacccgaaccttatttcccgaagtacgaacaaccgccaagacgtccgtacagttatacttcgtcgaactaaagtggaaggactccgtaaggacgtaggtacgtagtagaacgtacgtcctaactagtttaacgttagttcggtagtacggtagtaacgtttccggtaagtttacggtttccgacggtacggtaccg

SEQ ID NO: 29027 - DNA, 695 bp, Homo sapiens
  misc_feature: GYAE6OF02JTIXC.13.55.E11.1.454.CMB.1.raw
  modified_base (335)..(335): a, c, t, g, unknown or other
  misc_feature (335)..(335): n is a, c, g, or t
  modified_base (405)..(405): a, c, t, g, unknown or other
  misc_feature (405)..(405): n is a, c, g, or t
  modified_base (518)..(518): a, c, t, g, unknown or other
  misc_feature (518)..(518): n is a, c, g, or t
  modified_base (555)..(555): a, c, t, g, unknown or other
  misc_feature (555)..(555): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttggcttacttgggttttccttgttagcttattttaaaggtgtaccaatgtgagctgcagctggtggagtcgtgggggtagttttcggatagccgaggggccggttcccgtgagtacctctcctggtactaacgttcaggtactttcgaacgtttgggagtaattgtcgtctagtgaaccgttgggtaccncgtacggcctaccggaggggaacgggcgtgggagttcggggttagtttacagttaggacgctaatttccngattaggagttcgggaactaacgaagtaacgaccggccggtacgtacgttaaggtaaaacgggcaaggtacctttccgacctaagtccctaagacgaacgtagtacgacgtanaacgaacgtcctaagtttccctaccgttttcgaccgntaaccggagtaggtaacgacgtacgttaaggacccgtagtaaggacccttaagaccgtacaccgtattaccgtaagttcggaaactcttaaggaacgttaggttactacgggtacctagtttaccccggactttaccggg

SEQ ID NO: 29028 - DNA, 683 bp, Homo sapiens
  misc_feature: GYAE6OF02H3MFM.13.55.E11.1.454.CMB.1.raw
  modified_base (228)..(228): a, c, t, g, unknown or other
  misc_feature (228)..(228): n is a, c, g, or t
  modified_base (260)..(260): a, c, t, g, unknown or other
  misc_feature (260)..(260): n is a, c, g, or t
tcagtcacgtactacacgaccggtgctcgatttagcactcgcacgttgggtttggggactcaggacacagcatggacatgagggtccccgctcagctcctggggctcctgctgctctggcctcccaggtgccaggatggtagccatccagatcgacccagtcctccattccctcccttgtctgcatcgtgtaggagacagataccaccatcgacgttcggccgggtanaagtcgagggactagttagaatggtattaggngttggtatacgagacgaaacggaaaccggaagggtaacccgtacccgtaagtccgttacgttagaacgttcgttaggtcggtacaccgttaacgtaaccgttaaaggttttaaacgggtccgggtaccctaagttaccgaggttacgacgtcggagtaggtacgtatcgcgactaacgacgtaactttctaactttccaactaccgtataccgacgaccgcgtaccgtacgactacggtaccgtaacgttaagtttacgtttagaacctttaacttttacgttacgtactaactagaactagttaacctaacgttacttacgtaccggtacggttaccgtacgaaccggtaaggtaacgtaaggtacgaacgtaagtcggtaacgtggtacacgtcactacttctacggtacttcacttaccg

SEQ ID NO: 29029 - DNA, 716 bp, Homo sapiens
  misc_feature: GYAE6OF02ITIGB.13.55.E11.1.454.CMB.1.raw
  modified_base (165)..(165): a, c, t, g, unknown or other
  misc_feature (165)..(165): n is a, c, g, or t
  modified_base (202)..(202): a, c, t, g, unknown or other
  misc_feature (202)..(202): n is a, c, g, or t
  modified_base (695)..(695): a, c, t, g, unknown or other
  misc_feature (695)..(695): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtgcctcctatgagttnactcagccactctcagtgtcaggtcggccccgggaanagacggccacaatccctgtagaggaaacaacttagaacgtcagaatcgtccactacggtaccaagccgaagaacgtcgaacggccgaacgggccccccgttaggttcgggtcgggttacctaataccgttaaggttaaggggtaattaaaacgtaaccccgggtaccccgtacgttacggggactccccgtacggtacccggtactttcctcgtacggtccttacccgaaacggttaccgggggaaaccaacccggacccgtaaccccgttacgaacccaactaaccgaaacaacggtaccgacccgaaacgggaccggggtaatacggaggccgtaagtacgttaattagttgtacgaggttaggtacggaacacgacgaaccgacggtgtaagtacggtacggcggaccgggtacgacgtcgtacgaccgtccgtagtcgacgccgaacgcgtacccgccccgtacggtccctacgtccgttccgttcccnccctaccgttcacggttaccg

SEQ ID NO: 29030 - DNA, 725 bp, Homo sapiens
  misc_feature: GYAE6OF02FU9HB.13.55.E11.1.454.CMB.1.raw
  modified_base (203)..(203): a, c, t, g, unknown or other
  misc_feature (203)..(203): n is a, c, g, or t
  modified_base (275)..(275): a, c, t, g, unknown or other
  misc_feature (275)..(275): n is a, c, g, or t
  modified_base (696)..(696): a, c, t, g, unknown or other
  misc_feature (696)..(696): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgcctcactttacagcttctgtggcctcctatgagttgactcagccactctcagtgtcaggtcggccccggganaggaccggccacaacttccctgtaggaacggaaactaaccgttagaagtcaagaacttcgccacgtgtaccngcagaagtcagccgagcccctaggtcggtggtcatcgtagtagggtaactaacgtaaccggcctcgtcgggactcctcgaccgtacttccgtcgtcggtcctaccgacgtaccggggaaccaccggaccccgtaacccgtcgaccctaactaccgaacgacggtaccgacccgaagggaccggggtatcgggaacggcgttacggaactttagttacgttacggtacgtagggttacgggtacggaacgtaccggacgaccgtacgggttagaacggttacggtccggggaccgggtaccggaaccggtaacggtccgtaccggtaaccggttccgtacggtaccgtaccgacccggaacggtcccggtacccggtcccccgttaaccggtccgttaaccgtcccgttccggtttcccccnccgtttcccgttaccggtacccgtaccgg

SEQ ID NO: 29031 - DNA, 885 bp, Homo sapiens
  misc_feature: GYAE6OF02FYB6Y.13.55.E11.1.454.CMB.1.raw
  modified_base (201)..(201): a, c, t, g, unknown or other
  misc_feature (201)..(201): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccggganaggaccggccaactaacttccctggtaggaacgggaaaacctaaccgttagaagttccaaggtaaacttggtacccacgttcggtacccaggaccaaggaacgtccaacggcccaacgggccccctggtcgggtcggtccattccgtaagtaggggtataaacgtaacccggcccttacgtggggaccttcccgtacgaccggtatttccgtcgtcgggtcccttaaccgaaccggttaccggggggaaacctacccggggaccccctaaccccggttacggaaacccctaacgttaacccgaaaacccgttaacggaaacccgggaaccccccggaaaagggggtaccccgggggtaaagtttccggggaacgggtaccgtacggtaaaccgttacgttttaacgttaccggtacggtaaacggggtttcgggttacggggaaccgtacggtaccccgtaaccggtaacggggttacgtaacggtttaaccgggtttccgggggaccggggtaccggggtaaccgtaccgggttaccgttaaccgggaccccggttacccgtttaacgggacccgtaccggaaccccgtacgggtcccgtaccccgtacccccggttcggtacccgttacccgtccgtttacccggttccccctacccgtcccgtttaccgtagttacccggg

SEQ ID NO: 29032 - DNA, 655 bp, Homo sapiens
  misc_feature: GYAE6OF02GOMBG.13.55.E11.1.454.CMB.1.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
  modified_base (331)..(331): a, c, t, g, unknown or other
  misc_feature (331)..(331): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggccccggganagacggccacaacttccctgtgaggaaacaaccttagaagtcagaatgtccactcggtaccagcagaagtcaggccaggtccctggtggtgtcntctataggatacgtaaccggcctctcgggactcccngaccgtattctcgtggctccaacgtccgggacacggcccaccgtgacctatcaacgagaccgacccgaaggacggggactggacggtcgtagacttaagttagttacgtcgaacgggtggttacggacgaacgtccgaccgtacgggtacgtagttaacggttccggggacgggtacccggggacgtaacggtccgtacggtacccggtaccgtagggtaccgcgacccgtacgggtcctacccgggccccccgttacggtaccgtacctttccggtacccgttaccccgaccccctttcccggttacctaccggttaacccgg

SEQ ID NO: 29033 - DNA, 634 bp, Homo sapiens
  misc_feature: GYAE6OF02F9Z08.13.55.E11.1.454.CMB.1.raw
  modified_base (296)..(296): a, c, t, g, unknown or other
  misc_feature (296)..(296): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttggcttacttgggttttccttgttgcttattttaaaaggtgtccaatgtgagtctgcagctggtggagttcgtgggggtagtttggacagccgagggccggtccctgacgtactctccgtagtataacttctggatttcgaacgttgggtntattagtgtctaattcgaacgttcgggtccgaccgaggtcgtaccggagggggaacgggctgggaggtgggttagtttcagttaggagtccaagttctacattgagtcggggaacaagagaagtccgaccggtactacgtaaggtaaaacgcgtagacttaccactatactacgaagtacgagtcgacggtacaaggaacgtacagttccgttccttttacgagtactacggtataggacgtacgtaccgtaggaacgaccgtagaacgacgacgcctactacgtagttctagtacgacgtaagtgtagttcgtacgactaaccgtccgtacgtaccg

SEQ ID NO: 29034 - DNA, 727 bp, Homo sapiens
  misc_feature: GYAE6OF02HYX73.13.55.E11.1.454.CMB.1.raw
  modified_base (214)..(214): a, c, t, g, unknown or other
  misc_feature (214)..(214): n is a, c, g, or t
tcagtcacgtactacacgaccggtgctcgattttagcactcgcacgttgggtttggggactcaggacacagcatggacatgagggtccccgctcagctcctggggctcctgctgctctggctccagtgcagatgtgccatccagatgacccagtctaccactcctccctgtctgcatctgtaggagacagagtacacatcacttcggaccgganaagtcgacggctagttaagaatgtagtttaggacgttaggtatacgagacgaacgaaaccgaacggtaaacaccccgtaacgtccttaccgtagtaacgtacttacgatgacctacttaaccgtaagtttaacggaaacgtacgggtaccatacgtaaggttcgaggtaggagtaggtagtagtagggaactagttaacgttttaccttactaactaacgtacacgtctacgtaccgtagacgacgtactaaggtaagtacgtaacttacgtaacgtaaactaacgttactttacgtacgacgtaaagtacctaaagttacgtaacgttaaacgttaaacgtacccgttaacccgtaacttaccggttaaaccccgttacggaaaccccgggtaaggttaaacccgtacggttaacggttacggtaaaacggtttaaaccgtttaaaacggtaccggttaaggtacggttacccgttacgaccgttaaccctacggttaccttacgtttaccg

SEQ ID NO: 29035 - DNA, 862 bp, Homo sapiens
  misc_feature: GYAE6OF02FR8Y4.13.55.E11.1.454.CMB.1.raw
  modified_base (186)..(186): a, c, t, g, unknown or other
  misc_feature (186)..(186): n is a, c, g, or t
  modified_base (271)..(271): a, c, t, g, unknown or other
  misc_feature (271)..(271): n is a, c, g, or t
  modified_base (296)..(296): a, c, t, g, unknown or other
  misc_feature (296)..(296): n is a, c, g, or t
  modified_base (355)..(355): a, c, t, g, unknown or other
  misc_feature (355)..(355): n is a, c, g, or t
tcagtcacgtactacacgaccggtgctcgatttagcactcgcacgttgggtttggggactcaggacacagcatggacatgagggtccccgctcagctcctggggctcctgctgctctggctcccaggtgccagatgtgccatctagatgacccagtctccatcctccctgtctgcatctgtagganacagagtcaccatccacttggccgggacaagtcgagggcattagaaatgattaggctggtatcgagcaacgaaaccagggaaacncccctaagcttactgattctagtgngcagtacctaaaggtttaaaacgtcggggtaccctaagtctaagggttcacggccggtntaagggtaggtactcgttagggaccaactaggtaaccctttagaactttccctaccgaacccagtacccgtaacgtaccgttaaccgggaccccgttagggaccctaaccggtacccgtttaaacggtaaaccggttttaacgtttttaaccgggttaacccttaaaaccttttttaaacccgttttaaaccgttaccggttttaacttaaaaccgtaaacggttaaaccgtttacccaaaaacgtttaaaccgttttaaaccgtttaaccccgggttaacggggggtttaaaccggttttccccgggaaaaacccccgggttaaaacggggggaaacccccgtttaaaaaaggggggtaccgtaaaaaaacggtttaaaccccggtaaaaaacccggttaacggtttaaccggggttaaccggaccgttttaacggtaaccccggtaaaccttaacgttttaccccgttaacggggtttttaacccttaccccgggttaaaccccg

SEQ ID NO: 29036 - DNA, 723 bp, Homo sapiens
  misc_feature: GYAE6OF02IIE2K.13.55.E11.1.454.CMB.1.raw
  modified_base (339)..(339): a, c, t, g, unknown or other
  misc_feature (339)..(339): n is a, c, g, or t
  modified_base (605)..(605): a, c, t, g, unknown or other
  misc_feature (605)..(605): n is a, c, g, or t
  modified_base (628)..(628): a, c, t, g, unknown or other
  misc_feature (628)..(628): n is a, c, g, or t
  modified_base (714)..(714): a, c, t, g, unknown or other
  misc_feature (714)..(714): n is a, c, g, or t
tcagtcacgtactacacgaccggtgctcgatttagcactcgcacgttgggtttggggagtgctttctgagagtcatggatctcatgtgcaagaaaatagaagcacctgtggttcttcctcctgctggtggcggctcccgagagtggggcctcgtcccgagctcggcaggcctgaccgaggaggtccgggcccgagggaggtgggtagaaccgtcccgtttacgggaacgtaccccgtcggttccccgtcgtaggtttacgttaagtcgttgttcggttgggttcggacccttacccggtaaggtaacgaccgtttacgttaacgttcggtcggggttcnggtactaccgggccaccggaccccggtagggggaacgggtcctaggaggtgacggttagggattactcggtattgacggtgggaacgtacgaactacgtactcccgtactagaacggatcgtacgactacacctagtaacgtccgaggaaccgacggtcgaaaggaaccgtttactcctacggacgtaaaggtcgtacgttcgttacgcgtaaccgtgacgagttaccagggtccttagactttagtagtcgtgacggtagaccgngtaaatcgtaggcgtaaagggtnttccgaacgtcgtccggggaacctaccggggacctggttacccgtaccgtcgttcccgaaccgttcgtaacccccgtgaccccggngggtacccc

SEQ ID NO: 29037 - DNA, 763 bp, Homo sapiens
  misc_feature: GYAE6OF02H0AJ5.13.55.E11.1.454.CMB.1.raw
  modified_base (309)..(309): a, c, t, g, unknown or other
  misc_feature (309)..(309): n is a, c, g, or t
  modified_base (625)..(625): a, c, t, g, unknown or other
  misc_feature (625)..(625): n is a, c, g, or t
tcagtcacgtactacacgaccggtgctcgattttagcactcgcacgttgggtttggggagctctgggagaggagccccagccgtgagattccccaggagtttccacttggtgatcagcactgaacacagaccaccaacatggagtttgggcttacttgggtttttccttgtttgcttattttaaaaggtgttccaatgtgagctgcagctggtggaggtcgtgggggtaggtttggtacaggccgagggccggtccctgacgacttcctccgtgtaacttaacttctggtacttctaacgtttggggtntaattagttcgacttataggacgttcgggtacccgtccgacgggtccttacccgggaagggggtaacgggggtccggtaggggtagggttcgggggtttaaggttttacgaggttttaagggacgtactaaacggtttccttagtaagttgaggttacggggaaaaccaaaggaagtaaaccgttaaccggaccggtaccgttaacgttaaacgggtaaaaacggtcctaaagggtacttaaccgacccgtaacgttcctaacgaaagacggtaagtacgaacgtacgaaggaactacgagttccgttccttttancgtacaggtataggtagtaccgtaccgtaagaaccggaaccgggaacgaaccacgaaccgacgtacttacctaagtttaccgagttacgattaacggaagttaggtactacgaaccggttacctacccgtgtaacccg

SEQ ID NO: 29038 - DNA, 641 bp, Homo sapiens
  misc_feature: GYAE6OF02HUVTN.13.55.E11.1.454.CMB.1.raw
  modified_base (323)..(323): a, c, t, g, unknown or other
  misc_feature (323)..(323): n is a, c, g, or t
  modified_base (364)..(364): a, c, t, g, unknown or other
  misc_feature (364)..(364): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgctattttaaaggtgtccaatgtgagctgcagctggtggagtcgtgggggaggtttggtacaggtccgagggccggtccctggagactctcctggtatacttcgtggtacttcgaacgtttgggtgtattagtgtctagtgaacgtgggtccncgaggctcgagggacggctggagtggtagttcagttagganactaattcgatatcgagtgggaacaagagtaactacggccgtgttactaggtaaaacggcaagtacttccgaactagtactacgaagagtacgtagtacgtaccgaagtaagcgtaacttcggtccttttacgacgtacgagtacgtaggtacgtacgtaccgtaggaacggtaaccgaaggtacgaacgacggtacctacggttacttacgttacgtacggtgtaccgttaaggacgttagtacgttacgagtaccggttaccgtaaccggtaccg

SEQ ID NO: 29039 - DNA, 748 bp, Homo sapiens
  misc_feature: GYAE6OF02JJCQ8.13.55.E11.1.454.CMB.1.raw
  modified_base (611)..(611): a, c, t, g, unknown or other
  misc_feature (611)..(611): n is a, c, g, or t
tcagtcacgtactacacgaccggtgctcgatttagcactcgcacgttgggtttggggtgatcaggactcctcagttcaccttctcacaatgaggctccctgctcagctcctgggctgctaatgctctgggtcccaggatccagtgggatcgttgtgatgactcagtctccactcctccctgcccctcacccttggaccacgtccggcctccactcctccgtgcgagttccgtattaccaaagccttaccggtataccgagttcgatacggaaacgtacctacgttagtaatttcgggttacaggtcagtacggcccgaggaccagtccgtccaaggccaccttaatttactaacgtttcgttttacccggacgttcgtacggggtacccaggactacgtaattccgacggcgacggtacggtgggtaccgacggtactacgttgtaacgtttacaccgttaataacgtaaaccgtacgtaacccgggaggggttaccggtaacggtacccgttagggaaacggttaacggtttacggggttagggtttaaccgtttaaggttttacgtacggttaccgtaaacgttccgtacgtaaagacccggtttaaancggttttaccgttacggttacctttacccgtttacgtttcccggtaaccgttacgggtaacccgttaaggacgtaacgttaaccgacgttaccgtacgtacgtagtcttaacgccgtacctgtaccgttacgttccg

SEQ ID NO: 29040 - DNA, 639 bp, Homo sapiens
  misc_feature: GYAE6OF02FM5CO.13.55.E11.1.454.CMB.1.raw
  modified_base (403)..(403): a, c, t, g, unknown or other
  misc_feature (403)..(403): n is a, c, g, or t
tcagtcacgtactacacgaccggtgctcgatttagcactcgcacgttgggtttggggatgctttctgagagtcatggatctcatgtgcaagaaaatgaagcacctgtgttcttcctcctgctggtggcgctcccagatgggcctgtcccagctgcagctgcaggacgtcgggcccgaggagtggtagaacgccgttcggacgaccctcgtccctcagtttgtaagtgtgtcgtggtcggcctaccgtaagtaggtactacttactacgtgggctggactccggcacgcccccgaagggacgggtctggagtggagtggggatatcgtcttagtaggtgggtagtacgaactacgactcccgtacctacgaagtacgtacgacgtcactcgtatactacgtaancgtacggtaccgaaggtaactacttcctaccgtagaacgtgtagttctggtcgaccgtgcgtaagaccgtacgacttcgtacttattacgtgtacggacgtaggtaacgacttaaagttagttacgggtaacgtacgggtattccggacttacggcgggtaccggtaaccggtacccgtaggtacccgtacgttccgtaccttccgacgtccctacccgaccggtacggtaccccg

SEQ ID NO: 29041 - DNA, 801 bp, Homo sapiens
  misc_feature: GYAE6OF02I83WK.13.55.E11.1.454.CMB.1.raw
  modified_base (465)..(465): a, c, t, g, unknown or other
  misc_feature (465)..(465): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgacgcctccttgctcactttacagcttctgtgcctcctatgtagttgactcagtccactctcagtgtcaggtcggccccggaacggaccgccaacaacttccctgtacggaagggaaacctaaccgttaagaagttccaagaacttcggtaccacgttggtaaccacggacaacgtaaacggtcgaacggcccgtaacgggcccccgttggtcggtaggtaccaattccgtaagtacggggtaacttaaaccggtaaccggtcccgttacgttcgggtaacttaccccggtaggtaccccggttatttccgtcgttcggaccctaccgaacgttcggggaacccnccgggtacccaacccgtacggtaaccaacgtaccaaacgaacggaccgacccgtaaggaaccgggggactacgggaacggtacctacggtacgtttaaacgttagtttaccggtacggttacgggttacgggtacgggttaaccgacggaccgtaaccgtaacggtacggttagtaacgttaccggttacggggacccggacgggaacccttaggcccttacgacccgttacggtacgtaccgacggtacccgtacggcccgttcccgaaccccgtcgttaccgacccgtttcccgttccggttaccccctacccgttacccgttaccgttaacgg

SEQ ID NO: 29042 - DNA, 706 bp, Homo sapiens
  misc_feature: GYAE6OF02HPSNO.13.55.E11.1.454.CMB.1.raw
  modified_base (679)..(679): a, c, t, g, unknown or other
  misc_feature (679)..(679): n is a, c, g, or t
tcagtcacgtactacacgaccggtgctcgatttagcactcgcacgttgggtttggggatgctttctgagagtcatggatctcatgtgcaagaaaatgaagcacctgtggttctcctctgctcggtggcggctcccagagtcggggcctgtcccagctgccagctgccgaggagtccgggccagggagtgggtagaacgtcccgttcgggacgtacccgtcgtccctcgtaggttcgtaacgttggttcgtccgtggggtcggtaccttacccgtaaaggttaacggtaccttaacgttactacggtacgggggtcgttaggacgtccggcaccggcccccggaagggtaacggggcgtcggacggtggaggttgggattacgtcgtcttagtaggtaggacgtaacgaactacgtactccgtacctacgtaacgagtcgagtactagtactactacgtaccgtagacgtacggtacgacggaactactctacccgaagtaagtcggtacttcgtggtacgtacgtacagacgacggacgtcgtcgtattaattcgtagtcgacgtagaccgtaacgtaagtacgttaacgggtcgaagggtacgttacgaaccgttcggtacgggtaccgtaacgggtaaccgtcggtaacccttaccggtccgtaccgaccggtaccncccggtaacctaccggaccggtacccg

SEQ ID NO: 29043 - DNA, 619 bp, Homo sapiens
  misc_feature: GYAE6OF02F15JI.13.55.E11.1.454.CMB.1.raw
  modified_base (407)..(407): a, c, t, g, unknown or other
  misc_feature (407)..(407): n is a, c, g, or t
  modified_base (441)..(441): a, c, t, g, unknown or other
  misc_feature (441)..(441): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
tcagtcacgtactacacgaccggtgctcgatttagcactcgcacgttgggtttgggggggtctcagagaggagccttagccctggactccaaggcctttccacttggtgatcagcactgagcacagaggactcaccatggaattggggctgagctgggtgctccttgtgctattttagaaggtggccagtgtgagatgcgactggtggagtcgtgggggaggtcttggtccaggccgggggggtcacgtgagacctctccgtgtacagcctcgagattcattttcaggtaattagttggatggtagttgggtcccgcagttcctccgaggggaaggggtctagggtaggtcggggtggaccaaacgagtaaaagggaggacgtgggagtacgagactattagttagnggtaggagtgtggtcggtcgggcgtattccactntttccgagtacgacacgccagtactcgtacagttanactcgtanaccgtaaagtcggaagggactcggtacgagggtaacgtacgtacgtagtacgtaccgtacttacgtagttaagttattggacgtagtaagttagtcgttaaccgttacgttttaccgacggtaccggtaaccgg

SEQ ID NO: 29044 - DNA, 769 bp, Homo sapiens
  misc_feature: GYAE6OF02FIHI9.13.55.E11.1.454.CMB.1.raw
tcagtcacgtactacacgaccggtgctcgatttagcactcgcacgttgggtttggggatgctttctgagagtcatggatctcatgtgcaagaaaatgaagcacctgtggttcttcctcctgctggtgcggctcccagatgggcctgtcccagctgcagctgcaggagtcggcccaggacgtggtgaaacgccttcgggagacccgtcggtcccctcagtttgtaactcggtgttccgtcggtcggcctacccgttaaacggtacggtaaccttaaccgtttacgtaccgtcggggtactcgggacttccggccgtaaccggccccccgaagggggaacggggcgtcgggtacgtgggtagttacggggaaatacgtaatcgaataggttaggaacgcaaccaactaacctaacccccggtcctacgtaacgacgttacgtacgtaccaacctacgtaatccgaacgttaacgaaccgtacccgttaaccaaacgaacccgtacgtttaccctacccgtagaacgccgttagacgtccttccgtagtacccggaccgacccggtaccggaacgtaccggtacgtacggtgttaacggttaacctggttacggaccgacggtaaccggtaaccccgggaaaagtaccgggtaaacgtcggaccgtaaccgttaggtttacgggaacttaaccgttaacgtaacgacggtaacgggtccgttacggtacgggaacgtaaaccggggcccttaaccggcctaacccgttcccg

SEQ ID NO: 29045 - DNA, 274 bp, Homo sapiens
  misc_feature: GYAE6OF02FOY05.13.55.E11.1.454.CMB.1.raw
  modified_base (265)..(274): a, c, t, g, unknown or other
  misc_feature (265)..(274): n is a, c, g, or t
tcagtcacgtactacacgaccggtgctcgatttagcactcgcacgttgggtctgggacagacttcactctcaccatcagcagcctcgagcctgaagattttgcagcttattactgtcagcagcgtagcaactggcctccggccctttcggcggagggaccaaggtgcagatacaaacgaactgtggctgcaccatctgtcttcacttccttcccgcactctgattacgtacgtgactggaggcggctggacgaaggcgctatagnnnnnnnnnn

SEQ ID NO: 29046 - DNA, 629 bp, Homo sapiens
  misc_feature: GYAE6OF02JAD7Q.13.55.E11.1.454.CMB.1.raw
  modified_base (200)..(200): a, c, t, g, unknown or other
  misc_feature (200)..(200): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccggganagacggccacaattccctgtgaagggaaacaaccttagaagtcagaatgtccactggtaccagcagaagtcaggccaggcccctgtggtgtcatctatagggataagtaaccggccctgtgggactccccgttagaccgtattcctctggccttccgaacgttccggggaaccaccgggcccacccgtagaccctataccaaacgacgacgacccaaggacggggaatcggaggctagactattatcgtacgtaggtcgtggacacgacaccgacggtagacgttacgttcgggcgggccgggaaccacggcgttacgacccgttcgtacgggtcctacggacccgtaaggtccctcccggacccccgttcggttccctacgttcccgttcggttcccccgtcccttccgttacccgttacgttaccgg

SEQ ID NO: 29047 - DNA, 744 bp, Homo sapiens
  misc_feature: GYAE6OF02JE73F.13.55.E11.1.454.CMB.1.raw
  modified_base (187)..(187): a, c, t, g, unknown or other
  misc_feature (187)..(187): n is a, c, g, or t
  modified_base (240)..(240): a, c, t, g, unknown or other
  misc_feature (240)..(240): n is a, c, g, or t
tcagtcacgtactacacgaccggtgctcgatttagcactcgcacgttgggtttggggactcaggacacagcatggacatgagggtccccgctcagctcctggggctcctgctgctctggctccaggtgccagatgtgacatccagttgacccagtctccatccttcctagtctgcatctggtagganacagacgtcaacctatccacgttcgcccgggactagtcgaggactattaaccngtttactttagccgtaggtaatcgagtacaaaaaccgtaggaactcctaagcctactgatctagtgttacgctagtcctacgtttcgacgtaaacggttcgggtaccctagtacgtaaggttcgacggtcggaccgaggtagtacgtacgtacggggaataacggtaactttaccgaacgtactacctaacaacgttcaaacggtcccaaacgtcccgttaggaccgtaaccggtaccttaaagggaattttacgtttacggaaccctttaaacgttttaacgtaacccttacgttaacccggaaaactcgtttaactttaaaccggttcccgttaccccgtacgttacggttacggggtttacccggacgggtaacgggtacccgtaaaggtggtaacgttaactaacggtaaacgtaccggttagggtcggtaccgtcgtacccgtaaacgtcggttacccgtttaccggtcctttaaccgtacccgtttccccgttaaccg

SEQ ID NO: 29048 - DNA, 659 bp, Homo sapiens
  misc_feature: GYAE6OF02GRLCG.13.55.E11.1.454.CMB.1.raw
  modified_base (225)..(225): a, c, t, g, unknown or other
  misc_feature (225)..(225): n is a, c, g, or t
  modified_base (348)..(348): a, c, t, g, unknown or other
  misc_feature (348)..(348): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcaggtcgggccccgggacagacggccactaacttccctgnggaacggaaacaaccgttaagaagtcagaatcgtaccacgtggtaccagacagaacgtcgacggccacggccctggtcggtgtcatctagtagggataacgaccggcctcgtaggtactccgngtaccgtattctcgtggcctaccgaacgtcgggaaccgaccgcccaccgagaccaataccaacgacgaccgaccgaacgggacgggactggacggcttacggactttagttagttcggtacggtaggttcggtaggaacacggccgaacgtacgggtagaacgttcggttcgggaccgggtacggaccgtaagccttacgggtacccgtacgtcggtaccacggtacccacgggtccgtacccgtccccgttacgccttacccgttccgttcccgttaccccgtaccccttccgtccgttacggttaccgg

SEQ ID NO: 29049 - DNA, 865 bp, Homo sapiens
  misc_feature: GYAE6OF02HH8KA.13.55.E11.1.454.CMB.1.raw
tcagtcacgtactacacgaccggtgctcgatttagcactcgcacgttgggtttggggggtctcagagaggagccttagccctggactccaaggcctttccacttggtgatcagcactgagcacagaggactcaccatggaattggggctgagctgggtgctcctgtgctatttagaggtgccagtgtgagatgcgacgtggtggagtcggtgggggaggcgttcgggtccgagggccgggggggtcacgtggacgacgtctccgtagtacagcccgtcgagtagttcctattttacgaaggtaatttagtggtataggtaggttcgggtccgaccctaggttaccttcccggaagggggtaacggggtccgttagggggtagggttcgggggtacgggaccccgtaaaacgtaaacggttaaaaagggggacggtaaggtagggggaaacgggttccgaaaagggtaaacctaaggtttaaaacgtttaaacggtttagggttaaaccgggggttagttcccgggtttagggttacggggcccggggggttacccgtaaccttttaacccgaaacgtttaacgtttttaccccggaagggttaaacggaacccgtaaaacggccccgaaaaggtctacggttaaccgtaaacgttaacgttacgtaccgtttgaaaccctaaagttaacgggaagggtaaccggtacccgttagggaaagtaacccgggttaggtacgttaacggtagttaacccgggcttaaaccgttaatttaagttttaaccggtaggtacccggtaaagggtattaaacgttcgttaaaccccggtaggttttaaccccggaggaacccgggttaacccgg

SEQ ID NO: 29050 - DNA, 605 bp, Homo sapiens
  misc_feature: GYAE6OF02GY8FL.13.55.E11.1.454.CMB.1.raw
  modified_base (390)..(390): a, c, t, g, unknown or other
  misc_feature (390)..(390): n is a, c, g, or t
  modified_base (454)..(454): a, c, t, g, unknown or other
  misc_feature (454)..(454): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
  modified_base (567)..(567): a, c, t, g, unknown or other
  misc_feature (567)..(567): n is a, c, g, or t
  modified_base (573)..(573): a, c, t, g, unknown or other
  misc_feature (573)..(573): n is a, c, g, or t
  modified_base (577)..(577): a, c, t, g, unknown or other
  misc_feature (577)..(577): n is a, c, g, or t
  modified_base (598)..(598): a, c, t, g, unknown or other
  misc_feature (598)..(598): n is a, c, g, or t
tcagtcacgtactacacgaccggtgctcgatttagcactcgcacgttgggtttggggggtctcagagaggagccttagccctggactccaaggcctttccacttggtgatcagcactgagcacagaggactcacatggaattggggctgagctgggtgctcctgttgctattttagaaggtggccagtgtgagatgcgacgtggtggagtcgtgggggaggcttggtccgaggcccggggggggtcacgtggagactctcctgtaccagcctcgagactttctattttacgaggtaaatttattgggattggtaaggttcgggtcccggctacggtctccggaggggaagggcgtgggaggtggggtcggacctaaacgagtaaaagggnggaagtggggagtcaaggactataagttatggttacgggatcgttggtacgggcgggggtaccncgttaccgacttaactttcccgagacgaacaaccggccagtactacgtctaaggttactagcttagaactaagtggagcgtacgtgacgagtgagtgataccgntanagtttntgttgngtanagtattgattcggttacaggnggtaccg

SEQ ID NO: 29051 - DNA, 707 bp, Homo sapiens
  misc_feature: GYAE6OF02FZIAA.13.55.E11.1.454.CMB.1.raw
tcagtcacgtactacacgaccggtgctcgatttagcactcgcacgttgggtttgggggggtctcagagaggagccttagccctggactccaaggcctttccacttggtgatcagcactgaacacagaggactcaccatggagttttgggctgagctgggttttccttgttgctattttaaaaggtgcccagtgtgaggtgcagctggtgggagtctgggaggaggcttgatccagccgtggggggtccctgagactctcctgtgcagcctgtcgggttcaccgtcacgtccacaccctaacactgagcgtcgggtccgccgaggcctccgaggggaacgggcgtggagtgcgtcttacttttatttatagtaggttggtagtactacttacgtccgacgacgtacctcggtggacgggggcctacttcacctactcctaccaaggaacgaacctaaacttacccgaaagtaaaccaccggtctttacgttttacctaactaaaagttcgaaacctacgtccgtaggacgacgtccggtaatacggaaccgacgggtccgttacgtaacgtttacgacggttacggaccgggtaaggtaacgggtaccgggtacccgggggtaacccctaaaccgggttaacccggtttaacgtacccgggtaccgttaacggttcggggtaacccgggttccgggtaacccgggggg

SEQ ID NO: 29052 - DNA, 811 bp, Homo sapiens
  misc_feature: GYAE6OF02GO8FE.13.55.E11.1.454.CMB.1.raw
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcaggtcggccccgggacaggaccggccaactaactttccctggtaggaacgggaaacctaaccttagaagtcaagaatgtccactggtaccagcaagaagtcacggccacggcccctggtcggtgtcatctagtagggataacgtaccggcctcgtgggactcccgtacggacccgtatttccgtcgtcggtcctaccgaaccggtaccggggtaaccaccgggacccctaacccgtacgaaccctacgtaccaaacgacggtaccaccccggaagggaaccgggggtacgtagggaacggtccgttaaggtaaaccgttacgtttaaggtttacgggtccgttaaggggttcgggttaacggggtaaccctacgggtacccgaacccggtacgggtaaggtaacggttacgggtttacccgggggacggggtacccggggtaaccgacgggtacccggttaaccgggacccggtttaaccgggtaccgggttcccggaaccgggtacccccggtaagggtccccttacccgggtaccccccgttaccgggaccccttaaccggtttccttaccccggtttcccccggtcccctttaccccgttccggttaaccgggtttacccgg

SEQ ID NO: 29053 - DNA, 818 bp, Homo sapiens
  misc_feature: GYAE6OF02IYWGE.13.55.E11.1.454.CMB.1.raw
  modified_base (783)..(783): a, c, t, g, unknown or other
  misc_feature (783)..(783): n is a, c, g, or t
tcagtcacgtactacacgaccggtgctcgatttagcactcgcacgttgggtttggggatgctttctgagagtcatggatctcgatgtgcaagaaaatgaagcacctgtggttcttcctcctgctggtggcggctcccagatggggcctgtcccagctgcagctgcaggagtcggcccaggagtggtgaagccttcggagtaccctgtccctcgtagttgtaactgtcgtcgtggtcggctaccctaaggtacggacttaacttactacgttggggcttggacgttcccggacacggaccccccgtaagggggaacggggtccgttaggggacggttcgggtaaggttcggggggtacttaagtccgttaccgtttagtaacggtggggaacgttaaccggtaaacgttacgtaaacgttccccgtaccctacgaaacgtacggtacggtacgtacgtactaccgtagttaacttccggtaacggtacgtaacgggttacccgaagggtaaaccgtaacgtttacccgtacccgtaggtaaaaccgttcgggtaacgtttccggttacgtacggtaaccccggttcgaacccggttacggacccgtaaacggggttccttacggtttaccgttaagtttacgtttaggtacgggtacccggtaacgaacgggtacttaaaacggttcgttaacgggttacgtacggggtaacgttccgtaaccggttacgtaccggggaccgtacgggtaaccccggtggtacccgtacccgtacggttacccncggtaccgtacccgacctaaccggcggtaaccccg

SEQ ID NO: 29054 - DNA, 776 bp, Homo sapiens
  misc_feature: GYAE6OF02JTUQV.13.55.E11.1.454.CMB.1.raw
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (638)..(638): a, c, t, g, unknown or other
  misc_feature (638)..(638): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccagtggagtttgggcttacttgggttttccttgttgcttaattttaaaggtgtccaatgtgagctgcagctgggtggagtcgtgggggtaggtttggtacagccgagggtccggtcctggagactctcctgtattacttcgngattcgaacgttgggntattatgtctancgtaacgtgggccgaccgtaggccgtaccggaaggggacgggtctaggggtcggttaggggttacgtttcgaaggttagggagtacgtaaccgtttcgtacgtaaggtacggtaacggtacgggaaactaaaccgtaaaggtaaccgttaaacccgggcccggtttaacgttaacccgttaaaacggggtaaaaacgggtaccctaagggtttaaaccgtttccaaacccggttatacccggttaacgaaaggtacgaagttccggtaacgtaccgtaaaggaccgttcgaaccgtttccgtaccgtttcgtaacggacctagtttaacggngttacggtaccgtaacgtaggtaaaccgcccggaaagacccgtaccaaccgtaccgtagtttaaccgtacgtttaccggattacgaggttaacggatttacgtacgttaaccggtaccgtaacgtccccttaggaccg

SEQ ID NO: 29055 - DNA, 1004 bp, Homo sapiens
  misc_feature: GYAE6OF02HTB9Y.13.55.E11.1.454.CMB.1.raw
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgcttaattttaaaaggtgtccaatgtgagctgcagctggtggagtcgtgggggtaggtttggtacagccgaggggtccggtcccgtggaacgtaccttcctccgttagttaactaacgtttccgtagggtaactttccgaaacgttttgggggtagttaagttttaacgttcggaccgtttaagttacgggtaaaccggtttcggggggtacccccgtacccggtaacggggtccccgttaacccgggaagggggggggtaaaccggggggtaccggttaggggggtaagggtttacgggggggttttaacgggtttttaccgtaaagggttttaacgggggaacggtaaccggttaaaactttccgttacgtaaacgtttaggtaaacggttacgggggaaacctaaaaacggtaacggtaaaaccggttacccgggaccccgggttaccggtttaaccggtttaaaacgggttaaaaaaccgggggtctaaaacgggtttaacccttttaacccgaaacccgtaaccgttttacccgtaaacggaaaagggtacgttaaacgttcgggtaaaaccggtacccgtaaagggaaaccgtaccttaacgtttaccccgttcccgtttttaccagggaaacctcggttaaaggttcgttaacgggttaaaccggtccgttaaagggaaacccggtaaccggggtaacggaaacccgtaaccggaacgttacccctaagtttacccgttaagttaaccggttcggttagtaacccttaaaggggtactaaacgtttaggttcaacccgggttaacgttaccctaaccggttacccgg

SEQ ID NO: 29056 - DNA, 976 bp, Homo sapiens
  misc_feature: GYAE6OF02J2J0S.13.55.E11.1.454.CMB.1.raw
tcagtcacgtactacacgaccggtgctcgatttagcactcgcacgttgggtttggggagctctgggagaggagccccagccgtgagattcccaggagtttccacttggtgatcagcactgaacacagaccaccaacagtggtagtttgggcttacgtttcgggttttccttgttcgtacttaagttttaaaaggtcgtccaattggtgagtctgcagtctgggtgtagtcgtgggggtaggtttggacagtccgacgggtccgtacccgtggacgtaccttccgtccgtagttacttaaccgttcgtacggtatttaaccgtaacggtttggggtataacttacgtcgtacgttagtacggtaaccggtcgggttaccccgacgtacggtccgtaccgggaggggtaacgggtcgtagggttacggttacggggtttacggttctaagggtttaacggagtacgttaacgtttccgaagtaggtacggtaacggtacgggaaactaaacggtaggtaaaccgttaccgggacgtaaccgttaacggttaaacgggtaaacgtccgtaaaggttaccgttaacccgtaaccttaacggttacgtaaaccggtaaacggtaacggttaacggttaaccggtaaccggttaacccgtaaaacgggtaaccgttaccgtttaaaccggttacccccggttttcgttttaaccggaccggtaaaccgttaagggtttaacggtaaccgggttaaaccggttaccggttaacccggtaaaccgggtaaaaccgggttaccccggggaaaacggtaaacccggtaacccgtaaccgtaacccggttagtttaaacccggttttaaggttaacccggggtttgttaaaccgggttaacgttaaccgggtttaacgtttaacgggtttaccggtaccggtaccccggtttaaacccgggttacccgttaacccggttaaaccggg

SEQ ID NO: 29057 - DNA, 700 bp, Homo sapiens
  misc_feature: GYAE6OF02IIV43.13.55.E11.1.454.CMB.1.raw
  modified_base (398)..(398): a, c, t, g, unknown or other
  misc_feature (398)..(398): n is a, c, g, or t
  modified_base (535)..(535): a, c, t, g, unknown or other
  misc_feature (535)..(535): n is a, c, g, or t
tcagtcacgtactacacgaccggtgctcgatttagcactcgcacgttgggtttggggatgctttctgagagtcatggatctcatgtgcaagaaatgaagcacctgtggttcttcctcctgctggtggcgctcccagatgggcctgtcccagctgcagctgcaggagtccgggccaggtagtggtgaacgtccttcggacgtaccctgtcccctgtagttgtaagttcggtgtcgtagggtcggccttacccgtaagtcggaccttacgttaacgtacgtggggtctcggactccggcaccgaccccggagggacgggctaggagtaggtgttaggggaactcgtaagtcctagtaggtggaacgcctaaaccaaccgtaaccgaccccctacccgtanaacgtcgtaccgatccacctaatagtaccaggtacaaccgtaccgtacaaccgtaaccctacgttacctacccgtaggaaacgtcgttacgaacggtccttacgtcggtaccgaccccggtaccggccggtaaaccncggtctagggtacttacgtgtacggtcggacgacggaccggtaacccggaaggaacgtaacgtcggacgttacgttaggttacggaactaccgtaagtaactcggttaaggtaccgtcggtacggggaacaaaccgggacccgtacgtacccgtaccgttacccg

SEQ ID NO: 29058 - DNA, 701 bp, Homo sapiens
  misc_feature: GYAE6OF02IMUE9.13.55.E11.1.454.CMB.1.raw
  modified_base (670)..(670): a, c, t, g, unknown or other
  misc_feature (670)..(670): n is a, c, g, or t
tcagtcacgtactacacgaccggtgctcgatttagcactcgcacgttgggtttgggggagctctgggagaggagccccagccgtgagattcccaggagtttccactttggtgatcagcactgaacacagaccaccaaccatggagtttgggcttactttgggtttttccttgtttcgcttaatttttaaaaggtgtccaatgtgagctgcagctggtggagtcgtgggggtaggtttggtacaggcacgggcggtcccgtgacgactcgtcctgtatacttctggtacttctaacgttgggtgtattagtcgtctagtagtaacgtcgggtcccgccgacggtcctaccggagggggaagggggtccgtaggggtaggttggggtttacggtttacgtaaggttagggacgtactaattcgtactagtgtaagtcggaacaacgaagtaaatccggtaccgtcgttacgtaaggtaaaacggctaggtaacttccgaaccttacgtactacgaaagagtaagttgtaacggtacctagggaaccgtactaacttaccccgttctttacgcgtaccgtaagtcgtagaggttacgcgtaacggaacggtaacgccggaaacaccacgtcctactacgtttacgtaacggtggttaacgtgtacgtaaggtnttacgttgacccgttacttccccgatacccg

SEQ ID NO: 29059 - DNA, 717 bp, Homo sapiens
  misc_feature: GYAE6OF02FLZYS.13.55.E11.1.454.CMB.1.raw
tcagtcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtcggcccggacaggaccggcacaacttccctgtagacgggaaacaccgttagaacgtcagaatcgtaccacgttcggtaaccaggacaagaacgtccgaacggtcccgaaccgggtccccgttgggtcgggtcggtacctagttccgttaagtaacgggtaactaaacgtaacccgggtcctacggtacgggtaccttacccgtcggaacccgtacgtttctacgtcggccttacccgtaacggtaccggggaaaccaccggacccaccgtcgacctactacaaccgacgaccgaccgaagggacgggtatcggaaggcgtagtaacttagttattacgcggtaggtcgggtaacggacagggcaggtcctacggccgacccgtagttacgtccgtttacggtacggaacggtaccggaacgtacggtacccaccggttactacggtcccgaaccggacccgaaccgaacccctacccgtacgttccgaccttacccgttccggtccccgttccccgtccctttaccgg

SEQ ID NO: 29060 - DNA, 655 bp, Homo sapiens
  misc_feature: GYAE6OF02G1XK0.13.55.E11.1.454.CMB.1.raw
  modified_base (201)..(201): a, c, t, g, unknown or other
  misc_feature (201)..(201): n is a, c, g, or t
  modified_base (410)..(410): a, c, t, g, unknown or other
  misc_feature (410)..(410): n is a, c, g, or t
  modified_base (468)..(468): a, c, t, g, unknown or other
  misc_feature (468)..(468): n is a, c, g, or t
  modified_base (620)..(620): a, c, t, g, unknown or other
  misc_feature (620)..(620): n is a, c, g, or t
tcagtcacgtactacacgaccggtgctcgatttagcactcgcacgttgggtttggggagcctgggcctcaggaagcagcatcgggggtgccgcagccatggcctggaccgctctcctgctgagcctcttgctcactttacagcttctgtggcctcctatggagttgactcagccactctcagtgtcagtcggccccggganacggaccggccaactaacttccctggtacggaacgggtaaacaaccgttaagaacgttcaaggaattcgtaccacgtaggtaccagtacaagtaagtcacggccacggccccttggtcggtgtcagtctaagacggtaataaccgtaaccggcctcgtggtacctcctacggacctacttctcgcgtcctaccgaacgtcggggaaccncggacccaccagaccactacaacgacgacgaacccgagggacggagtacgaggtacgngttaacgtacgttatcgttaacgtaggtttcgggacggaaccgtacgacgaccgtaggtacgtagttaccggttacggccgggtccggaacgacggtcgtaccggaccgttacgacgtccgacgccgacggtcctccggtacccgcgtaccncgtccttaccgtccctaccctctacgtacctacgg

SEQ ID NO: 29061 - DNA, 713 bp, Homo sapiens
  misc_feature: GYAE6OF02JYDT6.13.55.E11.1.454.CMB.1.raw
  modified_base (189)..(189): a, c, t, g, unknown or other
  misc_feature (189)..(189): n is a, c, g, or t
  modified_base (221)..(221): a, c, t, g, unknown or other
  misc_feature (221)..(221): n is a, c, g, or t
tcagtcacgtactacacgaccggtgctcgatttagcactcgcacgttgggtttggggactcaggacacagcatggacatgagggtccccgctcagctcctggggctcctgctgctctggcctccaggtgccagatgtgccatccagatcgacccagtctccatcctccctgtctgctatcgtgtacggngacagagtcaccatcaccgttggcccgggtanaacgtcgacggctagttaaggaaatgtaattaggcttaggtaactcgacgactaacggaaaaccgacgggtaaactcccgtaagtccttaccgagtactacgttaagtcgttacgctaacttccgtacgtttcgaacgtaacggttccgggaccctagtaccgaagttacgacggtcgaccgtaggtcgtacgtcgtacggacaagtactcgtaccttacgcaaacgtacgtacgacgtactaccgtacgtacgacgtacgtccgtaaggttaaggttacttttcggaaacctttaaccggtttaatttacccgtaagtaaccgttaaccgaaaccgtttagttaaaccgttacgtcccgttacgttaaccgttacgggtttaacgggaccgggaaacgtaaccgggtaaggtaccgtaaggtaccgtaacgtaaacgtacggtagtacgtcgaacgccgttacgtacgtttacgttacgttaccttaccgg

SEQ ID NO: 29062 - DNA, 686 bp, Homo sapiens
  misc_feature: GYAE6OF02F893R.13.55.E11.1.454.CMB.1.raw
  modified_base (288)..(288): a, c, t, g, unknown or other
  misc_feature (288)..(288): n is a, c, g, or t
  modified_base (620)..(620): a, c, t, g, unknown or other
  misc_feature (620)..(620): n is a, c, g, or t
tcagtcacgtactacacgaccggtgctcgatttagcactcgcacgttgggtttgggggagctctgggagaggagccccagccgtgagattcccaggagtttccacttggtgatcagcactgaacacagaccaccaaccatggagtttgggcttacttgggttttccttgttgcttattttaaaaggtgtccagtgtgaggtgcagctggtagagtcgtgggggaggtggtggtacggccgtcggggggtccctcgagacctctcctgtcgcacctcgtgtattcagtnttagatgagtagtggactactacgtacgtcgggtacccgaccctaacccgtccggaaggggaacgggtctaggccgtaggttcgggtctacggtaggttaactaaacgtaggtaacgttggtcgaccgagaacgtaactaacgttagcgacgtagtaccttcggtcggtagggaaccggtaccgtactaccgaccgtaacttccgaaccgtaaggaccgtaaactaaaccgtttaccggaaaatacccgtacgttctttacgtttctaaacaacgttcaaccgcgttaccgtggaacggcgtaaccgtagaccgacgtacgcgtattacgtntggagagtagacgtacggacccggacctaaacggtcttacccgacgttcgagtccgggtagtccgg

SEQ ID NO: 29063 - DNA, 840 bp, Homo sapiens
  misc_feature: GYAE6OF02GKRUF.13.55.E11.1.454.CMB.1.raw
  modified_base (214)..(214): a, c, t, g, unknown or other
  misc_feature (214)..(214): n is a, c, g, or t
tcagtcacgtactacacgaccggtgctcgatttagcactcgcacgttgggtttggggagcctgggcctcaggaagcagcagtcgggggtgccgcagccatggcctggaccgctctcctgctgacgcctccttgctcactttacagtcttctgtcggccttcctatgtagtgactcgagccactctcgagtcgtcgacggtcgggaccccggganaacggaccggacctaccgtaacttccccgttgacggaaacggtaaaccaaccgtttaagaagtacgaagtaacttcgtacccgtaacgtacggttacccgagtaccgtaagaacgttaccgaccggacccgaccgggttaccccgtgggttcggggttaccgttaccgtaacgttaccggtaaaggttaacggggtaaacctttaaaaaccgggttacccgggtacccggttccgggtttccgggaaacctttccccggttaacggtacccgttactttcccggttacgtccggtaccgttaccgtaaaccggggtaccggaaccgtacccgggacccgtaaccctcggaaccttacacgaacgacgaccgtaaccggaacgggaacgggtagtacggtagcgttaacgacttaagtttacgtacgtacgtaagggtggtacggtacgacgaccacggtacggtacgtacgttacggcgggtacggacgtacgaacggttaccgtacgtccggtaccgttaaggaccgtacggaccggtaacggtccggtacccgtcccgttacgacccgttaccgttcccggttacccgtcccgttccccgtaccgttacggttacgttacccgg

SEQ ID NO: 29064 - DNA, 778 bp, Homo sapiens
  misc_feature: GYAE6OF02GX4OZ.13.55.E11.1.454.CMB.1.raw
  modified_base (363)..(363): a, c, t, g, unknown or other
  misc_feature (363)..(363): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgtctattttaaaaggtgccctagtgtgaggtgcgagctggtggagtctggaggaggcttgactccagccgtgggggtcctgagactctcctgtcgcacgtcctcgtcggttccaccgtcacgtcaacctacctacatacgagtcgttcgggcccgccgacggtcgtaccggacggggagggtcgtggagtcgngttcttattttaacgttagtacgtagtaggtagtactacgtacgtccgaactacgtacctcggtacggacggggtccctacttaccgaccgtacgttaccgtaccaaggaacgtaaccgtaacgttaacccgaaaacgtaaccgtacccgttaccgtttagttttaaccctaaacgtaaacttaacggtaaacccgtcggtacccttaagggaacgggtaaccgtacccgtaacgtaaccggacccggtaaccggggttcccgtttaagtaaccgtttaccgggtagtccggtaacggacggtacggttacggaccgggggtaaacccctaaacgggttaacccgtttaacggtaacccggttagtttaaccggttaccggggtaccgttaccggggtaccgggaaaaccccggg

SEQ ID NO: 29065 - DNA, 720 bp, Homo sapiens
  misc_feature: GYAE6OF02GFKCF.13.55.E11.1.454.CMB.1.raw
  modified_base (294)..(294): a, c, t, g, unknown or other
  misc_feature (294)..(294): n is a, c, g, or t
  modified_base (318)..(318): a, c, t, g, unknown or other
  misc_feature (318)..(318): n is a, c, g, or t
  modified_base (346)..(346): a, c, t, g, unknown or other
  misc_feature (346)..(346): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacgttgggttttccttgttgctatttttaaaaggtgtccaatgtgagctgcagctggtggagtcgtgggggtagtttggacaggccgaggggccggtccctggacgtctctcctagtataacttctggattcaacgttgggntattatggactatgaactgggccncaggctccggaggggacgggcgtagggnggttgggtaggtttcagttaggacgacttaacttcgactagtagagtggggaacaacgaagaacgtacgcgtcgttacgtaaggtaaaacgggcctaaaggtacttaccaaccgtattccgtaacaaacgggtagtaacgtaggtaccgtaccggaaagaactaccgtagttcccggttacccttttcggacgttacaacgggttactaggggtaagtacccgggtactaacgggtaaaccggaaccgggttaacggaacccgtacaaccgggaccttagttcccgtttaacgttaaccgtggtaccgtaaggtttaacgaacggtttacggtttaacttaccggaccgttacggttacccctaacggtaccgg

SEQ ID NO: 29066 - DNA, 784 bp, Homo sapiens
  misc_feature: GYAE6OF02JDSGT.13.55.E11.1.454.CMB.1.raw
tcagtcacgtactacacgaccggtgctcgatttagcactcgcacgttgggtttgggggactcaggacacagcatggacatgagggtcccgctcagctcctggggctcctgctgctctggctcccaggtgccagatgtgccatccagatgacccagtctccatcctcctgtctgctatctagtaggagacagtacgtcaccatccacgttcggccgggtacaacgtccgagggactagttaagtaaatagtacgtttaggtacttggtactcgaagacgaaacggaaaccgtaacggggaaacgtacccccgtaaagtcccttagttacgtaacttacgttaggttaggtcgtaccgtaacttaaccggtttaaaagggtttaaaaacggtccgggtttaaccccaggtttaccgtaaacggggtttacaacggtacgtacgtacggtaaggtcggtacgtacgtacgactacgtacgttacttacttacttaccgtacacctagtactacgacgaacttccgagcgtacgaccgttagaccgtttaatttcgtaacctttaagtttaccgttcgtaaccttaataaccgtaacttaacgtactactttaaccgttacgttccgggttacggtttaccgggtaaccggtaacgggaaaccgggttaacggaaccgggttaaggtaaaccggttaaacccgaacgggtttaaccgttagggtaaccggttactacccggttaacctacccggttctttaaccgggttacctttaccgttaacccgg

SEQ ID NO: 29067 - DNA, 670 bp, Homo sapiens
  misc_feature: GYAE6OF02HPRQ6.13.55.E11.1.454.CMB.1.raw
  modified_base (373)..(373): a, c, t, g, unknown or other
  misc_feature (373)..(373): n is a, c, g, or t
  modified_base (399)..(399): a, c, t, g, unknown or other
  misc_feature (399)..(399): n is a, c, g, or t
tcagtcacgtactacacgaccggtgctcgatttagcactcgcacgttgggtttgggggatgctttctgagagtcatggatctcatgtgcaaagaaaatgaagcacctgtggttcttcctcctgctggtggcggctcccagatggggcctgtcccagctgcagctgcaggagtcgggccaggagtggtgaacgccttcgggacgtaccctgttccctctagttgtaatgtgttctgggtcgcctacctaaggtagactacttactactggggctggatccggcacgcccccgaaggggaacgggcgtggaggtggagttggggattagtcttcttagtaggtgggagtaacggaactaacacgtcccgtcctanaacgagtacgagtcatcatatccganacagtccaggaactattcctcctagtaagtgtagttctgtacgtaccgtcgacgtaagaccgtaacggtcttacggttacttaacgtttaagtttggtacgtacggtaacggtaccggactaaaagttacgttacgggttaccgaaggggttacgtttaccgaacggttacggtcggggtaacccggtaacgggtaaccccgttcgggtaacccgttacccgttccgttacccgtcgaccgttaccctacccgaaccggaccggtaccccg

SEQ ID NO: 29068 - DNA, 729 bp, Homo sapiens
  misc_feature: GYAE6OF02GDOM6.13.55.E11.1.454.CMB.1.raw
  modified_base (511)..(511): a, c, t, g, unknown or other
  misc_feature (511)..(511): n is a, c, g, or t
tcagtcacgtactacacgaccggtgctcgatttagcactcgcacgttgggtttgggggagcctgggcctcaggaagcagcatcgggggtgccgcagccatggcctggaccgctctcctgctgagcctccttgctcactttacagcttctgtggcctcctatgagttgactcagccactctcagtgtcgacgtcggacccggacaggacggccaacaactttcccgtgtaggaacgggaaacctaaaccgttaggaacgttcaaggtaactcgtacctaacgtcgggtaaccaggacaaggaagtacgacggaccaacgggtccccctggttggtacggtacgtacgttacgtagttaacggggtaattaaacggtaaccccggtcccttacgttcggggaacttccccgtaggaccggttactttctcgttcggtcctaccgaacggtacggggaaccaccggccaacccgtcgaaccactaccaacgaaggaccaccgaaggacgggganacggagtcgtagacttattagttcgacgaggtaggacggactacggacctaccggtacggtagtacgttaacgtccgggtcgggtaccggacgtaacgccgttacggacccgttacgtcggtaccacggtaacccgaggtcccgtccggaccccgtcggtaccctacgtaccctttcccggtaccccgttaccctaccggttacgtaccggttaccgg

SEQ ID NO: 29069 - DNA, 857 bp, Homo sapiens
  misc_feature: GYAE6OF02GPLL6.13.55.E11.1.454.CMB.1.raw
tcagtcacgtactacacgaccggtgctcgatttagcactcgcacgttgggtttggggtgatcaggactcctcagttcaccttctcacaatgaggctcctgctcagctctgggctgctatgctctgggtcccaggactccaggtgggatgttgtgatgactcagtctccactctcctgcccgtcacccgttggacacgccggcctacctacttcctccgtacgcctaggttactacgtaccaaacgtcctacgtaatacgaggtagtagtacggaaacttaccctaagtttacgtaaattttcgggtttaacacggtacaggtacggacccgtagggtccctaaggttcccgtaaccggaacggtcccgtaaccttttaaaagttttaacgttaacgttttcccggggttttaaacccgggtccttaccgggtttccggggtacccctaagaccgtaaggttaccgttacgtacgggcgtacggtacgggttccgggtacacggtacctaacgttgttaacgtttccaacggttaaagtttaaccgtaaacgtccggttaaacggaggggttaggtaccgtacgtgggtaacggttagtttaggggttaacggttaacttttacgtacggttacgtacccggtagtacgttaaccgtaacgttaccttaacgtacgttttaccggtaaccgggttttaccctttaccgttaacccggtttccccggaaacgttaccggggtaaacccgtttaagggtaacggtaacccgttaaccgttaaacgggtttccaaacggtttacggggtctaacccgtacggttacccccaaggttttcttcccggttaagttttccccgg

SEQ ID NO: 29070 - DNA, 586 bp, Homo sapiens
  misc_feature: GYAE6OF02GDZ9T.13.55.E11.1.454.CMB.1.raw
  modified_base (323)..(323): a, c, t, g, unknown or other
  misc_feature (323)..(323): n is a, c, g, or t
  modified_base (413)..(413): a, c, t, g, unknown or other
  misc_feature (413)..(413): n is a, c, g, or t
  modified_base (509)..(509): a, c, t, g, unknown or other
  misc_feature (509)..(509): n is a, c, g, or t
tcagtcacgtactacacgaccggtgctcgatttagcactcgcacgttgggtttggggagcctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggaccagaccagccagcatcacctgctctaggaaattaattggacaagtaataaattattaaccttcctaggtatcagctaagaagtcgacggccacgttccccgtgtcgctcggtactactctanacgaagtacgtcgaccgaacgccggaccctaggacggactcccgtagacgtccgtattccgtcgtcgcctaccgtacgttcgacggtacnccgaacgcctactctacgacacgtccgacggaccggacccgacgtccgtatcggacgtggacgtctacgtacttagtcgtgtcgaggtcgacgacngacgacgcacgtcggtacctgtacgttcgtacgttacgacggtacggaccgtacgtccgtacccgtacgtacaccgg

SEQ ID NO: 29071 - DNA, 920 bp, Homo sapiens
  misc_feature: GYAE6OF02GY1I8.13.55.E11.1.454.CMB.1.raw
  modified_base (226)..(226): a, c, t, g, unknown or other
  misc_feature (226)..(226): n is a, c, g, or t
tcagtcacgtactacacgaccggtgctcgatttagcactcgcacgtttgggtttggggagcctgggcctcaggaagcagcagtcgggggtgccgcagccatggcctggaccgctctcctgctgacgcccttccttgcctctacgtttacagtcctttctggtcggtccctctatgtagttcgactcagccctactctcagttcgtacgaggtcggacccccggganacggaccgggcccaacgtaacctttcccgtggtagggaaacgggtaaaaccctaaaccgtttaaggaaacgttccgaaaggtaacgttcggtacccctacggttaccggtaaaccgaccggactaacgggtaaacgtcggaaccggggccccgtaaccgggtccccgtttaggggttcggtacggttactaacgggttactaagggtaacgggtaaacttaaacccggtaaccccgggttcccctaggttaccggggtaaccttcccccggtagggtacccctttaacgttcccggttcggtaccggtacccttaacccgggaaaccgggtttaacccgggggaaccgttaaccccgggacccctaaccccggttaaccggaacctaaaccgtacccgtaaaaccgaacgacccgggtaaacccccggtaaaggggtacgggggtaacctaacggggtaacggtaccgtacggttaaacctttaacgttacccgttaagggttacccggtagggtacccggggttaaggtacccgaacgggtaccgtagacccgtaacgtccgtaccggttagtacgtccgttacgaccgggtaactacggaccgttaacgaccgttaccgtacgtacggaccgacgtaccgaaccgcccgtaacccttcgtacgtcctaccgtcttacccctacctcccgtcg

SEQ ID NO: 29072 - DNA, 851 bp, Homo sapiens
  misc_feature: GYAE6OF02I5L9K.13.55.E11.1.454.CMB.1.raw
tcagtcacgtactacacgaccggtgctcgatttagcactcgcacgttgggtttggggactcaggacacagcatggacatgagggtccccgctcagctcctggggctcctgctgctctggctcccaggtgccagatgtgccatccagatcgacccagtcctccatccctaccctgtctcgctatctggtacggagacaggactcacctatcacgttcggcccggataacgtcggaggacttaattaaagaaacttgtagttttacggcgttaggttaactcgaacgtaacgaacggaaaacccggaacggggtaaaaccgtacccccgttaagtaccgtttcgttacggtaacttacgtttaggttacgggttcgaaccgttacttaaccgttaaaacgggtttttaaaaacggtccggggttacctaacgttaaccgtaacgggttacgacggacggacgttacggtaggtacgttcggacggtaccaacgttaaccgttacgtttactaacgtttccccgtacctaacccgttacgtaccaaccgggtccaaccggttccgtaaccgtcgtaacccgtacgttaaacggttaccgtttaacgttttaccgtaaccttttaaacgtttttacgttaaccggtttacttaaacgtaaaccctaagtaaccgttacttaaaccggttaaccttttaccggtacccgttaaccggggttaccgtttaaccggaaaccggttaaacgggtaacggtaacggtaacgtaacgttaaacggaaccggttaacggacggtacggttaccgacgtaccgttaacctacggtttccttacgttacgttaccttaccccgg

SEQ ID NO: 29073 - DNA, 865 bp, Homo sapiens
  misc_feature: GYAE6OF02ID2BB.13.55.E11.1.454.CMB.1.raw
  modified_base (567)..(567): a, c, t, g, unknown or other
  misc_feature (567)..(567): n is a, c, g, or t
tcagtcacgtactacacgaccggtgctcgatttagcactcgcacgttgggttggggactcaggacacagcatggacatgagggtccccgctcagctccgtgggcctctgctgcctctggcctcccgagggtcgaccctagagtcggtacgaccctacgtacccgaagtacgttaccggaacccctaggttaccctaccgtaccgttcccctacccgttgtcctacgactacgtcggtaggtaacggacgacgtacgaccgtacaccctatacgtaccggtccgggaccgtacgtaacggtacggtaagggtaccttaagttaacgtaagttggttaacgttacggtcgttaaccggtataccgaggtaaccgaaacggaaccgtaacgggtaaccctacctagttaccgttaccgttagtaccttacggttaggtaccggtaacgtaaccgttaaccggttaaaccggtttaaaacgggtttaaccgggtacccgtaacgttaccggttaaacgtaccggttaccgggaccgtaccgggtaagtacggttggtacctaggtaaccgngttaaacccgaggttaccttaacttacggttaccaacccgtagttacccggacgtaccggtcctaaccggtacgtacgacccggtacgtaacggtacgttacttaacgttactaacgtttaacttaacgttacgtcgtaaactaccgaaacttcaacgttaactcgtaccgttacggacggtttaccgaaccgggtaacgtaacgggacgttaacgaacgtacgtaacggtacgacggttacgacccgttagtacccaccgttagttaccgttcgtacccgttcgtaccgttaacccg

SEQ ID NO: 29074 - DNA, 672 bp, Homo sapiens
  misc_feature: GYAE6OF02FR6AT.13.55.E11.1.454.CMB.1.raw
  modified_base (290)..(290): a, c, t, g, unknown or other
  misc_feature (290)..(290): n is a, c, g, or t
tcagtcacgtactacacgaccggtgctcgatttagcactcgcacgttgggtttggggagcctctgggagaggagccccagcccgtgagattcccaggagtttccacttggtgatcagcactgaacacagaccaccaaccatggagtttgggcttacttgggttttccttgttgctaattttaaaaggtgtccaatgtgagctgcagctggtgagtcgtgggggaggttggtacagccagggcgtcccgtgacgactcgtcctgtatacttctggactctaacgttgggtnattactgtactatgaactgggtcctcgagctccgagggagggctaggagtgggtagttcagttagagctaagttcacgatgatgggacacgagtaatacgccgtacgtccgtaagttaaacggacctaggtaacttacctaaccctaataccttaaccgaacggtaaggtaagtacggtaacgtccctaaaggagtacccgtataacccggttccttttccgtacggacctacgggtactacggacgttaacgtcccgtaacgggaacgaacccgggacggtaaaccaaccgaacggtacccctaatcccgttaacgttaacgtcgttagggaactacggaaggttacaacgtttcgaagtaccgttaccgtaccgtaccgg

SEQ ID NO: 29075 - DNA, 667 bp, Homo sapiens
  misc_feature: GYAE6OF02HCXPV.13.55.E11.1.454.CMB.1.raw
  modified_base (188)..(188): a, c, t, g, unknown or other
  misc_feature (188)..(188): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (373)..(373): a, c, t, g, unknown or other
  misc_feature (373)..(373): n is a, c, g, or t
  modified_base (375)..(375): a, c, t, g, unknown or other
  misc_feature (375)..(375): n is a, c, g, or t
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
  modified_base (475)..(475): a, c, t, g, unknown or other
  misc_feature (475)..(475): n is a, c, g, or t
tcagtcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacgttgggttttccttgttgcttaattttaaaaggngtccaatgtgagctgcagctggtggagtcgtgggggacgttttgggacagccgaggggcggtccctgagacttctcctgtattaacttctggattcaacgttggggtnattangcttangtaactcgggtcccncgnggctccggaaggggagggctgggagtgggtagttcagtggagctatcnancgagtcggacaacagatacgcgacgtataagaaagctagtcttacacctntacacgtaangtagtgaacggtcaaggacgctactccggtactttgacgntaacgtgtaacggtaggtacccgtcgtaaagggaaccggtaaccggaaacggaccgaaccgtacggaacccctaagtttaccccttaacgtttaaaccggtttcggaaaccgttagtaaaacccgggttattaaacccggtttacgtttcggaaccccggttaaaccgggtttcccaaaccggtttccccgg

SEQ ID NO: 29076 - DNA, 789 bp, Homo sapiens
  misc_feature: GYAE6OF02JNNNP.13.55.E11.1.454.CMB.1.raw
  modified_base (618)..(618): a, c, t, g, unknown or other
  misc_feature (618)..(618): n is a, c, g, or t
tcagtcacgtactacacgaccggtgctcgatttagcactcgcacgttgggtttgggggatgcttttctgagagtcatggatctcatgtgcaagaaaatgaagcacctgtggtttcttcctcctgctggtggcggctcccagagtggggcctgtcccagctgcagctgcaaggagtcgacggcccgaggagtgggtagaacggccgttcgggacgccctcggtcccctagtagttgtaacgttgtcgtcgtggtcgtcctacccgtaaggtacggaacttacgttacgtacgtcggtcgtggtacgtccggtcgaccggtcccccggaaggggtaacgggcggttaggtcggtagggtacggtaggggtattacgttcgttgtttacggtagggtacggggtagtaccgtaacgtaaccgtacgttcccggtacctaacggaactacgggtacggtaacgtcctaagtacgtaacgttacgttaacggggtacggtaaacggtacgggtacccggtaaagggtaaccgttaaccggtaccgtttaccgaacggttaacggttagtaacggttccgtacggttaccgggtacctacgtaccgtaacggaacgtaccggtntaacggttacttacgtagttcgtacgacggtacggacgtaacgtacgtacgttggtaccggtaggttaccgtacggtacgtacggtaccggtacggttaaccgggtaccgtacggtaccgttaccgtccgtaccgtaccggtaccgtacccgttaacccggccgaacccgg

SEQ ID NO: 29077 - DNA, 955 bp, Homo sapiens
  misc_feature: GYAE6OF02H7MII.13.55.E11.1.454.CMB.1.raw
  modified_base (206)..(206): a, c, t, g, unknown or other
  misc_feature (206)..(206): n is a, c, g, or t
tcagtcacgtactacacgaccggtgctcgatttagcactcgcacgttggggtttggggagctctgggagaggagccccagccgtgagattcccaggagtttccacttggtgatcagcactgaacacagaccaccaaccatggagtttgggcttacgtttgggttttccttgttgtcttaatttaaaaggtgtccagtgtgaggtgngtaggttggtggagtcgtgggaggaggtcgttcgggtccgaggggtccccggggggggttccctagggacggtaccgttcgtactagtggtggccggtcctcgtgggcctaccgacccgtctaaaccgaaccctaaacgttaccgaagtcggaacggtccggttacggggttaccccgccccgtaagggtccccgttaacccggaacggggaacggaaccggggtacccgggtagggttaccggggtaccttacggttaagttttaacgttacggttacgggtaccggtacgggtaccgtacccgtaacttacgttttaacgaccgtaccgaacggttacccgttaccgggacggggtaccgggggtaaccccggttacacccgttaccgtaccgttacccggacgttaacggtaaacctaaccgtttaaaccaaaccgggtaaaccggttaaacggttcgttaaacgtttcccgttaactaaaaccggttacggtaaacccgttaccgtaaacgggaagggttaaccggtaaccggggaaccggtaaaccgggttaacccgggtaaccccggtttacgtttaaacgtttaaccgtacggggttaaccgaaccggttaaaagtaccggtacgtaacgggaccgggtaacgggtaccccgggtaacccgttaagggtcggggtacccggttagggtaccgggttacggtttcttaccgtttacgggcgttaccgggcgggtaacccgggg

SEQ ID NO: 29078 - DNA, 928 bp, Homo sapiens
  misc_feature: GYAE6OF02I1VF0.13.55.E11.1.454.CMB.1.raw
  modified_base (170)..(170): a, c, t, g, unknown or other
  misc_feature (170)..(170): n is a, c, g, or t
tcagtcacgtactacacgaccggtgctcgatttagcactcgcacgttgggtttggggtgatcaggactcctcagttcaccttctcacaatgaggctccctgctcagctccgtggggctgctaatcgctcgtcgggtacccgaggacttccgaggtcggggattggttggngtaatgacctacgtacgttcctcccaccttccctccccttccggtaccccgttccgtaccccggttacggaccgaccggcccccgggtccccttaccgacttcccttccgtcggaccgttacgggttaccttacggtaaccaaaccggtcccttacgtaactaacgaggtacgtaagtaacggtaaaccgtaaccttacgttagtaacgttttacgggttaccgaacgccggtaaggacggacccggtaccggtaccgtaccggttacccgtaccggaaggtaccccgttaaaccttttaaagtttaaacgtttaaaccggtttttacccgggtttttaaaccccggggtactttacccgggttcccgggggttaacccccaacggttaactaacgttacggtaaccggtacggggtaccgggtacggtagggtcgggtaacacgggtaacctacggttacggtttaatttaccgtaaactttaacggttaacaaaaccgtaccggaacgggttagggtcggtaagggcgtaagggtacgttacgggtttgggtacgtttagttaaccgttattacggtaactacgtacggaccgttaacgtccgttaacttaccggtttcgttacccgtttaccgtttaccgttccggttacccggttaccggtacgtaaaccggttagtaaccgtaaccggtaaccttaacgtacggtaaccggttggaccttccgtacgtaccctagttaccttcggtctttccg

SEQ ID NO: 29079 - DNA, 528 bp, Homo sapiens
  misc_feature: GYAE6OF01C5R25.42.15.B04.1.454.CMB.1.raw
  modified_base (291)..(291): a, c, t, g, unknown or other
  misc_feature (291)..(291): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctggggcccccagggcagagggtcatcatttctgcactggggatggttccaacagtcggggctaggttttgatgtacactggtaccagcagcttcagaacncgccccaagctctcatctttagaacaataatcgcctcgacgggtccctggccattctctgcctccaagtccgcacctcacgccctccctggcccatcacgtccgggcctccaggctgaggatgaggctagtacttattactgcctagttacctatacgaaccaacacgaccttccggtgtcgtttggggttcgttcgggcgggacgggaccaaggcctacggcccgttcgtaacggg

SEQ ID NO: 29080 - DNA, 506 bp, Homo sapiens
  misc_feature: GYAE6OF01BN96A.42.15.B04.1.454.CMB.1.raw
  modified_base (417)..(417): a, c, t, g, unknown or other
  misc_feature (417)..(417): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctggggccccagggcagagggtcatcatttcttgcactggggatggttccaacatcggggcaggttttgatgtacactggtaccagcagcttccagaacagccccaagctcttcatctttaggtaacaataactcggccctacgacggggtccctggccgtattctctcgcctccaagtccggcacctcacgccctccctggcccatcactcggctccaggctgagntgagctgattactactgccagtcctatcgaacacagtacctccgtgtcgttgggtcgtcggcggacggaccagctcgaccgtcgtacgg

SEQ ID NO: 29081 - DNA, 592 bp, Homo sapiens
  misc_feature: GYAE6OF01EGQAR.42.15.B04.1.454.CMB.1.raw
  modified_base (446)..(446): a, c, t, g, unknown or other
  misc_feature (446)..(446): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctggggccccagggcagagggtcatcatttcttgcacgtggggatggttccaacagtcggggctaggttttgatgtacactggtaccagcagcttccagaaaccacgccccaagcctcttcattctttaggtaaacaataactccggccctcgacggggtccctggccgtattctctcgccctaccgaacgtcccggcaccctcaccgtccctcccgtcggccctatccgagtccgggctccgaggcctggacggngtacggaggtctagtaactttagttacctcgaccgtagttccctacgtacgaaaccaaccgaacgtacccttccggtcgtacggtttcggggtcggttaccgggcgggaacgggtaccaaggcccgtcggtacccgtccgtaacgg

SEQ ID NO: 29082 - DNA, 573 bp, Homo sapiens
  misc_feature: GYAE6OF01CFX9Y.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctggggccccagggcagagggtcatcatttctgcacgtgggatggttccaacatcggggctaggttttgatgtacacgtggtaccagcagcttccaagaaaccacgcccccaagcctcttcattcgtttaggtaacaataactccggccctcgacggggtccctggccgtattctctcgcctaccgaacgtcccggccacctcacgccctcccgtcggccctatcacgtccgggcctccgaggcctggaggtagtggacggtctaggtatttagtacgtcgtcctacgttcctatacgaaccaacgtacgtacctccggtcgtcggttgggtcgttccgggacgggtacgggaccgtaggacctcggtaccgtccggtaacgg

SEQ ID NO: 29083 - DNA, 648 bp, Homo sapiens
  misc_feature: GYAE6OF01AJHI9.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctggggccccagggcagagggtcatctatttctgctacgtggggattcggttccaacgagtcggggctaggttttgatgtacacgtggtaccagcagtcttaccgaagaaccaccgacccccaagtccttacttacactttacgtttacggtaaactaaattaacgtccggtacccctacggacggggttcccctgggtcccgtatttccgtccgtcgtacccttaccgaacggtccccggacctacccgtaccgacgtcccctcccgtcggccctaagtccgacgtcccgggcctccgacggctaggacggagtaggacggtctaggtaactttacgttaccgtcgtacctagtccctagtacgaccagaccgtaccttccggtgtccggtttggggtcggttccgggacgggtaacgggtacccgtaggtacccgtcggacccgttcgtaaccggg

SEQ ID NO: 29084 - DNA, 653 bp, Homo sapiens
  misc_feature: GYAE6OF01CV7JP.42.15.B04.1.454.CMB.1.raw
  modified_base (279)..(279): a, c, t, g, unknown or other
  misc_feature (279)..(279): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcacgcccgccctcagtcgtcgtcggggcccccaggggccaggagggtcatctatttctgcacgtgggatcggttaccaacgagtcgggctaggttttgatgtacnctggtaccagcagtccttacaagaaaccaccgaccccaagtcctcttacattcgtttaggtaaactaataacgtccgccctacggacggggttccctcgggtcctatttccgtctcgcccttaccgaacggtcccgctacccgtccaccgtcccctcccgtcggccctagtccacgtccggtcctccgacgggtctacgggaggtagtcggtaggtcttagttaactttagttaaccgtcgaccgttacgttacccttagtaccgaacctaacgaccgttaccgtcccggtggtccggtttcggggttcggttccggggaccgggtaacgggacccgtaacggtccgtacccggtacccgtccggttaaccggg

SEQ ID NO: 29085 - DNA, 544 bp, Homo sapiens
  misc_feature: GYAE6OF01A9G3M.42.15.B04.1.454.CMB.1.raw
  modified_base (423)..(423): a, c, t, g, unknown or other
  misc_feature (423)..(423): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctggggccccagggcagagggtcatcatttctgcactgggatggttccaacatcggggcaggtttttgatgtacactggtaccagcagcttccagaaacacgccccaagctcttcatctttaggtaacaataacgtcggccctcgaggggtccctggccgtattctctcgcctccaacgtcccggacacctcacgcctccctcggcccatcagtccggctccgaggctgaggntgacgtctgtattacgtacgtgcctagtcctagtcgaaccacagaccttccggtcgtcgtttgggtcggttccgggccgggtaacgggacccacggaccgtcggacccgttccgtaacggg

SEQ ID NO: 29086 - DNA, 785 bp, Homo sapiens
  misc_feature: GYAE6OF01DGRHM.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctccgtgggcccagtctgtgctgacgcacgccgccctcagtcgtcgtcggggccccagggcaggaggtcatctatttcttgcctacgtggggacttcggttaccaacgtaggtcggggtacttagggttttagagttacgtaccgtacgttacgggtacccaggctaacgtccgttacccgaagaacccaccgtacccccgtaattccttaccgttactacgtttaccgttttaacggtaaaacctaacgttaaaccggtccccggtacccggttaccggtaaccgggggttcccccttacgggtaccccgttaactttccgttaccgtccgtaccccgtaacccgtaccggtccccgggacctaacccgttcgtaccccgtcccgttccccgtacgggtacccctaacgttcccgtaacgggttccccgggacgttaccccggtagggtcccggtaagggtacggtacggttacggtacggttcgtttaagtaaccttttacgttaccgtacgtacccgttaacgttacctaacgtacgaaaccgtactaccggtccgttccggtggttaccggtttggggtccggtaccgggacggacggtacctacggtaccgtccgtacggtcggtaaccgg

SEQ ID NO: 29087 - DNA, 640 bp, Homo sapiens
  misc_feature: GYAE6OF01EMHYG.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtcgtcggggccccagggcagaggtcatcatttctgcacgtggggatggttccaacagtcggggctaggttttgatgtacacgtggtaccagcagcttaccgaagaaccacgcccccaagctcttactacttcgtttaggtaacaataacgtccggccctcgacgggtccctcggccgtattcctctcgcctaccgaacgtcccgacaccctcaccgccctcccgtcggaccctactccgacgtccgggccttacccgaggtcctaggaggtacgtggacggtcttagtaactttacgttacgtcgtacccgtagttcccgtagtaccgaactaacgtacgtaccgttccggtcggtccggtttggggttcgggtttacccggggacggggtaaacccgggtaacctaaacgggtcccgtttaaccgggtaccccggttccggtaaccgggg

SEQ ID NO: 29088 - DNA, 652 bp, Homo sapiens
  misc_feature: GYAE6OF01CNNK7.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcacgccgccctcagtgtcgtcggggccccagggcaggagggtcatctatttctgctacgtgggatcggtacaactagtcggggctaggtttgatagtacacgtcggtaccagcagtccttaccgaagaaaccaccgaccccaagtccttcttacacttcgtttaaggtaaactaaacttaacgtcccggtaccctacggtaccgggttccctcggaccgtaactttcctcgtcgacccgtacccgtaacggtcccggacctaacccgtcgaccgtcccccttacccgtcggaccctaacgtccgacggtccgggcctaccggaggtcctaggacggtatcggacggtcttagtaatttactacgtcgaccctaacggttccataacgaacctaacgactccgttccggtgtcggtttggggtccgttacgggacgggtaacggaccgtaagtcccgtaacggtcccgttcgtaaccgg

SEQ ID NO: 29089 - DNA, 615 bp, Homo sapiens
  misc_feature: GYAE6OF01EVTNS.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctcggggccccagggcaggagggtcatcatttctgcacgtggggatggttccaacagtcggggctaggttttgatgtacacgtggtaccagcagtcttaccgaagaaaccacgcccccaagtcctcttcattcgtttaggtaacaataactccggcctcgacgggtccctggccgtattctctcgccctcaacgtccgactacctcacgccctccgtcgcccatcgacgtccgggctaccgaggctaggaggtatgggacggtcttaggtaactttacgttacgtcggtaccctacgttacctagtacgtaaacctaacgtacggtaccgttccgggttggttccggtttgggggttcggttaccgggggacgggtaaccgggtaacccgaaggtccgtaccggtacccggttccggtaaccggg

SEQ ID NO: 29090 - DNA, 755 bp, Homo sapiens
  misc_feature: GYAE6OF01ALJF2.42.15.B04.1.454.CMB.1.raw
  modified_base (147)..(147): a, c, t, g, unknown or other
  misc_feature (147)..(147): n is a, c, g, or t
  modified_base (167)..(167): a, c, t, g, unknown or other
  misc_feature (167)..(167): n is a, c, g, or t
  modified_base (188)..(188): a, c, t, g, unknown or other
  misc_feature (188)..(188): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacnggctcgtggcccagtctgtnctgacgcacgcccgccctacncggttcgtccgtcgggggacccccaggggtaccaggaccgggtcacgtcctagttttccgttggaccgtaccggttggggtagttccgggttaccctaaacggtcggtcggggtacgttaacgggtttttgaacggttagtaccgtacggtacggttacccgaaggtcgtaacgtccttaaccgaacgtaaacccgaccgaccccgtaacgtccttcttacctagttttaccgttacgtaaacctaacgttaacgtcccggtaccctacggtacccggggttccctacggccggttaacttcccgtgtcccgtccttacccggaaccgttcccgaccgtaacccgtccgtacccgtcccgtaccgtccggcctaacgttccgtacgcccggtaccgtcccgaaggtccctagggaccgtactgaaccgggtcttaggacttttcggtactcgacgttacttcctagaccgtaacacgtgttacccgtccggtcgttaccggttggttaccgggtccgggaagtaccggacttaaccgggccttacggggtcccttccgggtaaccgg

SEQ ID NO: 29091 - DNA, 698 bp, Homo sapiens
  misc_feature: GYAE6OF01AEBX5.42.15.B04.1.454.CMB.1.raw
  modified_base (134)..(134): a, c, t, g, unknown or other
  misc_feature (134)..(134): n is a, c, g, or t
  modified_base (493)..(493): a, c, t, g, unknown or other
  misc_feature (493)..(493): n is a, c, g, or t
  modified_base (687)..(687): a, c, t, g, unknown or other
  misc_feature (687)..(687): n is a, c, g, or t
tcagtgacgtatgtcacgaccggtgctcgatttagacagtatatatccgcgggctgcttcagctgtggcacaagaggcagcactcaggacaatctccagcatggcctggtctcctctcctcctcactctcctcnctcactgcacagctcctgggccctagtctgtgctgacgcagcccgcctcgagttcgtccgtacggggcccccagggccagacggggtcacttctattttcttggcctaacgtggggtattcggttacccgaacgtcggtcggggtacttaagggtttttggacttagttaccgacgttacggtaccgtacggtacgtaacgcccgtttaccgaagtaaaccccgacggtaccccccaaaggtcctacgttcctaattccgtttaacggtaactataaaccgttggaccccttcggtaacggtccctgggtacctacgtttcgttcccgtcgacccgtacccgaacggttcccgtaaccncccgttcgaacccgtccttaccccgtggttaccccaccgttacaccggtcccgggtacccttcccgggacgacgttccggaggttatcgggactcgtgtaactttacgtcctcgacttcgtacagtacactacgcttcctacgtcgttagttcggtcggtccggtagggtaccggatacgtccgtctaaccggnttaacccgggg

SEQ ID NO: 29092 - DNA, 736 bp, Homo sapiens
  misc_feature: GYAE6OF01ELFUD.42.15.B04.1.454.CMB.1.raw
  modified_base (328)..(328): a, c, t, g, unknown or other
  misc_feature (328)..(328): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcacgcccgccctcgagtcgtcgtcggggccccagggcagaggtcatctatttctgcacgtggggattcggttaccaacgtgtcggggtactagggttttgacgttgtacctacgtacggtacccaggtcacgtccttaccgaaacgtaaacccncccgaaccccgaagttccttacctttactacttttaccggtttaacggtaaaacctaaacgttaccggtcccggtacccgttacgggtacccggggttccccgtcgggtacccgttactttcctaccgttccgaccctaccgtaacggtcccgacctaccgtccacccgtcccttccgtcggacctacgtccgacggttccgggccttccggacggtcgtacgggagtacgtcggacggttactaacgttaagtttaccttaccgttcgtaaccttacgttacctagtaaccgaacgaaccgaccggttaccgttccggttcggtttacgggttggggtcccggttacggggaccgggaaacggttaccgacggttaccggtacccggtaccgttaccgggtaaccgg

SEQ ID NO: 29093 - DNA, 735 bp, Homo sapiens
  misc_feature: GYAE6OF01A8DPP.42.15.B04.1.454.CMB.1.raw
  modified_base (331)..(331): a, c, t, g, unknown or other
  misc_feature (331)..(331): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctggcccagtctgtgctgacgcacgcccgcctcgagtcgtcgtcggggccccagggcaggaggtcatctatttctgctacgtggggtattcggttaccaacgtacggtcggggtacttaggttttgagttcgtaacgtcgttacggtaccagcgtacgtccttaaccgaagtaaacccnccgaccccctaagtccttacttacgtaactttacgtttaacggaaacctaacgtaacgttcccggtacccgttagggtacccgggggttccctacgggtacccgttacgtttcccgttaccgtccggtaccccgttacccgtaaccggttccccgggacctaaccccggtccgtaacccgttccccgtaccgtacggtacccacgttccgtaccggtcccgggtacctaccggtaacggtcgttacgggacggtacgtacggacgtacgttagttaactttacgttccgacgtaccttacgttactacgtacaaccgaacgtacgtaccgttcgtcggttcgggtacgggttcggaccgggacgggtacggacgtacgtccgtacggtacccgtcggtaaccgg

SEQ ID NO: 29094 - DNA, 708 bp, Homo sapiens
  misc_feature: GYAE6OF01AKGDZ.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagcccgccctcagtgtcgtcggggccccagggcaggagggtcatctatttcttgctacgtgggatcggttccaactgtcggggctaggttttgatgtacagtcgtaccagcacgctaccagaacacgacccccaagtcctctctattcgtttacggaactaataacgtccggaccctcgtacgggtccctggcctacttctctcgtccctaccgtaacgtcccggacctaccctcacgtccccgtacccgtcggaccctacgtccgtacgtcccgggtacctcccgacgggtcccgtaggtacgggtacgtacgggacggtaccgttaggttaaccttttacgtttaccgaccggttacccgtaacggttacccttaacggtaccgtaaacccaaccgtaaccggttaacccgttccgggttacgttcccggggttttacgggggttccggggtttaccggggaccgggtaaccggggtaaaccctacgggtacccggttacccgggtccccggttacccggttaacccgggg

SEQ ID NO: 29095 - DNA, 649 bp, Homo sapiens
  misc_feature: GYAE6OF01BOEQH.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctggggccccagggcagaggtcatcatttcttgcacgtggggatggttccaacgatcggggctaggttttgatgtacactggtaccagcagctcagaacacgccccaagctcttcatcttaggtaacaataactccggccctcgacggggtccctggccgtattcctctcgcctcctaacgtcccggcacctcacgccctcccgtcggccctatccgacgtcccgggcctcccgaggtccgtaggacggtacgtgggacggtcgtacggttaacttaacgtttaccgtacggtacccgtaacggttacccttaacgtacggaacctaaaccgtacggtaacccgtttccggtacgggttccggtttacggggggtccggtttacccgggggacgggtaaccggggacccgtaaacgggtcccggttaaccggtaacccgggttcccggttaacccgggg

SEQ ID NO: 29096 - DNA, 922 bp, Homo sapiens
  misc_feature: GYAE6OF01C287F.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtcctcctctcctcctcactctcctcgctcactgcacgcggtctccgtgggcccagtctgtgcgtgacgcgacgcccgtcctgaggttccgtccggtccgggggacccccgaggggacgaacggtacggggttacctacgttacgtttaacgtttttccgtacggtaccgtacgggttacgggggttacgttaccggttacccgtaacggtacggggttaccgggggttaccgtttaggggttttacgacggtttaccggtaccgtaccgggtacgtacccggacgtaccaccggtaccttaaccggaaacgaacccgacccgacccctaattccgttaccttacgttaccgtttagttaacgtaacgtaaaccgtaaccggttcccggtacccggttacgggtaccgggttacccgtcggttaaccgttaccgttcgttaccgtacccgtaccgtaacccggtaaccggttccccggtaccctacccgtacccgtacccgtacccccgttaccggtacccgttacccgaccggttacccgtaccgggtttccccggtaacccgtccgggtaacggtaccgggttagggtaacggtaccggttagggacccgggtttaaccgttaagttaccgtttaaccggtaccgttaccggtaacccgtttacgttaaccgtacgtaaccggtaaccgaacgtacccggtttaccgtcgggtacggtttcgggggtttacgggtaccgggttaccccggggaaggtacccggtaaaccgggtaggttccccgtcggggttaaacctcccgggtaaccgg

SEQ ID NO: 29097 - DNA, 764 bp, Homo sapiens
  misc_feature: GYAE6OF01C2IOK.42.15.B04.1.454.CMB.1.raw
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
  modified_base (311)..(311): a, c, t, g, unknown or other
  misc_feature (311)..(311): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctcgggcccagtctgtgctgacgcagcccgccctcagtgtcgtcggggccccgagggcgaggaggtcatctactttcgtgctacgtgggattcggtaccaacgngtcgggctaggtttnagtgtacgcgtcggtaccagctagccttaccgaagaaccnccgaccccaagtcctttcttactacgtttacgtttaacggtaaactaacttacgtccggtccccgttacgggtacccgggggttccctcggtacccgtactttcccgtccgttacccgtaccccttaaccggtaaccggttcccgaccctacccgtacccggtacccgttccccgtaccccggtcggaacccctacgtaccggtacccggttcccggaccccgttacgggtacggtacccgtagggtaacggtacggtacgggtaacgtttcgttaacgttacgttttacgtacccgtacgtaccgttacgttacctagtaaccgaaccgtaacgtaccgttaccgttccgggttcggtttaccgggttgggttcccgggttacgggggacccggaacgggtaacccgtacggttacccggttaacccggtcccgggtacccggttaaacggg

SEQ ID NO: 29098 - DNA, 697 bp, Homo sapiens
  misc_feature: GYAE6OF01DA9QX.42.15.B04.1.454.CMB.1.raw
  modified_base (256)..(256): a, c, t, g, unknown or other
  misc_feature (256)..(256): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacacggctctcgggcccagtctgtgctgacgcacgcccgccctcagtcgtcgtcggggccccgagggcagacggtcatctatttctgctacgtgggtatcggttaccaacgngtcggggcttaaggtttcgagttacgtacgtacgtacggtaccaggcctagtccttaccgaaacgaaaccgaccggacccccaagtccttaccttactaactttacgtttaacggtaaactaagttaaccgtccggtacccgttacgaccgggggttccctcgggaccttactttcccgtccgttcgtacccttaaccgtaaaccggttcccggacctaacccgtccgaccgttcccctcccgtacggaccctagtaccgtacgtccgggtacctaccggaggtccgtaggacggtactaggacgttactagtaactttacgttaccgtgacctagttactagtaccgtaacacgtaccgtccttacggtcgtcggttttaggggcggttaccgggcggtaaacgggtaccaagggttctaccggtaccgtcggtaacggg

SEQ ID NO: 29099 - DNA, 774 bp, Homo sapiens
  misc_feature: GYAE6OF01AB3P3.42.15.B04.1.454.CMB.1.raw
  modified_base (169)..(169): a, c, t, g, unknown or other
  misc_feature (169)..(169): n is a, c, g, or t
tcagtgacgtatgtcacgaccggtgctcgatttagacagtatatagtccgcggggctgcttcagctgtgggcacaagaggcagcactcaggacaatctccagcatggcctggtctcctctcctcctcactctcctgctcactgcacaggctccgtgggcccagtctgtnctgacgcacgccgcctgacgtcgtcgtcggggccccagggcaggaggtcactctagtttcctgctacgtggggtaacttcggtacctaaacgtcggtacggggtacttaggttttcgaacgttacgtaacctacggtcggttaacccaggtacctacggtccttaaccgaaacgaaaccgacccgtacccccgtaaaggtcccttaccgttactacgtttacgtttaacggaaacttaactaacgttccggacccttacggtaaccggggttcctcgggtacctaactttctccgtcgtacctacgtaacgtccgacctcctacgtcgtcccgtaccgtcgcccttaaacgtccgtacggtaccgtcccgttacggacggtacgtaacggtggtaaacgttcggaacggttcccgttaagttaaccgtttaacgtttaccgtaccgggtacttaacccgtccggtttaacgaaccggaaacccgtagtaacccggtaaccgtacccgggttttggtaccgggtttcgggttcgggttaacccggacgggtaaacccggtcgtaaacccggtccgtaaccgggttccccgtaaggttaaaccccgg

SEQ ID NO: 29100 - DNA, 937 bp, Homo sapiens
  misc_feature: GYAE6OF01A7SI8.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctccgtgggcccagtctgtgctgacgcacgccgccctcagtcgtcgtcggggccccagggcgagagggtcatctatttctggctacggtggggtacttcggttaccaacgtacggtcgggggtacttagggtttttgacgttaggtacctacggttacggtacccaggaccgtacgtccttaccgaaacggaaacccgacccggtaccccctaaagtccctttaccgttacctaacgttttaccgttttaaacgggtaaacctaaacgttaaccggttccccggtaccccgttaccgggtaacccgggggtttaccccgtaccggggtacccgtttactttcccgttaccgttacccggtaccccgttaacccgtaaccggttccccggaccctaccccgttaccgtaccccggtccccttcccccgtacgggtacccctacgttacccgtaccggttcccgggtacccgttaccggacgggtaccggttaagggtaacgggtaacggtttaccggggaacgggttaccgtttaacgggtttaaacgttttaccgtttaacccgggtaccggttaacccgttaaacggttttacccggttaaacgtaacccggtaaaaccgtaacccggtacggtttaacccggttcccgggtttacgggtttaccggggttttcggggggtttacccgggttaaccgggggtaacccgggggttaaccgggtaaacccggtaaccggggtttacccgtaaccccgggggttaacccgtttcccgggtaaacccgggg

SEQ ID NO: 29101 - DNA, 689 bp, Homo sapiens
  misc_feature: GYAE6OF01DYY36.42.15.B04.1.454.CMB.1.raw
  modified_base (184)..(184): a, c, t, g, unknown or other
  misc_feature (184)..(184): n is a, c, g, or t
  modified_base (517)..(517): a, c, t, g, unknown or other
  misc_feature (517)..(517): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctccgtcggccagtctgtgctgacgcagccgcctncgtgtcgtacggggcccagggcaggaggtcattctatttctcgcgacggtggggtacttcggttaccaacgtagtcggggtcttaggttttgacttacgtacacgtggtaccagcgtacgtcttaccaaacggaacaccgacccctaacgtcttacttacttacttagtttaacgaaactaacgttaaccgtccggtcccgtacgggtaaccgggttcccgtacgggtaccttacgttccgtccgtacctacccgtaccgtaaccggttcccgaacctccctacgtacccgccccttaccggtcggaaccctacgtcggacgttcccgtaccncggtacgtacgtggacgtcggtagaacgtcttagttaactttacggtacgtcgtacccttaaaggtcctaacgtacgaacctaacggtccgtcttacggtcggtaccgggttttgggccggttaccgggggactacgggaaccctaggacccggtctaccgggacgttacgg

SEQ ID NO: 29102 - DNA, 769 bp, Homo sapiens
  misc_feature: GYAE6OF01BTDVE.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcacgcccgccctcagtcgtcgtcggggcccagggcaggagggtcatctatttctgctacggtggggtattcggttaccaaacgtggtcggggacgttagggtttttcgagttacggtaaccgaccggttacggtaaccaggtaccgtaacgtccgtttacccgaaacggtaaaacccacccgggtaccccccaaaggttcccttacctttactacgtttacgttttaacggtaaaacctaacgttaacgtccccggacccgttacgggtaccggggttacccgtcgggtaccgttacgtttccctaccgtacgtcccttaccgtaaccggtcccgacctacccgtcgaccgccccttcccgtcggccctacgtccgtacgtcccgggtcaccggtacggtcgtagacgggtactggacggtcttagtacgtttactaccgtccgacgttaacccgttcgtaacgtacgaacccgtaacgtaccgttaaccgtcggttacgggttggtttacgggggttccggtacccgggggaaacgggtaccgggtaaccgtaaacgggtccttaaccgggttcccccggtagttaacccgggg

SEQ ID NO: 29103 - DNA, 666 bp, Homo sapiens
  misc_feature: GYAE6OF01BLT48.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcgagtgtcgtcggggccccagggcagagggtcatctatttctgcacgtggggattcggttaccaactagtcggggcttagggtttttgattgtaacacgtcggtaccagcgagtccttaccgaaggaaaccacggcccccaaagccttacttactacttcgtttacggtaaaccaattaacgtccggtacccctacggtacggggtcccctgggacccgtactttcccgtacgtccgtcccgtacccgaacgttcccggacctaccctccgaccgtccctcccgtcggcctacgtccgacgtccggtcctccgacggcgtacggagtacgtgacggtctagtaactttacgtaccgtcgtaccgtacgttaccgtacgtacgaaccgtaacgtacgtacccgttccggttcggttccggtttcgggttcggttccgggacgggtacggacgaacgtcggtaccggtacccgtcggtaaccgg

SEQ ID NO: 29104 - DNA, 779 bp, Homo sapiens
  misc_feature: GYAE6OF01C0BRA.42.15.B04.1.454.CMB.1.raw
  modified_base (127)..(127): a, c, t, g, unknown or other
  misc_feature (127)..(127): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcnctctcctcgctcactgcacaggctcgtcgggcccagtctgtgctgaccgcacggcccgccctcgtaggttcggtccggtccggggggccccccgaggggaccgtaagggacggggttaccaacgtttccgttaattttttccgttcggccgtaaccgggttaggggggtaagtttccggggttaaccctaaaacgtaccgggttccgggggtacgtttaaggggttttttagaacgtttacggttaaccgacggttaccgggtaacccgaggtcctaagtacctttaccgtaaacggaaaaccgcccggaaccccaagttcccttacttacgtacgtttacgtttaacgaaactaacttaatcccgtacgtccccgttacggacgggttccctacggtccgttattcccgtactccgtacccgtaccgtaccggccgtacctaccctccgaccgttcccctccgtcgcctacgtcacgggtcggctcccggagtcgtaggacgtgtcgacgtcttagttactttacgtcgtccggtaccttagtaccttacgaacgacgaaaccgtcgtacccgttcggttggttaccgggtttagggtcccgggttaccgggacgggaaacggtaccacgggtcgtccggtaccggtaccg

SEQ ID NO: 29105 - DNA, 749 bp, Homo sapiens
  misc_feature: GYAE6OF01ALBXV.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcacgccgcctcagtcgtcgtacggggccccagggcaggacgggtcacgtctatttcttagctacggtggggtacttcggttaccaacgtaggtcggggacttaggttttgacttagtaccacgttcggtaaccgagtccgagtccttaccgaaacgaaaccgtaccgacccccaaaggtcccttcttacctatttccgttttacggtaaaactaacgtaaccgttcccggaccccgttacggtaaccggggttccccgtcgggtccctaacgtttcccgtccgtaccgtaccccgtacccgtaaccgggttcccggacctaccccgtacgtacccgtcccctcccgtcggtaccctacgtaccgtaccgttccgggaccttacccggcggtaccgtgggacggtacgtcggaccggtcttacggttaactttacgtaccgtcggtacctacgttaccttagtaccgtaacgactacggtacccgttcggtaccggttcggtttcgggtaccggttccggggaccggggtacccggtaacgtacgggccgttacggtccccgggttagtaacccgg

SEQ ID NO: 29106 - DNA, 983 bp, Homo sapiens
  misc_feature: GYAE6OF01ALL6T.42.15.B04.1.454.CMB.1.raw
  modified_base (124)..(124): a, c, t, g, unknown or other
  misc_feature (124)..(124): n is a, c, g, or t
  modified_base (133)..(133): a, c, t, g, unknown or other
  misc_feature (133)..(133): n is a, c, g, or t
  modified_base (201)..(201): a, c, t, g, unknown or other
  misc_feature (201)..(201): n is a, c, g, or t
tcagtgacgtatgtcacgaccggtgctcgatttagacagtatatatccgcgggctgcttcagctgtggcacaagaggcagcactcagacaatctcagcatggcctggtctcctctcctcctacnctctcctcnctcactcgcacacggcctccgtaggcccctagtccgtgtcgctacggacgccacgcccgtccctacgnggttcgtccggtacgggccccgacgggcgagacggggactatctacgttttctcgctacggtgggactttcggtaccacgtacggtccgggtacttagggtttcgaagttgtaacctacggttcgggtaacccagtaccgtacgtcccgttaacgaaacggtaaaaccgcccggtaacccctaggtacccctttacggttaacctagttttaccgggtttaaacgttaaaacctaaacggttttaaacgcccccggggttaccccttagggggaaaccccggggttttcccctccggggggttacccttaaacggttttcccttaacccggcccgggttaccccgttaaaccccggttaaacggggttccccccccgggttaactacccccggtttacccgtaaccccggtccccccgtttaacccggtccccgggttaccccgttaaacgtttccccggtaaacggtttacccccgggtcccgttaccccggtacccgggtaccggtttaaacggtccgggtaccgggtttaacgggacgggtttaaccgttcgttaaacgtttacccggttacggttaaccggttacccgttagggttaaccccgttactaacccgggtaaacctaacggtttaccgggaaacctttcccgggttagggttttaccccgggtttacgggttacccggggtttccggggaaaccccgggggtttaacgggtaaccccgtaaacgggttcccgggtaaccggggtttaaaccccgtccggttaaccccgggg

SEQ ID NO: 29107 - DNA, 843 bp, Homo sapiens
  misc_feature: GYAE6OF01CNXAA.42.15.B04.1.454.CMB.1.raw
tcagtgacgtatgtcacgaccggtgctcgatttagacagtatatatccgcggggctgcttcagctgtgggcacaagaggcagcactcaaggacaatctccagcatggcctggtcctcctctcctcctcactctcctcgctcactgcacacggcctccgtcgggccctagtctggtgctggaccgccacgcccgaccctgacgttgtcgccggggccccgagggcaagggacggtacacgttcctagttttcgtaggccgtagggttaggggtactttcgggttaacccaaacggtcggttccgggggtactttaagggtttttagaacgttacgtaacgtaaccgttggtaacccaggaccacgttcctaaccgaacgaaaccaccggtaccccaagttcctacttacgtactttacggttaacggaaaactaacgttaaccgttccggacccgttacggtaacccggggtcctacgggtacctactttccgtaccgttcgaccccgtttacgaaaccgggtccccgacctacccgtacctaccggtaccccgttacccgtacggacccctacgtaccgtaacggtcccgggtaacccttccggacgggtaccgtacggaacggtacgtacggtaaccggttcggtttaaactaacgtttaacgttaaccggtccgtaaccgtttaccggttaacgtagtaaaccggaaactaaacgtaccgttaccgttaccgggtttacggttaccggggtttcggggttaacggtacccgggggtaacggaaaccggtacccgaaacggttccccgggttaaacgggtcccccgttaacgggtaacccgg

SEQ ID NO: 29108 - DNA, 738 bp, Homo sapiens
  misc_feature: GYAE6OF01CFMMI.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggcctccgtgggcccagtctgtgctgacgcacgccgccctgagtgtccgtcggggccccagggcaggaggtcatctagtttctgcgacggtggggacttcggttaccaacgacggtcggggacttaggttttgagtcgtactacgtcggtaccgagccgacgtccttaccgaaacgaaccgacccgaccccaaggtccttaccttactacgtttaccgtttaacggtaaactaacgtacgtaccggacccgtacggtaccggggttccctacgggtcctacgtttcccgtacgtccgtacccgtaccgtaaccggttccggacctacccgtacgtacccgtccccgttccccgtacggacccctaacgtcccgtaacgggtttcccggaccgttccggaacggtccggtacggacggtacgtcgggacggttacgttacggtaactttacgttaccgtcgtaacccgttacggttacctacgttaacggacctaacgtaccgtccgttacggtcggttacggttcgggtccgggttcgggaacgggtacggaaccctacggtaccgttccggtaccggttcggtaaccggg

SEQ ID NO: 29109 - DNA, 746 bp, Homo sapiens
  misc_feature: GYAE6OF01DPPEW.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggtctccgtgggcccagttctgtcgctgaccgcacgcccgccctcgagtcgtcgtcggggccccagggccaggacggtcatctatttctgcacgtgggacttcggttaccaacgtaggtccggggtacgtttaggtttttcgatacgtacgtacgtcggttaaccagtacacgtccttaccgaacgaaaaccctaccggaccccaaggtccttacttactactttacgtttacgaaactaaacttacgtcccggacccttacgggtaaccggggttccctcggacccgtttacttccgtaccgttccgtaccccgttaacgtaaccggttacccgggaccctaacccgtacctacccgtacccccgttcccgtaccggaccttactaccggaccgtccgggtccctaccggtacggttacgtaggtacgtggaccggtactaggttaactttacgttaccgcgtaccctagttacctaagtacgaacctaaacgccgtacgttaccggttggttacggttacggggttcgggtcccggacgggggtagtaaacccgtacgggttaccgtacccgtaccgttacgggttacgaacccggg

SEQ ID NO: 29110 - DNA, 696 bp, Homo sapiens
  misc_feature: GYAE6OF01D53T4.42.15.B04.1.454.CMB.1.raw
  modified_base (180)..(180): a, c, t, g, unknown or other
  misc_feature (180)..(180): n is a, c, g, or t
  modified_base (184)..(184): a, c, t, g, unknown or other
  misc_feature (184)..(184): n is a, c, g, or t
  modified_base (337)..(337): a, c, t, g, unknown or other
  misc_feature (337)..(337): n is a, c, g, or t
tcagtgacgtatgtcacgaccggtgctcgatttagacagtatatatccgcggggctgcttcagctgtgggcacaagaggcagcactcaggacaatctccagccatggcctggtctcctctcctcctcactctcctcgctcactgcacaggctccgtggcccagtctgtgctgcgcagccncctnagtgtcgtcgggccccgaggcgagaggtctagtctactttcgtgacgtacggtggggtattcgggttacccaacgtacggtcggggtactttagggttttgagttacgtactacggtacggtaccgagccgagtccttaccgaaggtaaaccnccgaccccaagtccttacttcgagtttaccgtttaggtaaactaacgtaacgtccggtacccgtacggtaccgggttcccgttacgccggtaactttccgccgtcgtacccctaacgaccgtcccggacctaccgtccaccgtccccgttaccgtcggccctaacgtacctcggtacccggtccttaaccggccggtacgtacggacggtagtacggacggtacgtgttaacgtttacctacgtcgtaccgttactccgtatacgacacgtacgtaccgtcggttggttcggttcgggtcgttacgggaccggtaaccggaccgaacgttccgtaccgggttcccgtcggttacccggg

SEQ ID NO: 29111 - DNA, 684 bp, Homo sapiens
  misc_feature: GYAE6OF01B1GOV.42.15.B04.1.454.CMB.1.raw
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctggcccagtctgtgctgacgcagccgcctcagtcgtctcggggccccagggcagacggtcatcatttctgctacgtggggatcggttccaagtagtcgggctaggtttttgatgtacactggtaccagcagctacaagaaacacgacccaagcgtctctattcttagtaacaattacnccgtcctacgaacgggtccnggcctatctctcgacctaccgagtccgcacctcgacgtccctccgcggacctacgtccacggtaccggtctaccgaggtccctagggaagtacgtaggacgtcgtacgtaagtttacgttaccgtaccggtacccgttaacggttaccctaacgttaacgtaaacccgtaaacgtaaccggttaacccgttcccggttcggttaacccgggttttcgggggttaacccgggtttcccggggtaaaccggggggtaacccggttaaacccgggaaccgggtttaaacccggttccggtttaaacccccgggttacccgggtttaaaccccgggg

SEQ ID NO: 29112 - DNA, 800 bp, Homo sapiens
  misc_feature: GYAE6OF01C4YU6.42.15.B04.1.454.CMB.1.raw
tcagtgacgtatgtcacgaccggtgctcgatttagacagtatatatccgcgggctgcttcagctgtgggcacaagaggcagcactcaggacaatctccagcatggcctggtctcctctcctcctcactctcctcgctcactgcacgaggctcctgggccctagtctgtgctcggaccgcacgcccgccctgacggttcgtcgtccggggccccgtagggacgtaggacgggttccacgttaccttactttttccgtggaccgttacgggtaggggttacttcggttaacccaacgtacgggttccggggtacgtttaggtttttaggaacgttcggtaaccgtaccggtaccggtaaccgaggtaccgtacgttccttaacccggaaacgaaacccgcccggtacccccgtaagtcccttaccttactacgttaccggtttaacgtaaactaaacgttaccggtccggtaccctaccgggtaccgggttacccgtacggtacccgttagtttcccgtcgttaccgtaccccgtaccgaacccggttcccgacctaaccccgtccgacccggttccccttaccccgtggaaccccttcgtaccgtacggttcccgggcttaccgggacgttccgaggacgtagccgggtacgacgtttaatacgtttacgtacgcgtcttaacgctaagaccgaacctaacgtaccggttccgttacggtgttacggggtttcgggttacgggtacccggtagggtaacgtaaccggtacgtccgttaaaccggtcccgttaggtacccgg

SEQ ID NO: 29113 - DNA, 843 bp, Homo sapiens
  misc_feature: GYAE6OF01DJV23.42.15.B04.1.454.CMB.1.raw
  modified_base (183)..(183): a, c, t, g, unknown or other
  misc_feature (183)..(183): n is a, c, g, or t
tcagtgacgtatgtcacgaccggtgctcgatttagacagtatatagtccgcggggctgcttcagctgtgggcacaagaggcagcactcaggacaatctccagcatgctggtctcctctcctcctcactctcctcgcttcactgcacacggctccgtggcccagtctgtgtctgacgcacgccncctcgagtcgtccgtccggggccccagggccgaggtacggtacactcgtactttcttgcgtacggtggggtacttcggtaccctaacgacggttcggggtaacgttaggttttagtaacgttacggtactaccggttcggttaaccctaacggaccggtaacggtccctttaaccgaaacggaaacccgcccgaaccccgtaacgtcctttaccgttacctaacgtttaccgttttaacggaaacgttaaccgttacgacccgggttcccgtaacgggttaacccggggtcccctacgggttaccgttactttcccgtaccgttcccggaacccgttaccgttaaacccggtccccggtaccgtaacccgttaccaccccgttccccgttaacccggtccggtaccctaacgttaacccgtcggtaccccggttccgtaccggtacggtaaccggtaggtaacgggtacgtacgggtaacgggttaccttaacgggttaaatttacccgttacggtaaccgtcccgtaacggtttacctacgtaaggaaaccctacggacccgtttcgtaaaccgggttgttaacggtttcggggtacgtttacccggggagtaaaccgggtacgaacggttcccgttaaggccccgtttgtaacccggg

SEQ ID NO: 29114 - DNA, 730 bp, Homo sapiens
  misc_feature: GYAE6OF01BPLIJ.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctccgtcgggcccagtctgtgctgacgcacggcccgccctgagtgtccgtcggggcccagggcaggacggtcatctatttcgtgcacggtggggtattcggttaccaacgtaggtccggggtcgttagggttttgacgttacgtaacacggttcgggtacccagtcctacggtccttaccgaaacgaaaccgtacccggaccccctaagtccttacttactacgtttacgtttaacggaaactaacgttaacgtcccggtaccgtacgggtaccggggtccctaggtacccgtactttcgtcgtcccgtaccgtaccgacggtacccgcctaccgtcgacccgtccctccggtcgtaccacgtcgacggtccggaccgtaccgtaggtcgtaacggtacggtagttcgggacgtacgttaagttacgtttaccttacggtaccgtaccctacggttacctaacgtcgaaaccggtaacctaccggtaccgttcgggtgttacccgggttggggttacccgggttacggggaccggtaacgggtaccacggtacccggtaccgttacccgggtcttaccggg

SEQ ID NO: 29115 - DNA, 829 bp, Homo sapiens
  misc_feature: GYAE6OF01C21HB.42.15.B04.1.454.CMB.1.raw
  modified_base (513)..(513): a, c, t, g, unknown or other
  misc_feature (513)..(513): n is a, c, g, or t
tcagtgacgtatgtcacgaccggtgctcgatttagacagtatatatccggcggggctgcttcagctgtgggcacaagaggcagcactcaggacaatctccagcatggcctggtctcctctcctcctcactctcctcgctcactgcacaggctccgtggaccctagtctgtcgctcgacgcacgcccgccctcgagttcgtccgtccggggcccctagggccaggacgggtcattcgtattttcgtgctacggtgggtacttggttaccaacgtaggtccgggtacgttaggttttagagtacgtacctacgttcggtaccagcctagtccttaccgaagaaacccaccgtaccccgtaagtccttacttacgtacttaccgtttacggtaaaactaacgttacgtacccggttcccgtacgggtaccggggttcccgtacgggtacccgttacgtttcccgtccgttccggtaccctaccggtaacccggtcccgggtacctacccgttaccncccggttaccccttccggtacggaccccttacgtaccgtaacggtcccgggtacccttaccgaccgggtaccgtacgggtaacggtacgttacgggtaccggttacttacgtttaacgtttaaccgttaccggttacgtacccgttacgtttaacccgtagtaaccggttaaacccgaaccgtaaccggttacccggttaccggttacgggttaccggttttcgggggttaaccgggtacccggggtaaccgggtaaccgggtaaccggtaaccggttccggttaacccgggtaacccggtttcgtaaccccgggg

SEQ ID NO: 29116 - DNA, 487 bp, Homo sapiens
  misc_feature: GYAE6OF02HAPVA.42.15.B04.1.454.CMB.1.raw
  modified_base (407)..(407): a, c, t, g, unknown or other
  misc_feature (407)..(407): n is a, c, g, or t
  modified_base (440)..(440): a, c, t, g, unknown or other
  misc_feature (440)..(440): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctggggccccagggcagagggtcatcatttcttgcactggggatggttccaacatcggggcaggtttgatgtacactggtaccagcagcttccagaaacagccccaagctcttcatctttggtaacaataatcggccctcaggggtccctggccgattctctgcctccaagtccggcacctcacgcctccctggccatcatccggctccagctgagntgaggctgattatctgccagtcctatgacaacngactccgtgcttgggtgttcggcgagggccaagctgaccgtctacgg

SEQ ID NO: 29117 - DNA, 165 bp, Homo sapiens
  misc_feature: GYAE6OF02H1D0G.42.15.B04.1.454.CMB.1.raw
  modified_base (163)..(165): a, c, t, g, unknown or other
  misc_feature (163)..(165): n is a, c, g, or t
tcagtgacgtatgtcacgaccggtgctcgatttagacagtatatatccgcgggtatatactgtctaaatcgagcaccggtcgtgcccaaagaactgcgagatgtcactaaatcgagcaccggtcgtgacatacgtcactgagcgggctggcaaggcgcatagnnn

SEQ ID NO: 29118 - DNA, 513 bp, Homo sapiens
  misc_feature: GYAE6OF02GLHGU.42.15.B04.1.454.CMB.1.raw
  modified_base (423)..(423): a, c, t, g, unknown or other
  misc_feature (423)..(423): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctggggccccagggcagagggtcatcatttctgcactgggggatggttccaacatcggggctaggttttgatgtacactggtaccagcagcttaccagaaacacgcccccaagcctcttcattctttaggtaacaataatcggccctcacggggtccctggccgtattctctgcctccgaagtccgcacctcacgccctccctggcccactcagtcgggctccgaggctgagntggaggctgatttatactgcctagtcctatgacacagactccggtgcgttgggtcgttcggcggacgggacaagctcgaccgtcgtacgg

SEQ ID NO: 29119 - DNA, 569 bp, Homo sapiens
  misc_feature: GYAE6OF02IURFW.42.15.B04.1.454.CMB.1.raw
  modified_base (454)..(454): a, c, t, g, unknown or other
  misc_feature (454)..(454): n is a, c, g, or t
tcagtgacgtatgtcacgaccggtgctcgatttagacagtatatattccggtcgggggcgtcgcgttcaggctgtgggacgacaagagggcagcacctcaggacaattctccagtcccactggcctggtctcctctcctcctcactcgtcctcgctacgactgcacaggctcctgggcccagtctgtgctgacgcagccgccctcagtgtctggggcccccagggcagagggtcatcatttctgcacgtggggatggttccaacatcggggctaggttttgatgtacactggtaccagcagcttccagaaacacgccccaagctctcatctttgaacataatcgcctcacggggtcctggccgattctctgcctcaacgtccggcacctccacgccctccctcggcctagtcacgtccgggctccgaggctgagatgagctgtaattacttacncgtccagtcctattacgaacaacgagtaccttccggtaggtccgtttaggggtcgtttccggggacgggaacgggtaccctaaaggccgtacgggtacccggttaccgtaacggg

SEQ ID NO: 29120 - DNA, 543 bp, Homo sapiens
  misc_feature: GYAE6OF02HFF6Q.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctggggccccagggcagagggtcatcatttctgcactggggatggttccaacatcggggcaggtttgatgtacactggtaccagcagcttccagaaacagccccaagctcttcatcttgtaacatatcgcctcgacgggtccctggccgattctctcgcctccaacgtccgcacctcacgcctccctggccatcatccggctccgaggctgagatggaggtctggtatttattactgaccctagtccctagtcgaaccaacgtacgtaccttcccggtgtccgtttgggggtacgtttccggggacgggtacgggtacccgaaggtccgtacggtaccccggttcgtaacggg

SEQ ID NO: 29121 - DNA, 517 bp, Homo sapiens
  misc_feature: GYAE6OF02GFSIJ.42.15.B04.1.454.CMB.1.raw
  modified_base (420)..(420): a, c, t, g, unknown or other
  misc_feature (420)..(420): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctcggggccccagggcagagggtcatcatttctgcactggggatggttccaacatcggggctaggtttgatgtacactggtaccagcagcttccagaaacagccccaagctcttcatctttggtaacaataactccggcctcgacggggtccctggccgtattctctgccctcgaacgtcccggcacctcacgcctcccctggccatcactcggcctccgaggctgaggntgacggctgatttactactcgcctagtcctatcgacaacacgactccgtgtcgttgggtcgttcggcggagggaccaagctacggtaccgtctacgg

SEQ ID NO: 29122 - DNA, 495 bp, Homo sapiens
  misc_feature: GYAE6OF02IAMW2.42.15.B04.1.454.CMB.1.raw
  modified_base (466)..(466): a, c, t, g, unknown or other
  misc_feature (466)..(466): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctggggccccagggcagagggtcatcatttcttgcactggggatggttccaacatcggggcaggttttgatgtacactggtaccagcagcttccagaacagccccaagctctcatctttggtaacaataatccggcctcaggggtccctggccgattctctgcctccaagtccggcacctcacgccctcctggccatcatcgggctccgaggctgaggatgaggctgatttatactgccagtcctatgacacagactcgtgcttgggtcgttcggnggacggaccaagccgtgacccgtctacgg

SEQ ID NO: 29123 - DNA, 560 bp, Homo sapiens
  misc_feature: GYAE6OF02IX6S6.42.15.B04.1.454.CMB.1.raw
  modified_base (337)..(337): a, c, t, g, unknown or other
  misc_feature (337)..(337): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctggggccccagggcagagggtcatcatttcttgcacgtggggatggttaccaacgagtcggggctaggtttgattgtacactggtacagcagcttcagaacacgccccagctctcatcttagaacatactcgcctcgacgggtccnggccgtattctctcgcctacgacgtcccgcacctcgacgtcctcccgtggccactcacgtccgggctccgaggtctcggaggtactggacggtctagtatttacgttactcgtccgtagttcctagtcgaaccaacgtacgtaccgttaccggtggtccgtttgggggtcgttacggggacgggaacgggtaccgacggccgttacggacccgtccgtacggg

SEQ ID NO: 29124 - DNA, 657 bp, Homo sapiens
  misc_feature: GYAE6OF02IVUDX.42.15.B04.1.454.CMB.1.raw
  modified_base (281)..(281): a, c, t, g, unknown or other
  misc_feature (281)..(281): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagcccgccctcagtgtccgtcggggccccagggcaggacgggtcatctattttcttgcacgtgggggattcggttaccaaacgtgtcgggggcttagggtttttanggtacacgttcggtaccaggcagtcttaccgaagaaaccacgacccccaaagccttacttacactttacgtttaggtaaactaataacgtccggtccccttacggacggggttccctggtacccgtactttccgtctccggtccctaccgtaacggtcccgggacctacccgtacgacgtccccttcccgtcggaccctactccgacggtccgggcctccgacggtcgttacggagacgttcggacggcttagtaacgtttacttaccgtcggacctacgttccttaagtcgaaacctaacgacgtaccttcggtgtcggttcggttacggtcggacgggtacggaccgagccgtacgaccgttacgtaggtaccg

SEQ ID NO: 29125 - DNA, 640 bp, Homo sapiens
  misc_feature: GYAE6OF02H4MNK.42.15.B04.1.454.CMB.1.raw
  modified_base (300)..(300): a, c, t, g, unknown or other
  misc_feature (300)..(300): n is a, c, g, or t
  modified_base (521)..(521): a, c, t, g, unknown or other
  misc_feature (521)..(521): n is a, c, g, or t
  modified_base (530)..(530): a, c, t, g, unknown or other
  misc_feature (530)..(530): n is a, c, g, or t
  modified_base (554)..(554): a, c, t, g, unknown or other
  misc_feature (554)..(554): n is a, c, g, or t
  modified_base (579)..(579): a, c, t, g, unknown or other
  misc_feature (579)..(579): n is a, c, g, or t
  modified_base (609)..(609): a, c, t, g, unknown or other
  misc_feature (609)..(609): n is a, c, g, or t
tcagtgacgtatgtcacgaccggtgctcgatttagacagtatatatccgcgggctgcttcagctgtgggcacaagaggcagcactcaggacaatctccagcatggcctggtctcctctcctcctcacctctcctcgctcactgcacaggctcctgggcccagtctgtgctgacgcagcccgtccctcagtcgtctggggccccaaggggccaggcgggttaccatccagtttttccttgccgtacgtggggacttcgggtttccaaacgtagtcgggggtcaggttttgaagttgtaacncgttaggttaccagccgtaagctttaccaagaaaccacgaccccccaaaggtcctacctttatactccttttagggaaacctaagtaaacttcccgggacctcgaaggggtccctggacccgtatttccgactttcgccctcgtaacgttcccggctaccgtcctaaggccccttccgtaccgccgaacgttccaagtttcccgggactccgaccggttcnggtaaccgngtgtaggcttacggattattacgngccctaagtccattcgacgtaaccncgacttccgagtccgttgggtcgttccggnggacgtacctaggtcgtcgtaccgtcgtagg

SEQ ID NO: 29126 - DNA, 531 bp, Homo sapiens
  misc_feature: GYAE6OF02HBUKR.42.15.B04.1.454.CMB.1.raw
  modified_base (277)..(277): a, c, t, g, unknown or other
  misc_feature (277)..(277): n is a, c, g, or t
  modified_base (420)..(420): a, c, t, g, unknown or other
  misc_feature (420)..(420): n is a, c, g, or t
  modified_base (443)..(443): a, c, t, g, unknown or other
  misc_feature (443)..(443): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctggggccccagggcagagggtcatcatttcttgcacgtggggatggttaccaacagtcggggcaggtttgatgtacactggtaccngcagctccagaacacgccccaagctctcattcttagtaacatatccgcctcgacgggtccctggccgtatctctcgccctacgacgtcccgcaccgtcacgccctcccgtcggccatcgacgtccgggctccgaggctggagntggaggtctagtattacgttacncgtcctagttcctaagtcgaacactacgaccttcggtcgtcgttgggtcgttccggcggacggaccaggcgtacggaccgtcgtacgg

SEQ ID NO: 29127 - DNA, 561 bp, Homo sapiens
  misc_feature: GYAE6OF02JIWS6.42.15.B04.1.454.CMB.1.raw
  modified_base (290)..(290): a, c, t, g, unknown or other
  misc_feature (290)..(290): n is a, c, g, or t
  modified_base (375)..(375): a, c, t, g, unknown or other
  misc_feature (375)..(375): n is a, c, g, or t
  modified_base (427)..(427): a, c, t, g, unknown or other
  misc_feature (427)..(427): n is a, c, g, or t
  modified_base (449)..(449): a, c, t, g, unknown or other
  misc_feature (449)..(449): n is a, c, g, or t
  modified_base (499)..(499): a, c, t, g, unknown or other
  misc_feature (499)..(499): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctccactctcctcgctcactgcacaggctcctgggcccagtctgtgctgacgcagcccgccctcagtcgtctcggggccccaggggcaggagggtcagtcattttctgctacgtgggatggttccaacagtcggggactagggtttgattgtacacgtggttacccngtcagtctccagaacagcccccaagctcttcattcttaggtaacataactcggtaccctcacggggtcctggccgattctactcncctccaagtcccggcaccgttcagcctcccgtgcctatccatcgggcctccnggtctaggcgatcggacggtcngtaacttgtaactggcctacgtcctatcaaccgtacagtacctccggttntacccgttgggtccgttacgggcgtacggggaccctaggtctaccggaccttcccggtaagg

SEQ ID NO: 29128 - DNA, 491 bp, Homo sapiens
  misc_feature: GYAE6OF02HNMQI.42.15.B04.1.454.CMB.1.raw
  modified_base (332)..(332): a, c, t, g, unknown or other
  misc_feature (332)..(332): n is a, c, g, or t
  modified_base (403)..(403): a, c, t, g, unknown or other
  misc_feature (403)..(403): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctggggccccagggcagagggtcatcatttcttgcactggggatggttccaacatcggggcaggtttgatgtacactggtaccagcagcttccagaaacagcccccaagctcttcatctttggtaacaataaatcggccctnagggtccctggcgattctctgcctccaagtccggcacctcagcctccctgccatcatcggctcagctgagntgagctgattatactgccagtcctatgacaacagactaccgtgctttgggtgttcggcggagggaccaagtcgtgaccgtcctaacgg

SEQ ID NO: 29129 - DNA, 565 bp, Homo sapiens
  misc_feature: GYAE6OF02GGY07.42.15.B04.1.454.CMB.1.raw
  modified_base (290)..(290): a, c, t, g, unknown or other
  misc_feature (290)..(290): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctggggccccagggcagagggtcatcatttctgcactggggatggttccaacagtcggggctaggtttgatgtacactggtaccagcagcttccagaacncgccccaagctcttcatctttaggtaacaataactcggccctcgacggggtccctggccgtattctctcgcctccaacgtccggccacctcacgccctcccgtggccctactcacgtcccgggcctccgacggcctggaggtatcggacggtctgtactttagttaccgtcgtcctacgttcctagttacgaacctaagacgtacctcgtggtaccgtttggggtcggttcggcgggtacgggacctaaggcctacggtaccgtccgttaacggg

SEQ ID NO: 29130 - DNA, 598 bp, Homo sapiens
  misc_feature: GYAE6OF02IQ59G.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagcccgccctcagtgtctggggccccagggcagagggtcatcatttctgcacgtggggatggttccaacgagtcggggctaggtttgatgtacacgtggtaccagcagtcttccaagaacacgcccccaagctcttcattcttagtaacaataactccgccctcgacgggtccctggccgtattctctcgccctaccgaacgtccgactaccctcacgtccctccgtcgaccctatcagtccggcctccgacggtctggacggtgtacggacggtcgtagtaacgtttacgttaccgtcggtaccctacggttcctaaagtacgaacctaacgacgtaccgttccggtggtttccgttggggttcgttccggggacgggtacggtaccgtaaggtccgtacggtacccggtacgttaaccggg

SEQ ID NO: 29131 - DNA, 637 bp, Homo sapiens
  misc_feature: GYAE6OF02GLXVM.42.15.B04.1.454.CMB.1.raw
  modified_base (293)..(293): a, c, t, g, unknown or other
  misc_feature (293)..(293): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctcggggccccagggcaggagggtcatcatttctgcacgtggggatggttccaacagtcggggctaggtttgatgtacactggtaccagcagcttccagaacncgccccaagctcttcatcttagtaacaataactccgccctcgacgggtccctggccgtattctctcgcctaccgacgtcccggctacctcgacgtccctccctggcccatccgagttccgggccttaccgaggtcctaggacggtactggacgggtcttaggtaactttacgttaaccgtcggtaccctaacgttccctaagttaaccggaaccaaaccgtacgacccgttcccggttacgggttccggttttacgggggttcggtttacccggggaccgggtaaaccggggtaccccgtaaagggttccgtacccgggtaccccggttacccggttaaccggg

SEQ ID NO: 29132 - DNA, 560 bp, Homo sapiens
  misc_feature: GYAE6OF02G8V66.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagcccgccctcagtgtcgtcggggccccagggcaggagggtcatctatttctgcacgtggggattggttaccaacagtcggggctaggttttgatgtacacgtggtaccagcagtccttccaagaaaccacgacccccaagctcttcattcttaggtaacaatactcggccctgacgggtcctggcctattctctcgcctcgaacgtccgcacctcacgtccctcccgtggcccatcacgtcccgggcctcccgaggtcctaggacgagtcggaggtctagtatttactacgtcgacctacgttctatcgacaacacgtacctcgtgtcggttcggggtcgttcgggagggacggtaccgagtccgtcggtacccgtcgtacggg

SEQ ID NO: 29133 - DNA, 597 bp, Homo sapiens
  misc_feature: GYAE6OF02I5ZGW.42.15.B04.1.454.CMB.1.raw
  modified_base (516)..(516): a, c, t, g, unknown or other
  misc_feature (516)..(516): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagcccgccctcagtgtctcggggcccccagggccaggagggtcatcattttctgcacgtggggatggttccaacagtcggggcaggttttgatgtacactggtaccagcagcttccagaaacacgaccccaagctcttcatctttaggtaacaataactccggcctcgacgggtccctggccgtagttctctcgccctaccgaacgtcccggactaccctcgaccgtcccttccccgtcggcctaactccgacgtccgggacctccgaaggcccgtaggaggatgggacgtcgttagtactttattacgtacgtccgtaacgttccctagtcgaactaacncgtaacctccgtggttaccgttggggttcgttacgggaccgggacggtaccgaagtccgtacggtacccgtacgtaccggg

SEQ ID NO: 29134 - DNA, 550 bp, Homo sapiens
  misc_feature: GYAE6OF02F1X9A.42.15.B04.1.454.CMB.1.raw
  modified_base (291)..(291): a, c, t, g, unknown or other
  misc_feature (291)..(291): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctggcccagtctgtgctgacgcagccgccctcagtgtctggggccccagggcagagggtcatcatttctgcacgtggggatggttccaacatcggggctaggttttgatgtacactggtaccagcagcttccagaaacncgccccaagctcttcatctttgaacaataactcggccctcgacggggtccctggccgtattctctcgtccctccgaacgtccggacacctcacgtccctccctggcccatccacgtccgggcctccgaggcctggaggactggacggctgatttagtactgacctagtcctatcgaacaacgagtacctccggtgtacggtttgggtcggttccgggacggtacgggacctaacggctacggtacccgtccgtaacggg

SEQ ID NO: 29135 - DNA, 559 bp, Homo sapiens
  misc_feature: GYAE6OF02G5EE6.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgcctcagtgtcgtggggccccagggcagagggtcatcatttctgcacgtggggatcggttccaacgagtcggggcaggttttgatgtacacgtgtaccagcagcttacagaacacgccccagctctcattcttagtaacataacgtcggcctgtacgggtcctggcgtacttctcgtcgcctaccgaacgtcccggactacctcacgtccctcccgtcggtacccagtcacgtccgggacctccgaggccgtaggaggtacgtcggaggtctagtactttagttactggacctagttcctagtacgacacgtagaccgtcggtgtcgttcgggtcgttcgggacggtacggaccaacggtccgacggtaccgtcgtacgg

SEQ ID NO: 29136 - DNA, 628 bp, Homo sapiens
  misc_feature: GYAE6OF02G30WB.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctcggggccccagggcagagggtcatcatttctgcacgtggggatggttaccaacgagtcggggctaggtttgatgtacactggtaccagcagtcttactaagaaacacgacccccaagtctcttctacttcgttaggtaaactaataactctcgccctcgacggggtccctggccgtattcctctcgtcctaccgaacggtcccgctacctcgacgtccctcccgtggccactcacgtccgggtcctccgtacggccgttaggacggtacgtcgggacggtccgttaagtacttttaacttaccgtcgtaccctacgttacctaagtacgtaaccaacgtagtacccgttccggtaggttccggtttacggggtcggtttaccggggacgggtaacggggaaccctaacgggccgttaccgggacccgttacccggg

SEQ ID NO: 29137 - DNA, 839 bp, Homo sapiens
  misc_feature: GYAE6OF02FM3KD.42.15.B04.1.454.CMB.1.raw
tcagtgacgtatgtcacgaccggtgctcgatttagacagtatatatccgcggggctgcttcagctgtgggcacaagaggcggcactcaggacaatctccagcatggcctggtctcctctcctcctcactctcctcgctcactgcacaggctccgtgggcccagtctgtgctgacgcagccgccctcagtgtcgtcggggccccagggcaggaggtcatctatttctgcacgtggggatcggtaccaacgagtcggggactaggttttgagtgtacacgtcggtaccagacagtccttaccgaacgaaaccgaccgaccccctaagtccttcgttactatttaccgttttaacggtaaaactaaagttaaaccgttcccgggtaccccttaccgggtaaccgggggttccccttacggggtaccccgttaacgttttcccgttaccgttaccggtccccttaacccggtaaaccggttccccgggtacctacccgtaccgtaacccggtccccgtttaccccggtccgggtaaccccttacgttacccggtaacggttcccggggtaccccttacccggtaacgggttccggtaagggtaacggggtacgttaacggggttaccggtccgtttaaggttaacttttaacgttacccgtacggtaccccttaacgggtttacccttaaaggttaaccggaaaccgttaaaccgtaccggtttaccgttccggttacggtttaccgggtttacggggtttaccggggttacccgggaccgggggtaaccggaaccgtaacgggttcccgttaacggtccccgggttaccgtacgggtacccg

SEQ ID NO: 29138 - DNA, 886 bp, Homo sapiens
  misc_feature: GYAE6OF02JY08W.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctctcactctcctcgctcactgcacaggctcctcggcccagtcctgtgctgacgcagcccgccctcaggtcgtccgtcggggcccccaggggccacgggacggggtcacgttaccgtatttttccttcggacctaaccggtgggggtaacgttcgggtttaccaaccggtacggttccgggggtacctaagggtttttcggaacgttcggttacgtacgttacgggtaacctacggacgacgttaccgttaccgtaaacggaaaaccgtaccggaccccccgtaaaaggtcccttacccgtttacaaccgttttacgtttaaccgggtaaaacttaaacgtaaaccggttcccggtaacccgtttcggaaccgggggttccctacggggaccttaacgtttcccgttacgttccgaccccggttaactaaccgggttacccggtccaacccgttcgttaacccgaccccgtttccccggtacgggtaccctaacgtttacccgaaccggttcccggggtccttaacccggtaaccgggttccggtacgggaacgggttaatccgggtaaacggtcccgttttaaagaactttttaaacccggtcgtttaccgaccgtttaccgttaacctaacggttcgtaaaacccaagttaccggtactttacccggggttcggtaccggtttttcggggacggttttaccggggaccggtaccgggggttaacaacggttccgttaaccgggacccgtttcggttaacccggg

SEQ ID NO: 29139 - DNA, 645 bp, Homo sapiens
  misc_feature: GYAE6OF02IZQNE.42.15.B04.1.454.CMB.1.raw
  modified_base (249)..(249): a, c, t, g, unknown or other
  misc_feature (249)..(249): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctccgtgggcccagtctgtgctgacgcacgcccgccctcagtgtcgtcggggccccagggcaggaggtcatcatttctgcacgtggggatggttccaacngtcggggctagggtttgatgtacacgtggtaccagcagtcttccgaagaaaccacgcccccaagcctcttctattctttaggaaactaataactccggcctcgacgggtcctggccgtacttctctcgcctaccgacgtccgcacctcacgtcccctacccgtcggtacccagtccacggttcccgggaccttccggacggtccgtagggaccggtagtggacgggtaccttaggtaactttacgttacctcgtaccgttacgttcccttaagtaccgaacgtaaccgacgtaccgttaccggttcggttcggtttacggggttcggttaccggggtacgggtaccggggtaacaacggttccggtaccggttaccccggttcgttaaacccgggg

SEQ ID NO: 29140 - DNA, 626 bp, Homo sapiens
  misc_feature: GYAE6OF02JDPDD.42.15.B04.1.454.CMB.1.raw
  modified_base (299)..(299): a, c, t, g, unknown or other
  misc_feature (299)..(299): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctggggccccagggcagagggtcatcatttctgcacgtggggatggttccaagagtcggggctaggttttgatgtacacgtggtaccagcagtccttaccaagaaaccncgacccccaagtccttcttcattctttaggaaactaataacgtccggtccctacgaccggggtccctcggccgtattcctactcgccctaccgaacgtcccggcctacctcaccgccttcccgtcgccctatccacgtccgggcctccggacggtcctaggacggtactcggacggtctagttaactttacgttacgacgtaccctaacgtttccgtaactaccgaactaaccgacgtaaccgtcggttacggttccggtttggggtaccggttccgggacgggtacgggacctaacggtccggtacgtacccggttacggtaccgg

SEQ ID NO: 29141 - DNA, 682 bp, Homo sapiens
  misc_feature: GYAE6OF02H2V9X.42.15.B04.1.454.CMB.1.raw
  modified_base (246)..(246): a, c, t, g, unknown or other
  misc_feature (246)..(246): n is a, c, g, or t
  modified_base (303)..(303): a, c, t, g, unknown or other
  misc_feature (303)..(303): n is a, c, g, or t
  modified_base (378)..(378): a, c, t, g, unknown or other
  misc_feature (378)..(378): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtcgtcggggccccagggcaggagggtcatctatttctgcagtggggatcggtcaacngtcggggctaggtttgattgtacacgtcggtaccaggcacgtccttaccaagaaacncgacccccaagtcctcttctattctttaggtaactaatacgtccgcctcgacgggtcctggccgtattctcgtcncctccgaacgtcccgactacctcgtaccgtcccgttaccctcggaccctacgtccaccgttccgggtctacccggtaagggtccctagggtacggtagtacggacggttacgttacgtaacttttacgttacgtacgtacccgttaacgttcccgtaagttaaccgaacctaaaccgtaccgtaaccgtttcccgggttcgttaccgggttttcgggggttaccggtttacccggggacgggtaaccgggtacccgtaaacggttcccgttacgggttacccccgggttaccgttaaaccgggg

SEQ ID NO: 29142 - DNA, 587 bp, Homo sapiens
  misc_feature: GYAE6OF02IHCLN.42.15.B04.1.454.CMB.1.raw
  modified_base (253)..(253): a, c, t, g, unknown or other
  misc_feature (253)..(253): n is a, c, g, or t
  modified_base (289)..(289): a, c, t, g, unknown or other
  misc_feature (289)..(289): n is a, c, g, or t
  modified_base (306)..(306): a, c, t, g, unknown or other
  misc_feature (306)..(306): n is a, c, g, or t
  modified_base (468)..(468): a, c, t, g, unknown or other
  misc_feature (468)..(468): n is a, c, g, or t
  modified_base (484)..(484): a, c, t, g, unknown or other
  misc_feature (484)..(484): n is a, c, g, or t
  modified_base (515)..(515): a, c, t, g, unknown or other
  misc_feature (515)..(515): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtcctgtgctgacgcagcccgccctcagtcgtcgtcggggccccagggcaggagggtcatctattttctgcacgtggggatcggttccaacngtcggggctaggtttgatgtacacgtcgtaccagcngtcctacgaacgaaacncgaccccaagtcctctctacttcgtttagtaacaactaagtcccggcccttcggtaccggggtcccgtcggccgtacttctccgcgtccctaccggtaacgtcccggacctacccgtcaccgtccctcccgtacgcctactcgcgtccggcctccgcgtcgnggacggagtcggacgnttagtacttatacgtcgacctacgtctaaancgactaacgtctacgtccgtggtccgttggtcgtcgggaggcggtaccaggccgtacggtaccgtcgtacgg

SEQ ID NO: 29143 - DNA, 720 bp, Homo sapiens
  misc_feature: GYAE6OF02JAODK.42.15.B04.1.454.CMB.1.raw
  modified_base (185)..(185): a, c, t, g, unknown or other
  misc_feature (185)..(185): n is a, c, g, or t
  modified_base (201)..(201): a, c, t, g, unknown or other
  misc_feature (201)..(201): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctccgtggcccagtctgtgctgacgcacgccgcctnagtgtcgcggggcccngggcaggaggtcatcgtattttcgtgcacgtggggatcggttaccaactagtcgggactgggtttagatagtacactcggtaccagcagtcttaccaacgaacacgaccccaagtcctacttctacttcgtttacgaaactaagtaacgtccggtacctcggaaccgggttccctacgggcctaatttccgtcgtccgtacccgttaccgaaaccggtcccgacctaccctaccgtacccgtacccgttccccgtcggtaccctacgtaccggtaacgttccgggaccttccggaacggttccgttaacgggaggtacgttacggacgggtactacggtaactttaacgttacgccgtaccgtacgttacacgtaacgaacccgtaaacgacgttaaccggttacccggtgggttccgggtttaacggggttccgggttaaccgggggtacccgggtaaacggggttaaccctaacgggtaccggttaccccggttacccgggttaccggttaaccggg

SEQ ID NO: 29144 - DNA, 808 bp, Homo sapiens
  misc_feature: GYAE6OF02HBXA6.42.15.B04.1.454.CMB.1.raw
  modified_base (187)..(187): a, c, t, g, unknown or other
  misc_feature (187)..(187): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcacgcccgccctnagtgtcgtcggggccccagggcaggagggtcatctatttctgcacgtggggatcggttaccaacgagtcggggctaggtttgagttgtaacacgttacggtaccagccgagtccttacgaagaaaccaccgacccccaaagtcccttcgttaccacgtttaccgtttaaggtaaaactaaagttaaccggttccgggtacccccttaggacccgggggtttaccctcgggtacccgtacttttaccgtccgttacggtacccttacccgaaacgggtttccccggcctaacccgttaccgtacccggtcccccgttaccccgtaccgggtacccctacgttacccgaacgggttccccggggtaccttacccgaacggggtaccttagggaaaccggggttaacgttcgggaacggggttcttaacggttaaccgttttaacgtttaaccgtcgtaacccgtaacgtttacccgtaagttaccggaaccttaaaccgtacgggtacccttccggttacggttccggttttacgggggttaacggtttcccggggaacgggttaaccggggtaaccgtaaccggtccggttacccgggttacccggttaccgttaaccgggg

SEQ ID NO: 29145 - DNA, 651 bp, Homo sapiens
  misc_feature: GYAE6OF02HQ7L2.42.15.B04.1.454.CMB.1.raw
  modified_base (441)..(441): a, c, t, g, unknown or other
  misc_feature (441)..(441): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagcccgccctcagtcgtcgtcggggccccaggggccaggagggtcagtctattttctgctacgtggggattcggttaccaacgagtcggggtactaggttttgattagtacgacgttggtaccagcgagtccttaccgaacgaaacaccgacccccaagtccttacttctactttcgtttagtaaactaactaacgtccggtaccctcggtacggggttccctggccgtacttcctcgtcgaccctccgacggtcccgactacccncgtaccgtccccttcccgcggtcctactaccgacgtcgggcctcccgaggtacctggaacgtagtaggtcggtcttacgtaatttactacgtcggtaccttacgttaccttaacacgtaaccaaccgtacgtacctcccggtgtccggttgggtcggttccgggaccgggtagggtaccaaggttccgtaccggtacccgtcgtaaccgg

SEQ ID NO: 29146 - DNA, 701 bp, Homo sapiens
  misc_feature: GYAE6OF02HXSIV.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggcctccgtgggcccagtctgtgctgacgcacgcccgccctcagtcgtcgtcggggccccagggcaggaggtcatctatttctgcacgtggggatggtccaacgagtcggggtctaggtttgatgtacgacgtcggtacagctacgtccttaccgaagaaccaccgacccccaagtccttcttactacttcgtttacggaaacttaactaacgtcccggacccgttacggaccggggttcccgtggaccgtatttccgtccgtacgcccttaccgacgggttcccgacctaccgtcacgtcccccgttccgtccggacctaactccgacggtcccggtcctaccggcggtactagggtaacgtgtacgggacggttcgttaagtaacttttaccgttaccgtcgtacccttacgttacctagtaccgaaccaacgtaccggtacccgttccggtggtttaccggttcgggggttaccggttccggggaaccgggtaaccgggtaaccgaccggtttacccgggtaccggtttaccccggtacccggttaacggg

SEQ ID NO: 29147 - DNA, 817 bp, Homo sapiens
  misc_feature: GYAE6OF02JA0CU.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctctcactctcctcgctcactgcacaggctccgtcgggcccagtctgtgctgacgcacgcccgccctcagttcgtccgtcggggccccgagggccaggtacgggtcacgtctagtttctcgacacggtggggtactcggttaccaacgtcggtccggggtacttagggttttgacgttacgttaaccgtacggttacggtaccacggtacgtacgtaccttaccgaacggaaaccacccggtaccccccaagtcccttaccgtttacgtacgtttacgtttaacggaaacctaaacgtaccgtccccggtaccgtccggtaccggggtccctacgggtccttagttccgtcgtacccgtacccgtaccggtaccggtcccggtccttacccgtaccgttacccgtcccccgttacccggtaccggaccctacgtacccgacgggttccccggccctaaccggtacgggtacccgtaagggtacgtacgtacggggtacggtacgtaacggtttaccttttacgtaccggtacctacccgttaacggtttaccctaacgttaaccgggaaccttaaaccgtccgggttaacccgtttcccgggttaacggtttccgggtttagggggtttaccgttaccggggtaaccgggaacggtaccgtaacggtcccgttacggtaacccggtccgtaaaccgg

SEQ ID NO: 29148 - DNA, 580 bp, Homo sapiens
  misc_feature: GYAE6OF02G1IZT.42.15.B04.1.454.CMB.1.raw
  modified_base (301)..(301): a, c, t, g, unknown or other
  misc_feature (301)..(301): n is a, c, g, or t
  modified_base (452)..(452): a, c, t, g, unknown or other
  misc_feature (452)..(452): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctctcactctcctcgctcactgcacaggctcctgggcccagtctgtgctgacgcagccgccctcagtgtctggggccccagggccaggagggtcagtctatttctgcaagtggggatggttccaactagtcggggctaggtttgattgtacacgtggtaccagcagtcttaccagaaaccncgaccccaagtcctcttctacgttactttaggtaaactaatactccggaccctcgacgggtccctggccgtattctctcgcctacgtaacgtccgacacctcgacgtccctccgtcggcctatccgacgtccggctccgacggctcggagngtggacgtctagtactttagttactcgtctacgttccgtatacggaccaacgtcgtaccttcggtacgtcggttacggggtcgtacgggcggtaacggacgtaacggtcgtacggtaccgtcgtacgg

SEQ ID NO: 29149 - DNA, 744 bp, Homo sapiens
  misc_feature: GYAE6OF02JSKG4.42.15.B04.1.454.CMB.1.raw
  modified_base (286)..(286): a, c, t, g, unknown or other
  misc_feature (286)..(286): n is a, c, g, or t
tcagtgacgtatgtcacgaccggtgctcgatttagacagtatatatccgcgggctgcttcagctgtggcacaagaggcagcactcaggacaatctccagcatggcctggtctctctcctcctccacctctcctcgctcactgcacagtcctccgtcggcccagtctgtgctgaccgcacggcccgtccctcacgtcgtcgtccggggccccaagggccagggacggttcgactccgttattttcgtgctaacggttgggacttggtaccctaagaacggtcgggtntacggtttgtagtcgtaccgtagttcgtaccgaggccagtcctacgaacgtacgaaccaccccgaagtcctaccttcgactttcgtttaaccgaaacgttaactaacgtcccggtacccgtacgtacccggggttccgtacggacctacgtttccgtaccgttcggaccccttaccgtaaccggttcccggtaaccccgtccgtaccgtcccgtccccttccccggtaccgaccctccgttacctccggtacccgggcccttccgaaggtcccgtaggtacgtacgtcggtacgggcgttacgttacttaccgtttaccgtacgtcccgtattacccgtaacgttacgaaaccgtacctagttacccgttccggtacggtttacggttggggtcccgtttacgggggaccgaaggtaccccgtagggacccttacgggtacccgttcccgttaacggg

SEQ ID NO: 29150 - DNA, 664 bp, Homo sapiens
  misc_feature: GYAE6OF02IFZTX.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcacgccgccctcagtgtcgtcggggccccagggccaggacgggtcatcattttcgtgctacgtggggtatcggttaccaactagtcggggctaggtttgatgtactacgtacggtaccgacgcgagtcttaccgaagaaaccaccgtaccccaagtccttccttactaacttcgtttacggtaactaaagttaacgtcccggtacctaccggtaccggggttccctacgggtaccgtactttccgtactcgtaccctacccgtaaccggtcccgacctacccgtccaccgtccccgtccgtcggtacctacgtcgacggtccggtacctccggtacggtcgtacggtacgtacgtggacgtcgttaggtacttacgtacgtcgtacctacgtcctacgtacgaacgacgtacgtacgttcggtcgttcggttcgggtacggtcggacgggtacggacgtacgtaccggtaccggtaccggtacgtaccgg

SEQ ID NO: 29151 - DNA, 654 bp, Homo sapiens
  misc_feature: GYAE6OF02JD7ND.42.15.B04.1.454.CMB.1.raw
  modified_base (188)..(188): a, c, t, g, unknown or other
  misc_feature (188)..(188): n is a, c, g, or t
  modified_base (325)..(325): a, c, t, g, unknown or other
  misc_feature (325)..(325): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctctcactctcctcgctcactgcacaggctcctgggcccagtctgtagctgacgctacgcccgccctnagtcgtctcggggccccagggcacggagggtcatcgtatttcttagcacgtgggggattcggttccaacgtagtccggggctaaggttttcgattgtactacgttcggtaaccagacagtcttaccgaaggaaaccnccgacccccaagtcctcttctacttacgtttacgaaactaactaacgtcccggtaccctcggtacggggttccctagggtccctactttccgtccgtccgtacccgtacccgtaaggtccccggctacccgtcaccggtccctcccgtcggacctacgtccgacgtcccgggtacctccggaacggtccgtacggacgtacgttcggacggttcctagtactttacgtaccgttcgaccgtacgttacctagtacgacaacgtcgtaccgtcgtgtaccgttgggtcgtcggacggtacggacctaacgtccacggtaccgtcgtacgg

SEQ ID NO: 29152 - DNA, 697 bp, Homo sapiens
  misc_feature: GYAE6OF02H2227.42.15.B04.1.454.CMB.1.raw
  modified_base (313)..(313): a, c, t, g, unknown or other
  misc_feature (313)..(313): n is a, c, g, or t
  modified_base (656)..(656): a, c, t, g, unknown or other
  misc_feature (656)..(656): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcacgcccgcctcagtcgtcgtacggggccccagggcaggagggtcatctatttctgacacgtggggattcggtaccaatagcggggtataggtttgattgtacacgtacgggtaccagcacgtcttacgaacgtaaacnccgaccccctaaagcttaccttactattacgttttaacggtaaactaaattaacgtccggtcccgttacgaaccgggggttccctacgggtacccgtaactttccgtccgttaccgtaccctaaccggtaaccggtttacccgggccctaaccgtcccgtacgcccccgtttacccgtccgggtacctacgtacgtaacgtccgggccttaccgacgggtacgttacgggagtagtacgggacgtacgttagttaacgtttacgttacgaccgtaccttacgtaccttaagaacgaacctaacgtacgtaccgtcgttacggttcggttggtcgggttacggngggtaacggacgtaacgtcgtacggtcccgtacggtaacgg

SEQ ID NO: 29153 - DNA, 749 bp, Homo sapiens
  misc_feature: GYAE6OF02HSEU4.42.15.B04.1.454.CMB.1.raw
  modified_base (679)..(679): a, c, t, g, unknown or other
  misc_feature (679)..(679): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcacgcccgccctcagtgtcgtcggggccccagggcagagggtacatctacttttcgttagtcaccggtgggggattcgggttaccaaacgtacggtacgggggtccttagggttttagaatggttaacctacgttacggtaccgacgacgtacggtaccttaccgaaacgaaaccgtaacccggaccccccaaagtccttaccttactacgttacgttttaacggtaaacaaacttaacgtcccggtacccgttaccggtacggggggttccctacggtacgtaccttccgtcttacgaccctacccgaacggtcccggactacccgtctaccggtaccccttcccgtacggcctaacgtcccgtaacggtccggggtacctacccggacgggtacctaggggaaccgggtagtacgggtacggtacgttaggtaactttacgtttaccgtagacccgttaccggttaacctagtaacgtaaccaacgtacgtaacccgttcggnggttacggtttcggggtccggttacgggtaggaacgggaccgtaagccgttaccgtacggtaacctacgg

SEQ ID NO: 29154 - DNA, 737 bp, Homo sapiens
  misc_feature: GYAE6OF02FYZ1X.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctggcccagtctgtgctgacgcagccgccctcagtgtccgtcgggggcccccaggggccaaggacgggtcagtcattttctgcacgtggggacttggttaccacgagtcgggctaggtttgatagtacacgttaggtaccagctagtccttaccgaaagaaaccgaccgacccccgaaacgtccttacctttaccgtacgtttcgttttaaggtaaaacctaaagttaaccgtccggtaccccgttaccggtaccgggttcccggttaccggaccgttactttccgtccttcgtccccgttaccgaacggttccccggcctaacccgtacgtacccgtaccccgttccccgtacgggcccctaacgtaccgtacgtcccgggcccttaccgaccggtcggtaacggtacgggactaggacggtcgttagtactttacgttacctacggtcctaacgttcctaggtacaacctaacgtcgtacccgttcggtacggttaggttcgggtttaaccgggttccgggacggggtaccgggtaacccgtacgggtaccggtttaccggtaccccggtacggttaacccgg

SEQ ID NO: 29155 - DNA, 853 bp, Homo sapiens
  misc_feature: GYAE6OF02I557Z.42.15.B04.1.454.CMB.1.raw
tcagtgacgtatgtcacgaccggtgctcgatttagacagtatatatccggcggggctgcttcagctgtgggcacaagaggcagcactcaggacaatctccagcatcggcctggtctcctctcctctcactctcctcgctcactgcacgaggcctccgtcggccctagtctgcgctgaccgcacgcccgtaccctcgtagtcggtaccggtccggggcccctaggggcctagggtacgggttccaacgttccttagttttccgtacgccgtacggtggggggtacttcgggttaaccaacgtcggtacgggtacgttaggtttcgagttcggtaacctacggtacggtaccgagtcgttacgtcctaacgaacgaaaccgaccggacccctaacggtccttaccttacgtacgtttaccgtttaacgtaactaaccggttaacgtccccgggtaccggtttaccgggaccggggttcccgtaacggtccctttaacgtttcccgtccgttacccggtaaccccgttaaccggtacccggtttacccggacctaccccggtacccttacccgggtccccttacccgtacggaccctttaacgcccgggttacgtacccggacccgtaccggtagacccgggttacggaagggttaccgcgggtaacggttcttaacggttacctttaccgtacccgggttatacccggttattaaccggtcgtaaacccgtaaccgtaccgttacggttacccgtccgggtttcgggtttaaccggggtttgggtaacccgggtcggggtaaaccgggtaccgagttcccgggtaacgttacccggtacggtttacccgaaccgg

SEQ ID NO: 29156 - DNA, 689 bp, Homo sapiens
  misc_feature: GYAE6OF02ISXFZ.42.15.B04.1.454.CMB.1.raw
  modified_base (208)..(208): a, c, t, g, unknown or other
  misc_feature (208)..(208): n is a, c, g, or t
  modified_base (301)..(301): a, c, t, g, unknown or other
  misc_feature (301)..(301): n is a, c, g, or t
  modified_base (359)..(359): a, c, t, g, unknown or other
  misc_feature (359)..(359): n is a, c, g, or t
  modified_base (516)..(516): a, c, t, g, unknown or other
  misc_feature (516)..(516): n is a, c, g, or t
  modified_base (541)..(541): a, c, t, g, unknown or other
  misc_feature (541)..(541): n is a, c, g, or t
  modified_base (595)..(595): a, c, t, g, unknown or other
  misc_feature (595)..(595): n is a, c, g, or t
tcagtgacgtatgtcacgaccggtgctcgatttagacagtatatatccggcggggctgcttcagctcgtgggcacaagaggcagcactcaggacaatctccagcatggcctggtcctcctctcctcctcactcctcctcgctcactgccacgaggtcctccgtacgggccctagttctggtcgtctaggaccgcacgtcccgccctcnggtgtccgtaccggggccccgagggcagggacggtcattcctattttcgtagctacggtcggggtattcggttaccaacgtacggtccgggtnttaggtttgatcgttacacgttccggacagcagttcctaacgaaacgtaaccgacccnccccgaattccgttcttactactttacgtttaacgtaaaactacgtaccgtccggtacccgttcgggtaacccggtcctcggtacttaccttccgtatcccggtaccctcgtaaccggtccgcctacctccgtacccgcccgttaccgcgtactacncgaccgttccggacctcggacgtcngaagcgtcgatacttgtaacttactcgtaccgtctaccgttcacgtaaccgtanaccgacttacgttcccgggtggtttaacggtcgggttcggtcccgggaaggttacggaccgttaggtcccgtccgttaacccgggtacttcggg

SEQ ID NO: 29157 - DNA, 824 bp, Homo sapiens
  misc_feature: GYAE6OF02HVNHF.42.15.B04.1.454.CMB.1.raw
  modified_base (235)..(235): a, c, t, g, unknown or other
  misc_feature (235)..(235): n is a, c, g, or t
tcagtgacgtatgtcacgaccggtgctcgatttagacagtatatatccgcgggctgcttcagctgtgggcacaagaggcagcacgtcaggacaactctccagcatggcctggtctcctctcctctcactctcctcgctcactgacacaggctccgtgggccagtctgtgcttgacgcacgccgaccctgagttgtccgtcggggacccagggcaggacggtcatctattttcgtnccgtagtgggattcgttaccaaagtcggtacgggtacgttaggttttacgacgttagtaacgtacgtacggtacctagtccgtaacgttccgttaaccgaaaccggaaccacccggtaacccccctaaaggtccctttaccttaacgttacgtttaccgttttaaacggtaaccgttaaacgtttaaacggtccccggtacccgtttaccgggtaaccgggggttacccccgttacgggtacccgttacgtttaccccgttcgttccccggtaccccgtttaccgtaaacccgggtttccccggacctaacccgttcccgaacccggttccccgttccccggtacggtaacccttcgtaaccggtacggttacccgggtaccgtaccgggttaaccgtccggtaaggtaccgtagttacggacgttcgtttagtaacgtttacgtaacccttcgtaaccgttacgttccctaagtaccgaacgaacgttccgtaccgtacggttacgttaccgggtttaggtaccggttaccggggacggtaaccggtaccgaaccgtcccggttaaccggttacccgtaccggtacgg

SEQ ID NO: 29158 - DNA, 622 bp, Homo sapiens
  misc_feature: GYAE6OF02JVX4X.42.15.B04.1.454.CMB.1.raw
  modified_base (289)..(289): a, c, t, g, unknown or other
  misc_feature (289)..(289): n is a, c, g, or t
  modified_base (489)..(489): a, c, t, g, unknown or other
  misc_feature (489)..(489): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcacgcccgccctcagtcgtcgtcggggccccagggcaggaggtcatcgtatttcgtgcacgtggggatcggtaccaacgacgtcgggtctaggtttgattgtacacgtggtaccngcacgtctaccaagaaccaccgaccccaagtccttcttacatttcgttaacgaactaactacgtcccggacctcggtacgggtcccgtaggtaccgtatttccgtcgtaccgtccccgttacgaaccggtcccggtacctaacccgtccgtaccgtccccgttcccgtccgacctacgtccgtacgtccgggcctaccgngtcgtacggacgtcgtcggtacggtattcggtactttacgtactcggaccttacgttctagcgaaccacgtcgtacctcggtgtccggttggtccggtacggcggtacgcgtacgtcgcggtacctcgtacgg

SEQ ID NO: 29159 - DNA, 673 bp, Homo sapiens
  misc_feature: GYAE6OF02I8YUY.42.15.B04.1.454.CMB.1.raw
tcagtgacgtatgtcacgaccggtgctcgatttagacagtatatatccgcggggctgcttcagctgtgggcacaagaggcagcactcaggacaatctccagcatggcctggtctcctctcctcctcactctcctcgctcactgcacaggctcctgggcccagtctgtgctgacgcagccgccctcagtgtctcgggccccagggcagagggtcatctatttctgcacgtggggatcggttaccaacgagtcggggctaggtttgagtcgtacacgtgtaccagtcacgtcttaccaagaaactacgcccccaagtcctccgttcacttctttaggtaacaattaacgtcggccctacggaccggggttcccgtacggccgtacgttcctcgttcgtccctaccgtaacggtcccgtaccgtacccttaccgaccgtccccgtccccgtcgggtacccactaccgtacggttccgggtccttacccgaagggtccttacgggacggtacgtgggacgtcgttaggtaactttacgtaccttacggccgtaacgttcctaacgtcgaaccgaactacgtaccttaccgggtcgttgggtttcggggttacggttacgggaccgggtacgggaacccgtaaggtcccggtaccggtacccggtcccgttaaccggg

SEQ ID NO: 29160 - DNA, 761 bp, Homo sapiens
  misc_feature: GYAE6OF02H448S.42.15.B04.1.454.CMB.1.raw
  modified_base (166)..(166): a, c, t, g, unknown or other
  misc_feature (166)..(166): n is a, c, g, or t
  modified_base (176)..(176): a, c, t, g, unknown or other
  misc_feature (176)..(176): n is a, c, g, or t
  modified_base (186)..(186): a, c, t, g, unknown or other
  misc_feature (186)..(186): n is a, c, g, or t
tcagtgacgtatgtcacgaccggtgctcgatttagacagtatatatccgcgggctgcttcagctgtgggcacaagaggcagcactcaggacaactctccagccatggcctggtctcctctcctctcactctcctcgctcactgcacgacgcctcgcggccagtctngctagacgcncgcccgtccnacgtcgtcggtcgggccccgagggcaggacgggtcactcttacgttttcgtcgcgtacggtgggtacgttcggttaccaacgtacggtccggggtacgttaggtttacggacgttacgtaaccgtcgtaccggtaccgaggtaccgtacggttaccttaaccgaaaccgaaacccgacccggtacccccggaagttacccgttactttaacgtacgttttaccgtttaaacggtaaacctaacgttaaccggtccgtacccgttacgggtaccgggttccgtacggtccttacgttccgtcgtacgtcccgtacgtaccgggttccgtaccgtaccctcgtaccgtcccttcccggtacgtaccctacgtccgtacggtccggtaccgtaccgtacggtacgtacggtacggtcgtagtacgtcgttaattacgttacgttaacgttccgacgttacgttacctaggtaaccgaacgaccgtacgttaccggtccggtaggttcggttacgggtccgggttaccggacggttacggaacggtccggttaccgtacggtacccgttacggtaccgg

SEQ ID NO: 29161 - DNA, 800 bp, Homo sapiens
  misc_feature: GYAE6OF02GJ3XM.42.15.B04.1.454.CMB.1.raw
  modified_base (296)..(296): a, c, t, g, unknown or other
  misc_feature (296)..(296): n is a, c, g, or t
tcagtgacgtatgtcacgaccggtgctcgatttagacagtatatatccggcggggctgcttcagctgtgggcacaagaggcagcactcaggacaatctccagcatggcctggtctcctctcctcctcactctcctcgctcactgcacgacggcctccgtgggcccagtcgtgtcgctggacgcacgcccgccctgaggtcgtccgtcggggccccgagggtcagggacggtcattcctatttcgtcgacgacggtggggtacttcggtaccaagtggtcggggtcttaggtttagngttacgtactacgttcggtaacccagaccgacggtccttaaccggaacgtaaacccggaccggacccccctaagtccctttccttaccgttacgtttaccgtttaaacggtaaaactaaacggtttaacctccccgggtacccttacggggtacccggggtacccgttcgggtaccgtactttcccgtacgttcccgacccgttaccgtacccgggtacccggtacctacccgtaccgtacccggtcccccgtttcccggtacgcccctttaaacgtcccgtaccgggtccgtaccgtaccggtcgggtacctagggtacggtagtccggacgtcgttacgtaacgtttacgttcgccgtacctacgttacctaacgagtaaccctaaggtaccgtccggtttccggtaggggttccgggttttacggggccggttaccgggggacgggtaaccgggtacccgtcggttaccccgggtacggttacccggtacggtaacccggg

SEQ ID NO: 29162 - DNA, 788 bp, Homo sapiens
  misc_feature: GYAE6OF02I7102.42.15.B04.1.454.CMB.1.raw
  modified_base (221)..(221): a, c, t, g, unknown or other
  misc_feature (221)..(221): n is a, c, g, or t
tcagtgacgtatgtcacgaccggtgctcgatttagacagtatatatccgcggggctgcttcagctgtgggcacaagaggcagcactcaggacaatctccagcatggcctggtctcctctcctctcactctcctcgctcactcgcacaggctccgtcgggcccagttctgtcgctcggaccgcacggcccgccctcgacgttcggtcggtccggggacccgngggccgagggacgggttcacttctacgtttttccgtcggacgtacggtcgggggtacgttcggttaccaaccggtggtcggggtacgttaggttttgacgttacgtacgtacgtacggtaccagcgtacgtcctaccgaacgaaccgaccgtaccccagtccttactactacgttcgtttaacgtaaactaacggttactaccggtaccgtcggtaccgggttccgacgttaccgtcgtttcctcgttaccggtacccgtaccgtaccgggcccgtaccgtacccgtccgtacccgtcccgtacccggtcgcctacgtcgtaccgtcccgggtactaccggcggttacgacggtacgtacgtacgcggttcgttaagttcgtttaccgtccgtacgaccgttacgttacccgttagtaaccgtaccgaccggttacttccgggttaccggttggtttaccgggttttcggggttaccgggtaccggggtttaacccgggggacggtttaaacccggttaccggtaccgggtttaacccggttaccggggttcccgttaaaccggggg

SEQ ID NO: 29163 - DNA, 1029 bp, Homo sapiens
  misc_feature: GYAE6OF02I8SIC.42.15.B04.1.454.CMB.1.raw
  modified_base (119)..(119): a, c, t, g, unknown or other
  misc_feature (119)..(119): n is a, c, g, or t
  modified_base (169)..(169): a, c, t, g, unknown or other
  misc_feature (169)..(169): n is a, c, g, or t
  modified_base (932)..(932): a, c, t, g, unknown or other
  misc_feature (932)..(932): n is a, c, g, or t
tcagtgacgtatgtcacgaccggtgctcgatttagacagtatatagtccgcgggctgcttcagctgtggcacaagaggcagcactcaggacaatctccagcatgcctgtctcctctccnctcactctcctcgcttcactgcactacggctccgtggacccagttctgtnccgtaggaccgactcggccctcccgtacgcggttcgtccgggtccgggggcccctaaggggtccgacgggtacgggtactaccgttcttaacgtttttcgtgggaccttaaccgggtgggggtaacgtttccgggttaccaaacggtacggttccgggggtaccttaggggttttacgtacgttaccgggttaaccgtcggttaaaccgggtacccgtaaggtaccccgtaaccggtttacccggtttaaccggaaaacccgggttaaacctaacccccggacccccccggttaaaactttaccccgggttttaaacctttaccggttttaaaccgggttttaccgtttttaaaaccggtaaaccccgttaaaagtttaaacccggttccccgggttaacccgggttaacccgggttaacccgggggttttcccaccggggtttaaccccgttaaggttttccccgttccgggttaaaccccggtaacccttaccccggggttaaaacccgggttcccctaaacccccgttacccgtaaaccccggttccccggttacccccggttttacccccggaaaccgggtttccccgtaaaccttaacccggggtttccccgggaacccggtttaccccggttaaccgggtaacccggttcccgggtaaacgggttaaacgggtccgggtaaccgggtttaggaccgttttaacggtaaccgtttacgttaaccgttaccggtacccgtttacgttacctacgttaanaaccccgttaacgtcgttaccgtcgttaaccggtcggtcggttacgggttccggaggttaccggaacgtgaccggttaccggtacgtaccggttacg

SEQ ID NO: 29164 - DNA, 521 bp, Homo sapiens
  misc_feature: GYAE6OF01DIVZP.34.72.G06.1.454.CMB.1.raw
  modified_base (200)..(200): a, c, t, g, unknown or other
  misc_feature (200)..(200): n is a, c, g, or t
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctccagataccaccggagaaattgtgttgacacagtctccagccacctgtctttgtctccaggggaangccaccctctcctgcagggccagtcagagtgttagcggctacttagcctggtaccagcagaaacctggccaggctcccaggctcctcatctatgatgcgtccaacnggccatgcatcccagccaggttcagtgcagtgggtcngggccagacttcactctcaccatcagcagcctagacgacctaaagtattttgactaattttattactgtacagtctgcgtagctaacgtcgacctcccgttgacgtccgtccgttcggccggagggacacgacgtggaacgtaacttaaacgaactggtcgctagcacatctgtcttc

SEQ ID NO: 29165 - DNA, 547 bp, Homo sapiens
  misc_feature: GYAE6OF01BR30D.34.72.G06.1.454.CMB.1.raw
  modified_base (202)..(202): a, c, t, g, unknown or other
  misc_feature (202)..(202): n is a, c, g, or t
  modified_base (437)..(437): a, c, t, g, unknown or other
  misc_feature (437)..(437): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctccagataccaccggagaaattgtgttgacacagtctccagccaccctgtctttgtctccaggggaaangccaccctctcctgcagggccagtcagagtgttagcggctacttagcctggtaccagcagaaacctggccaggctccaggctctcatctatgatggctaccaaacgagggccagtggcatcccagcctagggttcagtcggcaggtgggtctgggcctagaccttcactctcaaccatcagcacgcctagacgactaagtatttgactaatttattactgtacagtctgtcgtancaacgtcgacccttccgttgacgtccgtccgttcgggccgtaggaccgacgtacgtagggaacgtacgttaaacggacgtcggtacgtctcgactacatcgtgttcttac

SEQ ID NO: 29166 - DNA, 526 bp, Homo sapiens
  misc_feature: GYAE6OF01BEIFV.34.72.G06.1.454.CMB.1.raw
  modified_base (203)..(203): a, c, t, g, unknown or other
  misc_feature (203)..(203): n is a, c, g, or t
  modified_base (518)..(518): a, c, t, g, unknown or other
  misc_feature (518)..(518): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcggctacttagcctggtaccagcagaaacctggccaggctcccaggctcctcatctatgctacatccaccagggccactgctattccagccaggttcagtggcagtgggtctgggacagagttcactctcaccatcagcagcctgcagtctgaagattctgctactttattactgtcagcagtctaataagtggaccgtggacgtttcggacctaagggaccaagggtggaaatcgaaaacggacctaggtcggctgacaccgtattcctaggttccttnacttcccg

SEQ ID NO: 29167 - DNA, 549 bp, Homo sapiens
  misc_feature: GYAE6OF01BIJW0.34.72.G06.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
  modified_base (397)..(397): a, c, t, g, unknown or other
  misc_feature (397)..(397): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcggctacttagcctggtaccagcagaaacctggccaggctcccaggctcctcatctatgatgcgtccaacngggccactggcatcccagccaggttcagtggcagtgggtctgggccagacttcactctcaccatcagcagcctagagacctaaagtntttgactaatttatactgtacagtctgcgtagctaacgtcggacccttccgttgacgtccgtccgttccggccgagggaccacggtacgtacgggagtaacgttaaacggacttcggtacggtctacgaccacctagttcctggtccttacg

SEQ ID NO: 29168 - DNA, 490 bp, Homo sapiens
  misc_feature: GYAE6OF01EULKP.34.72.G06.1.454.CMB.1.raw
  modified_base (203)..(203): a, c, t, g, unknown or other
  misc_feature (203)..(203): n is a, c, g, or t
  modified_base (461)..(461): a, c, t, g, unknown or other
  misc_feature (461)..(461): n is a, c, g, or t
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcggctacttagcctggtaccagcagaaacctggccaggctccaggctcctcatctatgatgcgtccaacagggccactggcatcccagccaggttcagtggcagtgggtctgggccagacttcactctcaccatcagcagcctagagcctaaagattttgactaatttattactgtcagctgcgtagcactgcctcctgacgcgccttcggcgaggcacgcnggagataagatgngcngcacatctgtctc

SEQ ID NO: 29169 - DNA, 635 bp, Homo sapiens
  misc_feature: GYAE6OF01CT75K.34.72.G06.1.454.CMB.1.raw
  modified_base (200)..(200): a, c, t, g, unknown or other
  misc_feature (200)..(200): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctccagataccaccggagaaattgtgttgacacagtctccagccacctgtctttgtctccaggggaancgccaccctctcctgcagggccagtcagagtgttagcggctacttagcctggtaccagcaagaaacctggccaggcctccgagacgtcctcatctatgctacatcccacacggccactgctattccagcctaggttcaggtcggacgtaggttcggggtctaggggacaggtagttccgacttctcaacctatcagtcacgcctgactagtactagaacgtactttctagtacttacgtttttataccgttgttaccgaagtcttaacgttacgttaaagttaacggtccgggttaccgtacgggtaaccggtttcggaacccgtaagggaacccgtaagggtaacgaaacgttacgaaaaccggtacgttaggacgggtccttacgaacccttaccgttaacgtccgttagttaccttccgaacgtttcccccg

SEQ ID NO: 29170 - DNA, 543 bp, Homo sapiens
  misc_feature: GYAE6OF01DLHG5.34.72.G06.1.454.CMB.1.raw
  modified_base (363)..(363): a, c, t, g, unknown or other
  misc_feature (363)..(363): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggacagagccacctctcctgcgggccagtcagagtgttggcagcaacttagcctggtaccagcagaaacctggccaggctcccagagtcctcatctatgctacatccaccaggccactgctatccagccaggttcagtggcagtggtctgggacagagttcactcncaccatcagcagcctgcagtctgaagtattctgctactttatactgtcagtcagtactaataagtggtccgtaggacgttccggacgaaaggggtaacccgtaaagggtgggtaaaactcgaaaaacgggtactagggtcggacctacggacctaaccgattcttacggtctttcgaccg

SEQ ID NO: 29171 - DNA, 544 bp, Homo sapiens
  misc_feature: GYAE6OF01CVTBQ.34.72.G06.1.454.CMB.1.raw
  modified_base (202)..(202): a, c, t, g, unknown or other
  misc_feature (202)..(202): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctccagataccaccggagaaattgtgttgacacagtctccagccaccctgtctttgtctccaggggaaangccacctctcctgcagggccagtcagagtgttagcggctacttagcctggtaccagcagaaacctggccaggctcccaggctcctcatctatgatgcgtccaacgacgggccacgtggcatccccagcccagggttccaggtcggcaggtgggtctgggccagcttcactctcaccatcagtcacgcctagacgtacctaaagtattttagactaaatttattactgtcagtctgcgtagactaacgtcgcctccttgcgtcgtccgttcggaccggagggacacgtacgtaggaagtaacttaaacggagtcggtaggactgcctacattctgttcttacc

SEQ ID NO: 29172 - DNA, 573 bp, Homo sapiens
  misc_feature: GYAE6OF01B981W.34.72.G06.1.454.CMB.1.raw
  modified_base (204)..(204): a, c, t, g, unknown or other
  misc_feature (204)..(204): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanagccaccctctcctgcagggccagtcagagtgttagcggctacttagcctggtaccagcagaaacctggccaggctccaggctcctcatctatgatgcgtcaacagggccactggcatcccagccaggttcagtgcgagtgggtctgggccagacttcgactctcaccatcagcacgcctagagtacctaaagtatttgactaatttattactgtcagtcgtgtacgtagctaacgtcggcccttcccgttgtacggccgtaccgttccgggaccggacgggaccgaccggtacgtagggtaacgtaacgttaaacggaacgttgggtacggtacgtacggtaccaccgtatccgttcgttcgttcccg

SEQ ID NO: 29173 - DNA, 704 bp, Homo sapiens
  misc_feature: GYAE6OF01EC88M.34.72.G06.1.454.CMB.1.raw
  modified_base (151)..(151): a, c, t, g, unknown or other
  misc_feature (151)..(151): n is a, c, g, or t
  modified_base (201)..(201): a, c, t, g, unknown or other
  misc_feature (201)..(201): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccgganaaattgtgttgacacagtctccagccacctgtctttgctcgaggggaaancgccacctctcctgcagggccagtcagagtgttagcggtctacgttagcctggtaccagcagaacctggccaggctccgaggctcctcatctatgatgacgtccaacgacgggccacgtcggcactcccgaagtccctagggttccaggtggacgaggttcggggtctggggacctaggtaccttcacctcgtaccaacctatccacggtcaacggtccctacggtactaccgttaaaagtacgttttaacggtaaccttaaattttaacgtttaacttacggttaccgtaacggtccttggtaccggttaacgaccgtaaacgttccggtacccgttccccgttaggtaaccggtcccggtcccgtttaccggggaccccgggtaacggggtaaccgacccggtaacgtacgggtaaacgttaaacggttaaaaacccggacgttcggtaccgggtacctaccggtacctaaccgaactttccgttacggttcctttacccg

SEQ ID NO: 29174 - DNA, 724 bp, Homo sapiens
  misc_feature: GYAE6OF01BTY84.34.72.G06.1.454.CMB.1.raw
  modified_base (452)..(452): a, c, t, g, unknown or other
  misc_feature (452)..(452): n is a, c, g, or t
tcagtacacgtgatcacgaccggtgctcgatttagctacgactgcaaggggaaggggaggaactgcgtcacgttaggacccaggagggtaaccagtggtaagcccctagctcagcttctcttacctcctgctactctggctccgagtagtaccacggagtaatttgttgttgacactagttactccacgacctacccttgtactttgcctaccgtaggggtaaagcgtcccaccggtctcctggaccgaggggccggtacgtcgagtacgttcgttacgcggtctacgttacgcccttggtaccagtccaacgtaaccgtggacccaggtcctccccgaggtcctccgtcacgttcctagtggacttcgggccggttaccgaacggtacggggcctaacggtcggaccactcccgtaggccgtaggttcgaggtggactagggtcgggtccncgggacctagtaccttcgactcgtaccgacctatcacgccacgaccgtaagaacgtaaccgttaaagtacgtttagacgtaagttacttacgttacgttagtaacgtagtactaacgtacgtacgaacgacgacgtacgtacggtacgggttacgttacggaccggtaacgggaccgtaagggtaacgtaaacgtacgtaaacggtacgttaggtacggtcgtacgtacgtaccgtaacttacgttacgttccgtttaccgaccgttacccg

SEQ ID NO: 29175 - DNA, 543 bp, Homo sapiens
  misc_feature: GYAE6OF01ARU3Q.34.72.G06.1.454.CMB.1.raw
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacgcagtctccagccaccctgtctttgtctccaggggacagagccaccctctcctgcggggccagtcagagtattagtagctacttcttagcctggtatcagcagaacctggcctggcgcccaggctcctcatctataatgcctatagcagggccacgtggcgtcccagactaggttcaggtgcgagtgggtcgtggggcagtacttcacgtctcacatcagcagacgtggacgtcctagaagtatttcgactagttgttatttagttgtactacgctagctatcctagtccgtactaccgttactacgtttcggaccgtagggacctagtcgtaggatagtacgaaacgtactggtacgactagactctacgtcgttacg

SEQ ID NO: 29176 - DNA, 616 bp, Homo sapiens
  misc_feature: GYAE6OF01EW2T1.34.72.G06.1.454.CMB.1.raw
  modified_base (202)..(202): a, c, t, g, unknown or other
  misc_feature (202)..(202): n is a, c, g, or t
  modified_base (304)..(304): a, c, t, g, unknown or other
  misc_feature (304)..(304): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccacctgtcttgtctccaggggaaagngccaccctctcctgcagggtcagtcagcgttctaacaccgacttctcgcctggtaccagcagagacctggccaggctccaggctcctcattcaggtcgcgcncgcgccacgtcgactcgtccacgacgtacgtacgaggtcgacgtaggtcggtcggtacgggtacgtacggtacgtacgacttctacctactactacgacgacgacgtacgtagacgtcgtagtacgttagttacgtacgagtttagtacttaactagtactaacgtactaatatacgaagtaacgtcgacgtagtcgggtacgttacggtccggaacgggtaccgtaacgggtacgggaaacgacgtaaacggtaaacgtacggtacggacgtacggtacgtaccgtacgtaccgtacgttcgttccgtacg

SEQ ID NO: 29177 - DNA, 778 bp, Homo sapiens
  misc_feature: GYAE6OF01DEEM2.34.72.G06.1.454.CMB.1.raw
  modified_base (202)..(202): a, c, t, g, unknown or other
  misc_feature (202)..(202): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctccagataccaccggagaaattgtgttgacacagtctccagccacctgtctttgtctccgaggggaaancgccacctctcctgcagggccagtcagagtgttagcggctacttagcctggtaccagcagaaacctggccaggctcccaggcctcctcatctatcgatcgcgtccaacgacgggcccacgtggccaacgtccccaggtcccaaggttccaaggttcggacgtacggttggggtacctggggaccctaaggtaccttcgaacttcctaccaaccctactcgaagtccgaacgtacccttaaggaccgtaaccttaaaggttactttttacggaaccttaaagtttttaacttaacgttcgttacctacggtacgttacggtaccggtttagacccgtaaaccggtttccgggtaccccgtttaccccgtttaggggtaacccggttccccggttaaccccggttttcccggggaaccccggggtaaacggggtaccccgtaaacccgggaccgttaacggggaaaccggttaaaccggtttaaaaacccgggaacccggtttgggtaccgggtaacccgtttacggaaccccttaacccgttaagtttcccgtttacggttacccttttaaccccgg

SEQ ID NO: 29178 - DNA, 760 bp, Homo sapiens
  misc_feature: GYAE6OF01C3998.34.72.G06.1.454.CMB.1.raw
  modified_base (206)..(206): a, c, t, g, unknown or other
  misc_feature (206)..(206): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagatacccaccggagaaattgtgttgacacagtctccagccaccctgtctttgtctccgaaggggaaanacgcccaccctctcctgccagggccagtcagagtgttagcggctacttagcctggtaccagcaagaaaccctggacccaggccctcccgaggcctcctcaatctatgatcgcgtaccaacgcggccacgtggccactccccgagccctaggttcaggtcgcgtagggtcgggtcgtcggggacctagtaccttccgacttccgtacaaccatcgacgccaacgtaccgtacggaacgtaaccgttaaagttacgtttttacgaacgtttaaacttttacgtttacgttacgttaccgtaacgtcgttacggtacggttaacgtaccgtaacgttcccggtaccccgttcccgtttacgggtaaccggtcccggttaccccggtttacccggggacccgggtaaccggggtaacccgtaaccgggtaaccggttaggggtaaaccggttaaaacggtttaaaacccgggtaaaccggtttacggggtaccgggttacccgtacccggtaaccctaacccgttaccgtttacccgtttcggttccctttaaccccg

SEQ ID NO: 29179 - DNA, 630 bp, Homo sapiens
  misc_feature: GYAE6OF01C4JYU.34.72.G06.1.454.CMB.1.raw
  modified_base (203)..(203): a, c, t, g, unknown or other
  misc_feature (203)..(203): n is a, c, g, or t
  modified_base (463)..(463): a, c, t, g, unknown or other
  misc_feature (463)..(463): n is a, c, g, or t
  modified_base (476)..(476): a, c, t, g, unknown or other
  misc_feature (476)..(476): n is a, c, g, or t
tcagtacacgtgatcacgaccggtgctcgatttagctacgactgcaaggggaaagggggaggaactgctcagttaggacccagagggaaccatggaagccccagctcagcttctcttcctcctgctactctggctccagataccaccggagaaattgtgttgacacagtctccagccacctgtctttgctacgaaggggaaancgcccacctctcctgacgagggccagtcagtagtgttaggcgtctacttagcctggtaccagcaagaaccgtggccaggcctccgaggcctcctcatctatgatcgctaccaacgcggaccacgtggcctactccccgaagcccgtaaggttcaggtcgcgtagggtcgggtacgtcggggaccagtaccttcaacgtcctacacctatcagtcacgtacctagaacgtaccgtaaagtgttttacgaactttaaatttntttacgtgttacngtactggacgttaacgacgtaacgtccgtacccgttacccgtggacgtcccgtccggttacgggcggaacggaccacggtacgtagggaaacgtaacggttaaacgaagttgggtacgtaccacgtacccgacttagttcctcgttcttacccg

SEQ ID NO: 29180 - DNA, 530 bp, Homo sapiens
  misc_feature: GYAE6OF01DTE1X.34.72.G06.1.454.CMB.1.raw
  modified_base (202)..(202): a, c, t, g, unknown or other
  misc_feature (202)..(202): n is a, c, g, or t
  modified_base (358)..(358): a, c, t, g, unknown or other
  misc_feature (358)..(358): n is a, c, g, or t
  modified_base (525)..(525): a, c, t, g, unknown or other
  misc_feature (525)..(525): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctccagataccaccggagaaattgtgttgacacagtctccagccaccctgtctttgtctccaggggaaangccaccctctcctgcagggccagtcagagtgttagcggctacttagcctggtaccagcagagacctggccaggctcccagagtcctcatctatgctacatccacagggccactgctattccagccaggttcagtggcaggtgggtctgggacaggngttcactctacaccatcagcagcctgcagtctagaagtacttctgcttactttattactgtacagctagtctaagtagtcggtcgtggtacgttcggaccgaagggaccgaagggtacgaaacgtacgaaacgtacgtaggtcggctagaccactatactcgtcttntaccg

SEQ ID NO: 29181 - DNA, 554 bp, Homo sapiens
  misc_feature: GYAE6OF01EPFQ6.34.72.G06.1.454.CMB.1.raw
  modified_base (203)..(203): a, c, t, g, unknown or other
  misc_feature (203)..(203): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcggctacttagcctggtaccagcagaaacctggccaggctcccaggctcctcatctatgatgcgtccaacagggccactggcatcccagccaggttcagtggcaggtgggtctgggccagacttcactctcaccatcagcagcctagagtactaaagtatttgactaatttattactgtcagtctgcgtagctaacgtcggtcctcccgttggacgtccgtccgttccgggacccggagggacctaccggacgtagggaacgtaacgttaaaccggaacgtggtacggctaggaccaccatccgttgtccttaccg

SEQ ID NO: 29182 - DNA, 600 bp, Homo sapiens
  misc_feature: GYAE6OF01CUN10.34.72.G06.1.454.CMB.1.raw
  modified_base (206)..(206): a, c, t, g, unknown or other
  misc_feature (206)..(206): n is a, c, g, or t
  modified_base (373)..(373): a, c, t, g, unknown or other
  misc_feature (373)..(373): n is a, c, g, or t
tcagtacacgtgatcacgaccggtgctcgatttagctacgactgcaaggggaaagggggaggaactgctcagttaggacccagagggaaccatggaagccccagctcagcttctcttcctcctgctactctggctcccagatacccacggagaaattgtgttgacacagtctccagcccaccctgtctttgtctccgaaggggaancgcccaccctctcctgcgagggccagtcagtagtgtagcggctacttagcctggtaccagcaagaacctggaccaggcctcccgagtcctcctcatctatgactcgcgtaccaagacggcctagtggaccactcccgagcctaggttcaggtcgcgtaggtgggtcncgggacctagtaccttcactctaccacatccgagcacgtcctagacgtaacgtaaagttacttttacgaacttaatttacttacgttgtactacgtcgtacgacgtacgacgtaacgtcgtacccttccgttggaccgtccgtccgtcgggcggacggtaccacggtacgtaggaacgtaacgtaacggacgttggacgtcgtacgtacctactatctgttccttac

SEQ ID NO: 29183 - DNA, 655 bp, Homo sapiens
  misc_feature: GYAE6OF01CX9V4.34.72.G06.1.454.CMB.1.raw
  modified_base (197)..(197): a, c, t, g, unknown or other
  misc_feature (197)..(197): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctccagataccaccggagaattgtgttgacacagtctccagccacctgtcttgctcgaggggaancgccacctctcctgcagggccagtcagagtgttagcgtctacgttagcctggtaccagacaacgaacctggaccaggcctcccgaggcctcctcatctatgactcgccgtaccaacgcgggccaacgtggacctacgtcccaggtccctaaggttcaggttggcgtagggtcgggtcgtcgggacctaaggtaccttcgaaccttccaccgtaacctagtccgacgtcgacgtaccgtaaggacgtaaccttaaaggttacttttacgaactttaaacttttacgttaaccttgtactacgtcgttacggtacgtaacgacctaacgtcggtacccttccggttagaccgtccgtccgttaccgggccggtaacgggtacctacggtacgtagggaacgtaacgttaaacggacgttcggtacggtcctaggaccctacgtattcgtcgttcttaccg

SEQ ID NO: 29184 - DNA, 620 bp, Homo sapiens
  misc_feature: GYAE6OF01C5FB1.34.72.G06.1.454.CMB.1.raw
  modified_base (203)..(203): a, c, t, g, unknown or other
  misc_feature (203)..(203): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanacgccacctctcctgcagggccagtcagagtgttagcggctacttagcctggtaccagcaacgaacctggaccaggtcctacccgaggccttcctcaactctatgattcgcgtacccaaagcgggcccagtggccacgtccccagtcccgaaggttccaggtcggctaggttcgggtctcgggcctaggtaccttcgactccgtacacccgtatccagccacgtcctagacgtacctaaagtattttagaacttaattttacttactagtacagtctgtacgtagacctaacgttcgtacccttcccgtggacgtccgtacccgttcgggaccggtacgggaaccacggtacgtggaacgtaacgttaaacgacgttcggtacgtcctcgtaccgtacctagttcctgttcttaccg

SEQ ID NO: 29185 - DNA, 784 bp, Homo sapiens
  misc_feature: GYAE6OF01C939W.34.72.G06.1.454.CMB.1.raw
  modified_base (204)..(204): a, c, t, g, unknown or other
  misc_feature (204)..(204): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggcctccagataccaccggagtaaattgtgttgacacagtctccagccaccctgtctttgtctcgaaggggaanacgccaccctctcctgcagggccagtcaggagtgttagcggctactagccgtggtaccagcaacgaaaccgtggaccacggtcctacccgaggtcctcctacacttctaagtgactcgaccgtaccaacgacgggaccctacgtcggacctactccccgaggcccgtaacgggttcgaggtcggtccgtagggttccggggttcgacggggtacccaacggtaccctttcgaaccgttcctaccgaacctacgtaccgacgccgtaacgaccttaacggtaaccgtaaccgttaaaaggtttactttttacgaactttaaagtttttacgttacgttgtaccgtagtccttacggccgaacgtaccgaccgttaacccggtccgttaccccgttaccgttggacccggttcccggttcccgtttaccccggggccgggaacccgggtaaccgtcccgggttaaaacggtacggggtaaaccgttaaaacccgggtttaaaacggaccggttttacggggtaacccggtaccgtaccgggtaacccttaccgttacctttccgggtttcttttaaccccgg

SEQ ID NO: 29186 - DNA, 662 bp, Homo sapiens
  misc_feature: GYAE6OF01C2X2J.34.72.G06.1.454.CMB.1.raw
  modified_base (203)..(203): a, c, t, g, unknown or other
  misc_feature (203)..(203): n is a, c, g, or t
tcagtacacgtgatcacgaccggtgctcgatttagctacgactgcaaggggaaagggggaggaactgctcagttaggacccagagggaaccatggaagccccagctcagcttctcttcctcctgctactctggctccagataccaccggagaaattgtgttgacacagtctccagccaccctgtctttgtctccaggggaaancgccaccctctcctgcagggccagtcagagtgttagcgctacttagcctaggtaccagcaacgaacctggccaggcctccaggcctcctcatctatgatcgcgtccaacgacgggacccagtggacacgtccccgaagcccgtaagggtttcaggtcggcgtaagggttcggggtcgtcggggtaccaggtaacctttcgaccttcttacaaccctatcgacgcacgacccgtagacgtcctaggtaacgtacttttggacgtaggttagttaacgtttacgtcgtactaacgtaggtttgtacctacgaacctacgtacgttcgggtaccgttcgggaccgtaacggggtaccgaaagggttaacggtaaaacgtaccgaaaacgtaaccggttaggtacggtacgtcgaccgtacccacgtttcctacggttcctttactacgttcccgttaccccg

SEQ ID NO: 29187 - DNA, 711 bp, Homo sapiens
  misc_feature: GYAE6OF01AR154.34.72.G06.1.454.CMB.1.raw
  modified_base (196)..(196): a, c, t, g, unknown or other
  misc_feature (196)..(196): n is a, c, g, or t
  modified_base (285)..(285): a, c, t, g, unknown or other
  misc_feature (285)..(285): n is a, c, g, or t
  modified_base (447)..(447): a, c, t, g, unknown or other
  misc_feature (447)..(447): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctccagataccaccggagaattgtgttgacacagtctccagccacctgtcttgctcgagggaancgccacctctcctgcgagggccagtcagagtgtagcggcttacgtgcctggtaccagcaagaacctggccaggcctccgaggcctcctntactctaatgatcgtaccgtaccgaaaccgtcggggccctaacgtcggacctaccgtccccaggtaccccgttagggtttcccaggttccgggacgtacgggttcgggggtaccttacgggggaacttacggtaccgtttcaacctttcccgacgtaacccnttacccaacgtacgggtaccttcgggaaccgtcccgtaggtaaacgtttagttttacggacgttaaggtttacggttaactttacggtacgtaaccgtaagttacggtttcggtacctacgaacgtaacgtaccgggttacggtaccgggtttaccggacccgtaaacggggtacgaaggtaacggaaagtacccgaaacggtaacgtcggtgccgtacgacctacgtactacgttcgttacttacctaccttccgttcccgac

SEQ ID NO: 29188 - DNA, 565 bp, Homo sapiens
  misc_feature: GYAE6OF01BJDIM.34.72.G06.1.454.CMB.1.raw
  modified_base (204)..(204): a, c, t, g, unknown or other
  misc_feature (204)..(204): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtgttagcggctacttagcctggtaccagcagaaacctggccaggcctcccaggcctcctcatctatgatcgctccaacgcgggccacgtggccactccccgagccctaggttcaggtggcgtaggtcggggtctcggggcctaggtaccttcaccgttcctaccacctatccagccacgcctagacgtaccttaaagtatttagacttaatttattactgtactagtctgtcgtagctacgtcgtcctccgtgacgtccgtccgttcggccgaggaccacgcgtaggacgtaacttaacgacgtggtcgactcgcactatcttgtcttaccg

SEQ ID NO: 29189 - DNA, 806 bp, Homo sapiens
  misc_feature: GYAE6OF01B7NWS.34.72.G06.1.454.CMB.1.raw
  modified_base (204)..(204): a, c, t, g, unknown or other
  misc_feature (204)..(204): n is a, c, g, or t
  modified_base (281)..(281): a, c, t, g, unknown or other
  misc_feature (281)..(281): n is a, c, g, or t
tcagtacacgtgatcacgaccggtgctcgatttagctacgactgcaaggggaaagggggaggaactgctcagttaggacccagagggaaccatggaagccccagctcagcttctcttcctcctgctactctggctccagataccacggagaaattgtgttgacacagtctccagccaccctgtctttgtctccgaaggggaaancgcccaccctctccgtgcgagggccagtcaggagttgtagcggtctacttagccgtaggtaccagcgaagtaaccgnggaccaggtcctacccgaggtcctcctactacttccgtaagtcgtacgtcggtacccgtaccgaaccggacggggcctaacgtcggacctaccgtacccgagtacgtacgggttacgaggtccggacgtaggggttcggggtacgtacggggacctaacggtaccttacgtaaccgtcctaaccctaacctacgtaccgaacccgtaggtaacggtcgggtaacgtccgttaaggtaacggtttacgtttcggaacggttagttaacgtttacgttacgttacggttaacctaacgggttcgggtttaccgtacctaaccgtaaccgtacgggttaacgggttaccggttaaccggggttacccggaaaccggggtaaacccgggtaaaccgggtaaggggttaaacggtaaaaccgttaacccgaaaacggttaacggttcgggtaaccgggtaccgtacggtaccctaaccggtactttccggtactttacctttacccggtacctttcccgtaccccgtacg

SEQ ID NO: 29190 - DNA, 601 bp, Homo sapiens
  misc_feature: GYAE6OF01COQ1D.34.72.G06.1.454.CMB.1.raw
  modified_base (202)..(202): a, c, t, g, unknown or other
  misc_feature (202)..(202): n is a, c, g, or t
  modified_base (403)..(403): a, c, t, g, unknown or other
  misc_feature (403)..(403): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctccagataccaccggagaaattgtgttgacacagtctccagcccaccctgtctttgctccgaggggaanagcccaccctctcctgccagggccagtcagagtgttagcggctacttagcctggtaccagcagaaacctggccaggcctcccaggcctcctcatctatgatgcgtccaacacggggcccacgtggccactccccgagcccgtaggttccaggtcggcgagggttcggggtcgtgggccaggtaccttcacctctccacctntcagctagtctgctagtctagtaagttattttcgacttagtttacttacgtgtacagtctaacttaataattaacggtcgtacctaccgtacttaccgtacccgttccggaccgaacgggtaccacggtacgtaggaacgtaacgttaaaccgagttcggtacgacgttcgacctaccgtattcctgttcctttaccg

SEQ ID NO: 29191 - DNA, 560 bp, Homo sapiens
  misc_feature: GYAE6OF01EW140.34.72.G06.1.454.CMB.1.raw
  modified_base (203)..(203): a, c, t, g, unknown or other
  misc_feature (203)..(203): n is a, c, g, or t
  modified_base (404)..(404): a, c, t, g, unknown or other
  misc_feature (404)..(404): n is a, c, g, or t
  modified_base (438)..(438): a, c, t, g, unknown or other
  misc_feature (438)..(438): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctcgaggggaaangccaccctctcctgcagggccagtcagagtgttagcggctactagcctggtaccagcagaaacctggccaggctcccaggctcctcatctatgatgccgtccaacgagggccactcggcactcccgagccaggttcagtggcaggtcgggtctcgggccagtacttcacttcgcacatcagcagcctagacgactaaagtntttgactaatttattactgtacagtctgacgtanacgtactcggtcctcccgttgacgtccgtccgttcggaccggtacgggacaccggtacgtacgggacgtaacgttaaaacgacgttggtacggacgtacgacctacgatccttgtccttacg

SEQ ID NO: 29192 - DNA, 773 bp, Homo sapiens
  misc_feature: GYAE6OF01A5WBF.34.72.G06.1.454.CMB.1.raw
  modified_base (210)..(210): a, c, t, g, unknown or other
  misc_feature (210)..(210): n is a, c, g, or t
  modified_base (212)..(212): a, c, t, g, unknown or other
  misc_feature (212)..(212): n is a, c, g, or t
  modified_base (221)..(221): a, c, t, g, unknown or other
  misc_feature (221)..(221): n is a, c, g, or t
tcagtacacgtgatcacgaccggtgctcgatttagctacgactgcaagggaaagggggaggaactgctcagttaggacccagagggaaccatggaagccccagctcagcttctcttcctcctgcctactcgtggcctcccagactacccaccggagaaattgtgttgacacagtctccagcccacctgttctttagctccgaggggaaancncccacctcncctgctagggccctagtccagtagtgttacgccggacttacgttacgccgtaggtaaccagggtacaacggaaaccctgggccgaacggtcctcccgaaggtccctacccttcacgttactagttacgacgttccggacccgtaaccgaaaccgcggggacccctaacggtccggaccaactttccccccgagggttaccctaacgggttcgaacggggtccgtaacggaggggttccgggttctaaccgggggccctaaaggtcctttaccgaacctttccgacgaaactctccgtaacgcgaacgtactacggacgtccgtaggtaaacttaggtttcgaatacgtattaccgttatccgtagaattacgaacttaacgtccggtaaagtcccgtagtaaccgttcgggtcggtacggtttaacccggaccgggttaaaccgaacccgggttaaagtacccgggaaaatttaaccgaaaccggttacggtacgttaacggacgttaaccacccggtaactaccggtaacttcgttaaccttcgtaacccg

SEQ ID NO: 29193 - DNA, 921 bp, Homo sapiens
  misc_feature: GYAE6OF01DNECX.34.72.G06.1.454.CMB.1.raw
  modified_base (203)..(203): a, c, t, g, unknown or other
  misc_feature (203)..(203): n is a, c, g, or t
  modified_base (259)..(259): a, c, t, g, unknown or other
  misc_feature (259)..(259): n is a, c, g, or t
  modified_base (291)..(291): a, c, t, g, unknown or other
  misc_feature (291)..(291): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctccagatacccaccggagaaattgtgttgacacagtctccagccaccctgtctttgtctcgaggggaaancgccaccctctcctgcagggccagtcagagtgttagcggctacttagctggtaccngcaagaacctgccaggcctcccgaggcctccncatctagtgatcgcgtaccaacgacggggccctacgtcggaccactaccccgaggtccccgtaagggtttcccgaagggttcggggaccgtaagggggtttccgggggtttacccgtcgggggacccctaaagggttaccccttttaccctaccccggtttcccttaaacccccgaaccccgttaaacgttaccccgaacggggtacccctaaaccgggttaacccccggttaacgggtaaaccccggtttaaccccgggttttaaaaaacggttttaactttttttaacgggtaacctttttaaaacgttttttaaccgtttttaacccgttaggtttaacccgtacggttaccgttacggttaacccggtttacggtaaacccgttaaaccgggttcccgggttaccccgttttaccccggtttaccgggtaccgggttccccggggtttacccccgtttacccgggggaccccggggttaaccggggacccggttaaccggaccggggttaaccgggtaaaacggttaaaaccggttaaaaccggtaaccggttaccggggtaccggttaccggtaccggtacccctaacccgtacttttacccggttcggtttccctttaaccccg

SEQ ID NO: 29194 - DNA, 718 bp, Homo sapiens
  misc_feature: GYAE6OF01AQTY1.34.72.G06.1.454.CMB.1.raw
  modified_base (206)..(206): a, c, t, g, unknown or other
  misc_feature (206)..(206): n is a, c, g, or t
  modified_base (505)..(505): a, c, t, g, unknown or other
  misc_feature (505)..(505): n is a, c, g, or t
tcagtacacgtgatcacgaccggtgctcgatttagctacgactgcaaggggaaagggggaggaactgctcagttaggacccagagggaaccatggaagccccagctcagcttctcttcctcctgctactctggctccagataccaccggagaaattgtgttgacacagtctccagccaccctgtctttgtctccgaaggggaaacncgcccaccctctcctgcagggccagtcagtagtgtagcgtctacttagcctggtaccagacaacgaaaccgtcggaccaacgggccctacccgaggtcctccctactacttacctaagtcgtacgtccggtccgtaacccgaaacggtcggggaccctaaccggtcggacccactccccgagccccgtaagggttccaggttcggcgaggttcggggtcgtcgggtacctaggtaccttccaccttccaccaacctactaccaaccgagtaccgtcggacgtaccgtaagtaacggttntttacggactaggtttacgttaacttacgtcgtaacctaaacgttcggtttacgtacctacgaaccgtacggaacggttaccggtaccggttaccggaacggttaacggaaccggtaaggtaacgaaacgtaacgaaaccgtagtaggtccggtactacgaccctacgtagttccgttacggttctaaccttccgttccccgttcccgtaacg

SEQ ID NO: 29195 - DNA, 800 bp, Homo sapiens
  misc_feature: GYAE6OF01BX590.34.72.G06.1.454.CMB.1.raw
  modified_base (202)..(202): a, c, t, g, unknown or other
  misc_feature (202)..(202): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctccagataccaccggagaaattgtgttgacacagtctccagccacctgtctttgcctcgaaggggaaancgccacctctcctgcaggccagtcagagtgttagcggctacttagccttaggaccagtcaacgtaaaccgtggaccgtaggcctacccgaggtcctccttacaacttcctaagtcgaatttcggaccgttaccgaaacgtacggggcctacggtaggacctacgttaccccgaggtaccccgtagggtttaccaacgggttcggacccggtaaggggttacggggttccgttcggggaacccgtaacggtaaccgtttccgaacttcctacccgaacctaacttccgagaccgtacgtcccgtaaggaacgtaacccgttaaagttacttttacggaacttaaacgttttaacttacgtcgttacgtattacggtacgtacgttaacacggtaaccgttaccggtcccgttacccgttacgggtaacgtcccggtttacccgttcccggggacccggtaacggggtaaccgaaccggtttaccggtaaggggtaaaccgttaaaccgtttaaaacccggggacgttccggggttacgggtaccctttacggaacccgtaacccgtaccgttttcgttaacggttcccgttttaacccg

SEQ ID NO: 29196 - DNA, 799 bp, Homo sapiens
  misc_feature: GYAE6OF01B8C30.34.72.G06.1.454.CMB.1.raw
  modified_base (203)..(203): a, c, t, g, unknown or other
  misc_feature (203)..(203): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctccagataccaccggagaaattgtgttgacacagtctccagcccaccctgtctttgctaccgaggggaancgcccaccctctcctgcacggccagtcagagtgtagcgtctactagcctggtaccagcaacgaaccgtcggaccacggcctacccgacggtccttcctactacttccttagtgacgtcggtaccgtaccgaaaccggacgggtacccacgtcggacctaacctccccgaacggtcccgtacgggttccgagggttcgggacgtacgggttcggggtaccggtacggggtacccaaggttaccctttacccgtaacctttccccgtaaccgaaccctaacgttaaccccaacccggttaacggaaccggttacgggaaccgtaacccgtttaagggttaacggtttaacgttttacgggaacgtttaacggttttaacggttaacgtttacgttaacggttaacctaaaccgtttacggttaccggtaccttaccgaaccgtacccggttaaccggttaccgggtacccggttacccgggaaccggtaacgggtaaccggtaaggtaacggtaaactaaccggaaacgtagtacgggtacgtaccgacgtaccaccgtacgttcgttacgttactcctaccttcccgtacccgtacg

SEQ ID NO: 29197 - DNA, 664 bp, Homo sapiens
  misc_feature: GYAE6OF01BYULF.34.72.G06.1.454.CMB.1.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggcctccagataccaccggagaaattgtgttgacacagtctccagcccaccctgtctttgtcctccgaggggaaacgngcccaccctctcctgcagggccagtcagngtgttagcggactactagcctggtaccagcaagaacctggccaggcctcccgaggtcctcctcatctatcgttacactcccgaccgaggccctagtcggtacctcccgagtccgtaggttcaggtggccgtaggttcgggtacgtaggggaaccaggtaacttcaacgttcacccactagttccgagtccgacgtccgtgaccgtacgtacgtagtaacgttagtttacgtacttaagttttactttacgtcgttaacgagtactaagttacttaagtaaccgtcgggtcccgttaccgggggtaccgttaccgggaaccggtaacggaaccgtagggtacgtaacgttaccgaaacgtacggtaggtcgtcgtacgacctacgtctaccgttcggttaccttactccgttcccttcccgtcgtacg

SEQ ID NO: 29198 - DNA, 619 bp, Homo sapiens
  misc_feature: GYAE6OF01BO61I.34.72.G06.1.454.CMB.1.raw
  modified_base (206)..(206): a, c, t, g, unknown or other
  misc_feature (206)..(206): n is a, c, g, or t
  modified_base (387)..(387): a, c, t, g, unknown or other
  misc_feature (387)..(387): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggcctcccagataccaccggagaaatcgtgttgacacagtctccagccaccctgtctttgtctccgaaggggaaancgcccaccctctcctgcgagggccagtcagagttgttagccggtctacttagcctggtaccaggcaagaaaccgtcggccaggcctcccgaggcctcctcatctaagtgatcggcctacccgaacgacgggcctacgtcggcactccccagtccagggtttcaggtgcgtagggtcgggtntcgggcacgctttcgcctctccgactatccagacacgctaagcgtacctaaagttctttagacttaatttcgtacgtgtcgtaagtctggtacgtcacgtaacgtccgtacccgttccgttgacgtccgttccgtcgggaccggtaggaccgacggtacggtaggtaactaacggttaaacacggttggacggtccgtaggcccttaacgtagtttccgttcgttccttacg

SEQ ID NO: 29199 - DNA, 588 bp, Homo sapiens
  misc_feature: GYAE6OF01DNA4Z.34.72.G06.1.454.CMB.1.raw
  modified_base (199)..(199): a, c, t, g, unknown or other
  misc_feature (199)..(199): n is a, c, g, or t
  modified_base (364)..(364): a, c, t, g, unknown or other
  misc_feature (364)..(364): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctccagataccacggagaaattgtgttgacacagtctccagccaccctgtcttgctcgaggggaaancgccacctctcctgcagggccagtcagagtgttagcgctactagcctggtaccagcaagaacctggccaggcctcccgaggtcctcctacatctatgatcgccgtaccaacgcgggccacgtcggcactccccgagcccaggttccagtcggctaggtcgggtcncgggcctaaggtacttcactccgtaccaaccgtatccgagccacgtccgtagaacgtacttaaagtattttacgacttaatttacttacgttcgttacagtcgtcggtacgtacgtacgtaacgtcggtcccttccgtgtacgtccgtccgttaccggcggtacggacacgacgtaggacgtaacgtaacgagtcggtacgcgtcgactactatctgtcttacg

SEQ ID NO: 29200 - DNA, 881 bp, Homo sapiens
  misc_feature: GYAE6OF01BGTAV.34.72.G06.1.454.CMB.1.raw
  modified_base (312)..(312): a, c, t, g, unknown or other
  misc_feature (312)..(312): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctcggcctccagactaccgacggaagtaagttgtgttgacacgtacgtctaccacgccctacccgttgttctttcgtccgtaccggaaaggggaaacgccgtaccctaccccgttcgtccgtgccgacgggccagtcagtgtgttagcgtactacgtgcgtacggtaccagacaacgtaaccgnggaccgacgtccgtacccgagtcctcctactacgtccgttagtcggtcgtaccacctaccgaccggacggtactacgtcgtactacccgagtccgtacggtcacggttcgacggttacgggtcggtacggtacggtacgaaagtaccgttaccgtaccttcccgtacgaccttacgacctacggtacaccgttcctacggtaccgtacgttacgttaaaggttacgtttaaccggtttttagaaccggttttaagttttaccgtagttttaccggtaacgtacggttaaaccgtttaaggtttaaaccgttaacgtttaacccgggtacccggggttttaaacccccggggttaacccgggggttttaacccggtttaaaccccggggaaacccgggtttaaaccgggggtaaccggttaaaccggggttaaacggttaaacccggttaaacgggtaaaaccgttccggtacgggtttaacggcccggttaacgtacccacggttaccgtttacccggtacggtttaaccccttcgttaaccccgtttcccccggtttaaacccgaccg

SEQ ID NO: 29201 - DNA, 912 bp, Homo sapiens
  misc_feature: GYAE6OF01C0S2G.34.72.G06.1.454.CMB.1.raw
  modified_base (344)..(344): a, c, t, g, unknown or other
  misc_feature (344)..(344): n is a, c, g, or t
tcagtacacgtgatcacgaccggtgctcgatttagctacgactgcaagggaaagggggaggaactgctcagttaggacccagagggaaccatggaacgccccagctcagcttctcttcctcctgctactctggcctccagactacccgacggaagtaaattgtagttacgacacgtacgtcctaccacgccctacccttgttcctttgtacccgtaccggaaagggggaaacgccgacccctaaccccttccgtaccgtcggaccgacggggcccagttacgaggtacgttaggttacgccggtactacgttacgccgtacggtaccagacgaacgtaacccgnggacccgacggtaccctacccggtacggcccttaccctacttacggtactaagtcggtaacgtccggtacccgtaaccgaacggtaccgggacctaacggtccgacccgtaaccgtacccccgaggtaccccgttagggttacccgtaggtccgggacgtacgggttacgggttccgaccgggtacctaacgtaccgtttacccaacggttcccaacctaacccggtatccaacggacctaaccgtaccgtaacggaacgttaaccgttaaaggttatttaaccgtaagtttaaaccttttaagtaccgtttagtacgtacgtaccgtagtaacccggttacgtacccgtaacgtttccgtaccccgtttaaccggttaccggacccggttaccggttaccccgggtttaccgggaacccgggtaaccgggaaccggttaaacccgtacccggggtaaagggttaaaacccggttaaacgggtaaaaccgttacgggttccggttacggtacccttaacggtacccaacccgttagttacccggtttacggttccctttaaaccccgg

SEQ ID NO: 29202 - DNA, 748 bp, Homo sapiens
  misc_feature: GYAE6OF01CW2I1.34.72.G06.1.454.CMB.1.raw
  modified_base (735)..(735): a, c, t, g, unknown or other
  misc_feature (735)..(735): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccgaccggagaaattgtgttgacacagtcctccagcctaccctgttctttgtcctaccgaaggggaaacgcgccctacctctcctgccgagggtccagtcagaggtgttagcggtactacgttacgccgtggtaccagacaacggtaaacccgtggacccaacgggtccctaccccgaacgggtcccttccctacgtaacgttccttaacgtcggtaacggttccgcccggttaaaccccaaacggaccggggtccccaacggttcgggaccctaccgttacccccgacggtccccgtaacgggttcaacgggttggacggtacgggttcggggtcgtccggggtaccacggttaccttacccaccgttacctaccgtaacccctaagttcccgaacgccgtaaccggtacccgtaacgaacggttaacccttaaaaggttcttttacggaacttttaacgtttacgttacgtgtactacggtctaggtacgtacacgtacgtccgtccttccgtagtacgccgtccgtacggcgacggacacgtacgcggaacgttaaacgtaacgacgtggaccgtcgtcggtacaacgtntccgtgtcctacg

SEQ ID NO: 29203 - DNA, 842 bp, Homo sapiens
  misc_feature: GYAE6OF01CQ068.34.72.G06.1.454.CMB.1.raw
tcagtacacgtgatcacgaccggtgctcgatttagctacgactgcaagggaaagggggaggaactgctcagttaggacccagagggaaccatggaagccccagctcagcttctcttcctcctgctactctggcctcccagataccaccggagtaaattgtgttgacacagtctccagccaccctgtctttgtcctccgaaggggaaagcgccaccctctcctgcgagggccagtcagtagttgttagcggtactacgttacgccgtacggtaccaggacaacgaaaccgtcggaccgacggccctacccgaggtccctcctacacttctatagacgttcgacccgtaccaaacggacgggccctaacggtcggcctaacccgtccccacggacccgtagggtttaccgaaggtccgggtgtacggggttcggggttacgtaccggggtacccaaggttacctttaccgtaacccgttccttaacccgaacccgtcgttacccgaacggtccctaaacggtaccccgttaaaggtaaccggtaaaccgtttaaaaggttttacctttttaacgggtaaacctttttaaaacggttttacctttaacccgttaggttaccgtaacggttaccccggttagggttaacccggttaacggaaccctttaacccgggttcccgggttacccccctttaccgggttccgggtacccggttccccggttaccccgggttacccggggacccgggtaacgggtaccgaaccggtacggttaaggaaacggtaaacgttaacggtacgtgggtccgacgtctaacctacgttcttcgtcgttccgttaccg

SEQ ID NO: 29204 - DNA, 791 bp, Homo sapiens
  misc_feature: GYAE6OF01AQSXQ.34.72.G06.1.454.CMB.1.raw
  modified_base (212)..(212): a, c, t, g, unknown or other
  misc_feature (212)..(212): n is a, c, g, or t
  modified_base (442)..(442): a, c, t, g, unknown or other
  misc_feature (442)..(442): n is a, c, g, or t
tcagtacacgtgatcacgaccggtgctcgatttagctacgactgcaagggaaagggggaggaacgtgctcagttaggacccagagggaccatggagccccagctcagcttctcttcctcctgctactctggctcccagatacccaccggagaaattgtgttgacacgagtcctaccagcccaccttgttctttgtcctccgaagggggaaanacgcccacccttctccgtgcgacggggccagttcaggagttcggttagaccggtccttactttacgccgtcggttaccagaccacggtaaacccgcggacccagggtcccttacccgacggtccttcccctacaccttccttaagcggttactcgggtacccttaccgaaccggtccggacccgtaccgttcgggacccacggtaccccaaggggcccttacgggttacncgggttcggaaccgtgggttgggtcccgtacgggccctaaggtcctttaccgacccgtttacaccccggtaaactctccgaacgggccgttacgtaccgtaacggaacgttacccgttaaaagtttaccgttttacggaaccttttaacgtttaacgttaccttaccgggttacgtacgttacgttcggtaaccggtactaaccgtaacgtccgtaccctttccggttacgacgtcccggttcccgtaccggtccggaacgtaccggtacgtaccggtacgacggttaacgtacgtaccggtggtacctcgtcgtaaccgtaccgtaccgtcttccggttacttacccg

SEQ ID NO: 29205 - DNA, 812 bp, Homo sapiens
  misc_feature: GYAE6OF01D155Q.34.72.G06.1.454.CMB.1.raw
  modified_base (602)..(602): a, c, t, g, unknown or other
  misc_feature (602)..(602): n is a, c, g, or t
tcagtacacgtgatcacgaccggtgctcgatttagctacgactgcaaggggaaagggggaggaactgctcagttaggacccagagggaaccatggaacgccccagctcagcttctcttcctcctgcctactctggcctcccagactaccaccggagtaattgtgttcgacacagtctccagcccaccttgtctttgtcctaccggaaggggaaacgacgccctaccctctaccgtcgaccgagggccagtccaggtagtcgttacgcggtaccttacgttacgccttacggtaccagaccgaaacgaaccgtcggaccgacggccctacccgacggtcctcctcactcctagtgacgtcgaccgtaccgaaccggcggacctcgtacggccctaaccgtcccgaagtcctaacgtacgttaccggaagggtcggacgttacggggttcgggtacggtccgggaccgtaacggttacccttacgtaacctcccgtaacgaaccctcgtaaccacgaccgtaacgtaccgtaaacgtacttaaacccgttaaagtttccgttttaagaaacctttaaggtttttaactacgttacggttaaccncggtttaccggtacgttaaccgtacgtaccctaacggttcccggttacccttaccggttacggtcccggttcccgtcccggttacggggacccggttaacggaaccgttacggtaagggtaccggtaaacttaaagggttaaacccggtggttacgggtaccgtaccgttacccgaaccgtaccgttacgtttccgttgtttaacccccg

SEQ ID NO: 29206 - DNA, 742 bp, Homo sapiens
  misc_feature: GYAE6OF01ERHO1.34.72.G06.1.454.CMB.1.raw
  modified_base (229)..(229): a, c, t, g, unknown or other
  misc_feature (229)..(229): n is a, c, g, or t
  modified_base (473)..(473): a, c, t, g, unknown or other
  misc_feature (473)..(473): n is a, c, g, or t
  modified_base (524)..(524): a, c, t, g, unknown or other
  misc_feature (524)..(524): n is a, c, g, or t
  modified_base (545)..(545): a, c, t, g, unknown or other
  misc_feature (545)..(545): n is a, c, g, or t
  modified_base (730)..(730): a, c, t, g, unknown or other
  misc_feature (730)..(730): n is a, c, g, or t
tcagtacacgtgatcacgaccggtgctcgatttagctacgactgcaagggaaagggggaggaactgctcagttaggacccagagggaaccatggaacgccccagctcagcttctcttcctctgctactctggcctccagactaccaccggataaattgtgttcgaacacgtacgtcctcccgaagtcccctaccttggttcctttacgtccgtaccggaaggggaaacncgccctaaccctctaccctggccacgggaccaggtcaaggtaggttcgttaacggcggtacttaacttcggccgttaggtaacccagaccgtaaacgtaaacccgtcggacccaacgggtcccttacccggaacggtcctacccgtacctaattacctagttacgacgtttcggaacccgttaccgaaaccggacgggtaccctaacggtcgaccctaacgtccccgaagtccggtaacggttnacgggtcgtcgtaggggttcggccggttacggacctaacggttaccttacnccgtttaccacgtacccgtancgacgtacacgtaccgtaagaaccgtaactaagttacgtttaacgtactttaaatttacgtacttacgtacgtcgtactagtacgtaacgactaacgtccgtactcgtcggtacgtccgtaccgtcggaccgacgggtaccaggtacgacggtactaacgtaacgtcgtgtacgctcggacactntctcgtctaccg

SEQ ID NO: 29207 - DNA, 824 bp, Homo sapiens
  misc_feature: GYAE6OF01CZ4PT.34.72.G06.1.454.CMB.1.raw
  modified_base (179)..(179): a, c, t, g, unknown or other
  misc_feature (179)..(179): n is a, c, g, or t
  modified_base (587)..(587): a, c, t, g, unknown or other
  misc_feature (587)..(587): n is a, c, g, or t
  modified_base (676)..(676): a, c, t, g, unknown or other
  misc_feature (676)..(676): n is a, c, g, or t
  modified_base (733)..(733): a, c, t, g, unknown or other
  misc_feature (733)..(733): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagactaccgaccggagtaattgtgttcgacacagtcctaccncgcccaccgtgttcctttgtccgtaccggaaggggaaacacgccctaccccgttctcccgtcggaccgacgggccctaggtccgaggtaaggttgtacggccggtacttaaccgttacgccgttacggtaccacggacaaaacggtaaacccgtcggacccgtacggtaacccgtcccgaacgggtccttaccctactaccgttcgttaacgtcggtaacgtttccgaaccgtaccccgaaacgggaccggaccccgtacggtcggtaaccctaccgtaccccgtaaacgggtacccgttaagggtttccgaaacgggttccggtaaccggtacgggggtttcggggtacccgtaccggggtaccgttaacctaccggttcctacccgtacctttcccgaaacccgtntacccgaacggtcgaacccgttaccggacggttaaacgtaacccgtttaaaagtttcgttttaataaccgttaatttacgttacgtacnccgttagctttcggaatccgtaccgtcgttaccgcctttaccggtcgacggttcccncgggttaccggccggaagtcccgtaacggtcgtagtaaaccgtaagtaccgggtagttcgcgaacgtctcacttcgtctgttccgttaccg

SEQ ID NO: 29208 - DNA, 733 bp, Homo sapiens
  misc_feature: GYAE6OF01A01ZW.34.72.G06.1.454.CMB.1.raw
  modified_base (205)..(205): a, c, t, g, unknown or other
  misc_feature (205)..(205): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagactaccaccggataaattgtgttgacacagtctccagccacctgtctttgtcctccgaggggtaanacgcccaccctctcctgcacgggccagtcgagtagtgttacgccggcttacgttacgcctacggtaccacgcgaacgtaaaccctcgggaccgacgggcctacccgaggtcctaccgtcacttctaatggtaactcggcccgtacgaacgtacgggccacgtcggacacgttaccccgacgtccgtaggttccgaggtcggacgtgggtttccggggtcgtacggggacctaggtacccgttacgaacccttcctaccgtaaacctcgttaccggacgtaccgtacggtaccgtaacggacgtaaccgttaaagtacgttttagaccgtaagtttacggttacttacgttacgttaacgaacgtacgtttcgtactaccgtacgtaccgtacggtacggtaccgttaccggaaccggaacggtaaccgaggttaacgtaaacgtaaccgtaaacgtaccgttaggtacgtactacggacctaccgtcgttaccgtcgtttacttaccttacctaccccgttccgtacc

SEQ ID NO: 29209 - DNA, 739 bp, Homo sapiens
  misc_feature: GYAE6OF01BG657.34.72.G06.1.454.CMB.1.raw
  modified_base (206)..(206): a, c, t, g, unknown or other
  misc_feature (206)..(206): n is a, c, g, or t
tcagtacacgtgatcacgaccggtgctcgatttagctacgactgcaagggaaagggggaggaactgctcagttaggacccagagggaaccatggaagccccagctcagcgttctcttcctcctgctactctggctcccagataccgaccggtagaaattgtgttagacacagtctccagccacctgtctttgctccgagggtaacncgccacctctcctgcacgggcagtcagtgtcgtagcggtctacgttacgctaggtaccagaccacgaaccgtggacctaaggtcctacccgacggtacctacccgtacacgttcctaagttcgaagttcggaccgttaccgaaacgtacggggtacccaccgtcgggtacctaccgtccccgtaacgtacccgtacgggtttaccgaggttccggcgtagggttcgggtcgcgggacctaacggtactccgactccgtacaactcgtacgacgacctagtacctacggacgtaccgttaaagttacgtttacgtactttaaagtttacttacttcggtaactacgtcttaccggtagttaacgtaccgtaaccgtccgggtttacccttaccggttacgcccgttaacccggtccccggttacgggacccggtaacgggacccgtaacggtaccggtaacgtaaccggttaacgttaaacggtaccgttggccgtaacgtcgtaccctactaccgtccttgtttccgtacccg

SEQ ID NO: 29210 - DNA, 796 bp, Homo sapiens
  misc_feature: GYAE6OF01B0KNQ.34.72.G06.1.454.CMB.1.raw
  modified_base (206)..(206): a, c, t, g, unknown or other
  misc_feature (206)..(206): n is a, c, g, or t
  modified_base (248)..(248): a, c, t, g, unknown or other
  misc_feature (248)..(248): n is a, c, g, or t
  modified_base (335)..(335): a, c, t, g, unknown or other
  misc_feature (335)..(335): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccaggccaccctgtctttgtctccgaaggggaaanacgccaccctctcctgccgagggccagtcagtagtagttaangcattctacttcgccgtggtaccagacacgaaacctggcccaccgccctacccacgtaccttcctactattaacgtggtcgactacncccgaccgacgggtcctacgttacggtactccccgaggtccgtaggttacgacggtacggtcgtagggttcgggtacgtcgggaacgtaggtacgttacctacctctaccgacccgtacgtccgtaacggtcgtacgttccgtagtcgtacgttaccgttaggtaaacgtttacgttttacggtacggttttaacttttacgtttaccggttacgtacctaacgttaactaaacgtttaacgttaaaggttaaccggttacccgggtacccgttaccgtaacccgttacccgttaacccgggtttaccccgggaaccggtaaacgggtaacccgttaacccgggtaaacggttaaccgggtaaacgttaaaccgggttaaaaccgtacgggtttaacgggtccggttaccgtacggtaacccgttaacccgtacttttcgttacccgtttcggttaacccc

SEQ ID NO: 29211 - DNA, 888 bp, Homo sapiens
  misc_feature: GYAE6OF01AZMJN.34.72.G06.1.454.CMB.1.raw
tcagtacacgtgatcacgaccggtgctcgatttagctacgactgcaagggaaagggggaggaactgctcagttaggacccagagggaaccatggaacgccccagctcagcttcctcttcctcctgctactctggcctccagactacccaccggaagtaattgtgttagacactacgtctaccacgccctaccttgttctttgtcctaccggaaggggaaacacgtacccctacccttcctccgtgaccgacgggcccagtcgaggtgttgttacggcggtacttacgtacgccgttacgaaccagtacaacgtaaccgtcggaccgtacggcctcccgacggtccctacctctacgttactacgtagtacgtcggacccgttaacccgaacggaccgggacccgtacgtccggtacctacccgtacccggaaacgtacggttacggttacggtaacgggtcgggtacggtaggggttacggggttacccggtaggaacccgtacgttaaccctttcctaaccgttacccgaccctaacgtaccgtacgacgtacgtacgtaccgttcggtaacgtaccgtaaggttaagtttacgtttacggaacgtttaacgtttaacttacgtttaacgtacgttacgtaacgtaactaacgtaaccgtaacggtaacggtaccgtaccggttacggggttcgggttacccggggttacggttacccggggaaaccgggtaaaccggggtaaaccgggtaaacgggttaaacggtaaaaccggttaaaccgggtaaaaccggttagggtaccggtttaccgggaccgttaaccggtaacccgttaaccggttacctttaccgggtttaccgttccccgttacccggtttacccccg

SEQ ID NO: 29212 - DNA, 659 bp, Homo sapiens
  misc_feature: GYAE6OF01EJI9Y.34.72.G06.1.454.CMB.1.raw
  modified_base (200)..(200): a, c, t, g, unknown or other
  misc_feature (200)..(200): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccacctgtctttgctcgagggaaancgccacctctcctgcagggccagtcagagtgttagcgctacttgcctggtaccagcagaacctggccaggcctccaggctcctcatctatgatcggccgtaccaacggcgggccctacgtcggacctacgtccccaggtccctagggttccaggtcgggaccgtaggggttcggggtaccgtcggggaccctaggtacctttcgaccttcccgtaccacctatccgacgtaccaacgtacctaaggaacgtaacccgtttaaaaggttacttttacggaactttaaagttttaaccttacgttacggttactacgtcgttaggtaccggtaacgaccgtaaccgtccggtccccttaccgtggtaccgcccgttcccgttcgggaccgacggaccacggtacgtaggtaacgtaagttaaaccgacgtggcggtctacgacctactatcgttgtccttc

SEQ ID NO: 29213 - DNA, 773 bp, Homo sapiens
  misc_feature: GYAE6OF02IXMUW.34.72.G06.1.454.CMB.1.raw
  modified_base (203)..(203): a, c, t, g, unknown or other
  misc_feature (203)..(203): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagtagttgttacgcggtacttacgtacgccgtacggtaccagacaaacgtaaaccgtcggaccgacggtccctaccccggaggtcccttccctactacttctaagtgtatcggtcctaaccaaacgggaccgggaccctacggtcggactacctaccccgacgaccgttaggttaccgagggtcggaccgtaggggttcggggttccggtcggggtaccaaacggttcctttaccgaccttccgtacccaaaccctacgtaccgaacgtaccgaccgtaaccgtaacgggaaccgttaaacccgttaaaagttttcgttttacgaaccttttaaaattttaactttacgttacgtaacgacgttccgttacggtacgtaacgaccttaacggttccggtacccctttacccgttaggaccgtcccgttacccggttccgggaccggtaacgggaacccgacggtacgtagggtaacgttaaacgttaaaacccgagttcggacggttacgtcggacctaaccttgtacgtttcgttaccttacg

SEQ ID NO: 29214 - DNA, 515 bp, Homo sapiens
  misc_feature: GYAE6OF02H574Z.34.72.G06.1.454.CMB.1.raw
  modified_base (350)..(350): a, c, t, g, unknown or other
  misc_feature (350)..(350): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcggctacttagcctggtaccagcagaaacctggccaggctcccaggctcctcatctatgatgcgtccaacagggccactggcatcccagccaggttcagtggcagtgggtntgggccagacttcactctcaccatcagcagctagagcctaaagattttgactaatttattactgttcagctgcgtagcaactggaccttccctgacgcgtccttcggccgagggacacgacgtggagtagttaaacgactgtagctgcacctatcttcgtcttac

SEQ ID NO: 29215 - DNA, 521 bp, Homo sapiens
  misc_feature: GYAE6OF02GG60I.34.72.G06.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (348)..(348): a, c, t, g, unknown or other
  misc_feature (348)..(348): n is a, c, g, or t
  modified_base (423)..(423): a, c, t, g, unknown or other
  misc_feature (423)..(423): n is a, c, g, or t
tcagtacacgtgatcacgaccggtgctcgatttagctacgactgcaagggaaaggggagggaactgctcagttaggacccagagggaaccatggaagccccagctcagcttctcttcctcctgctactctggctcccagataccaccggagaaattgtgttgacacagtctccagccaccctgtctttgtctccaggggaanagccacccttntcctgcagggccagtcagagtgttagcggctacttagcctggtaccagcagaacctggccaggctcccaggctcctcatctatgatgtgtccaacagggccatggcatcccagccaggttcagtgcagtgggtcngggccagacttcactctcaccatcagcagcctagagcctaaagattttgactaatttatactgtcagctgcgtancaactggccttcccttgacgcgccttcggccgtagggacgacgacgtggagagttaaaccgtaacgtacgtggacttcggccaccgatctgtccttac

SEQ ID NO: 29216 - DNA, 526 bp, Homo sapiens
  misc_feature: GYAE6OF02I10AS.34.72.G06.1.454.CMB.1.raw
  modified_base (204)..(204): a, c, t, g, unknown or other
  misc_feature (204)..(204): n is a, c, g, or t
  modified_base (344)..(344): a, c, t, g, unknown or other
  misc_feature (344)..(344): n is a, c, g, or t
tcagtacacgtgatcacgaccggtgctcgatttagctacgactgcaagggaaagggggaggaactgctcagttaggacccagagggaaccatggaagccccagcgcagcttctcttcctcctgctactctggctcccagacaccactggagaaatagtgatgacgcagtctccagccaccctgtctgtgtctccgaggggaaangccaccctctcctgcagggccagtcagagtgtggcagcaacttgcctggtaccagcagaaacctggccaggctcccagagtcctcatctatgctacatccaccaggccactgctatccagccagttcagtgcagtggtcngggacagagttcactctcacatcagcagcctgcagtctagaagtattctgctactttacttactgtcagtctagtctaagtagtcgtccgtggtaaccgttcggaccgtaagggacctaagggtacggaaacgtacgaaaacggtacgtaggtacggacgtacgccaaccgtattccgtacg

SEQ ID NO: 29217 - DNA, 530 bp, Homo sapiens
  misc_feature: GYAE6OF02G3QME.34.72.G06.1.454.CMB.1.raw
  modified_base (202)..(202): a, c, t, g, unknown or other
  misc_feature (202)..(202): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaangccacctctcctgcagggccagtcagagtgttagcggctacttagcctggtaccagcagaaacctggccaggctcccaggcctcctcatctatgatgcgtccaacgagggccacgtggcatcccagccaggttcagtggcaggtgggtctgggccagacttcactctcaccatcagcacgcctagacgacctaaagtatttgacttaatttacttactgtcagtctgcgtagctaacgtcggccttcccgtgacgtcgtccgttccggccggacgggacacgacgtggacgtaagttaaacgacgtggtcgctcgcaccatctgtctc

SEQ ID NO: 29218 - DNA, 586 bp, Homo sapiens
  misc_feature: GYAE6OF02GJNKT.34.72.G06.1.454.CMB.1.raw
  modified_base (202)..(202): a, c, t, g, unknown or other
  misc_feature (202)..(202): n is a, c, g, or t
  modified_base (450)..(450): a, c, t, g, unknown or other
  misc_feature (450)..(450): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaangccaccctctcctgcagggccagtcagagtgttagcggctacttagcctggtaccagcagaacctggccaggctcccgaggcctcctcatctatgatcgccgtccaacgacgggccacgtggccactcccagcctaggttcaggtggcaggtgggtctcggggccaggacctttcactctcaccatcagcacgcctagacgacctaaaggtatttagactaatttattacttgtctacgcttgcgtancctaacgtcgtcctccgttcgacgtccgtccgttccggccggaacgggaccaccggacgtacggaacggtaacgttaaaccggaacgttcggtacggtcgtacggacctaaccgtacttcgttcgttaccttaccg

SEQ ID NO: 29219 - DNA, 524 bp, Homo sapiens
  misc_feature: GYAE6OF02IFP71.34.72.G06.1.454.CMB.1.raw
  modified_base (203)..(203): a, c, t, g, unknown or other
  misc_feature (203)..(203): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcggctacttagcctggtaccagcagaaacctggccaggctcccaggctcctcatctacgatgcgtccaacagggccactggcatcccagacaggttcagtggcagtgggtctggggacagacttcactctcaccatcagcagacttgagcctgaagtattttgctagtatattactgtcagcaatatacgagacgcactggtgggtcgttcggccaaagggaccgaaaggtaggaatacgaaaacgaacgtagtaggcgtgacaccgactctcgtcttcattcccg

SEQ ID NO: 29220 - DNA, 888 bp, Homo sapiens
  misc_feature: GYAE6OF02JF9Y4.34.72.G06.1.454.CMB.1.raw
  modified_base (189)..(189): a, c, t, g, unknown or other
  misc_feature (189)..(189): n is a, c, g, or t
tcagtacacgtgatcacgaccggtgctcgatttagctacgactgcaagggaaagggggaggaactgctcagttaggacccagagggaaccatggaagccccagctcagcttctcttcccctcgtctactctcgcgtccacgatacaccgacggaatatgtgtacacagtactccacgcaccctccgttntttcgttcgtcccacggggaaaaggggaagccgacccctacctccgttcgacgacgggaccggtacgtacgacgtaaggtggtttgggtacgacgacgaaccttaacggttccgtccgggttaccgaaccacgacggaaaaccgttaccggtcggaaccggacggtcccctaaccgaaggtccccttccctaatacttactaggtcgtaacctactaccaccccgaacggggaccgaccctacgtcgtaacttacccgtacgaccgaccggggttagtacgagggtccgaagtacgggggtttcggtcgggacggaacgtattttccttaccgaccttcaacccaacttcgaagacggacccgaccgttcgtcgtacgtacgtttacggaagaacgtttccgttccgaccgttaacttttaaacctttttacgttacccggtttacaaccggttaccgtacggttaacttaaccgttaaagggttacgggtcccgggggttaccgggttaacggggtttaccccgggttaaccggggaaacccggttaaacccggggaagggtttaaacgggggtaaccgttaaaccgtaaaacccgggtaaaaccggttaaccgggtttgggtacccggttacgtacccggaacccttacggttaaccgtttcccgtttaaccggttttacctaccgttaacccccgg

SEQ ID NO: 29221 - DNA, 560 bp, Homo sapiens
  misc_feature: GYAE6OF02GZCLZ.34.72.G06.1.454.CMB.1.raw
  modified_base (201)..(201): a, c, t, g, unknown or other
  misc_feature (201)..(201): n is a, c, g, or t
  modified_base (308)..(308): a, c, t, g, unknown or other
  misc_feature (308)..(308): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccacctgtctttgtctccaggggaanagccacctctcctgcagggccagtcagagtgttagcggctacttagcctggtaccagcagaaacctggccaggctcccaggctcctcatctatgatgcgtccaacgngggccacgtggcatcccagccaggttcagtggcaggtgggtctgggccagacttcactctcaccatcagcagcctagacgacctaaagtatttagacttaatttacttacttgttacagctgtcgtagctaacgtcggtccttccgttgacgtccgtcccgttcgggccggtaacgggaccacggacgtagggagtaacgttaaacggaacgtggtcggacgtcgcctaccgtattcgttacgttcttaccg

SEQ ID NO: 29222 - DNA, 599 bp, Homo sapiens
  misc_feature: GYAE6OF02GKBEN.34.72.G06.1.454.CMB.1.raw
  modified_base (202)..(202): a, c, t, g, unknown or other
  misc_feature (202)..(202): n is a, c, g, or t
  modified_base (309)..(309): a, c, t, g, unknown or other
  misc_feature (309)..(309): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccacctgtctttgtctccaggggaaangcccaccctctcctgcagggccagtcagagtgttagcggctacttagcctggtaccagcagaacctggccaggctcccaggctcctcatctatgatgcgtccaacgngggccacgtggccactcccagccaggttcagtggcaggtgggtctgggccaggtacttcactctcaccatccagcacgcctagacgacctaaagtatttagacttaatttattacttgttcagtctgcgtagacaacgttcggcccttcccgttgacggtccgtccgtttccgggacccggtaggggaccgaaccggtacgtacgggaacggtaacgtttaaaccggaacgttacggtacggtaccgttacggacctaacccgtacgtccgttacggttacctttacccg

SEQ ID NO: 29223 - DNA, 679 bp, Homo sapiens
  misc_feature: GYAE6OF02JPYN5.34.72.G06.1.454.CMB.1.raw
  modified_base (202)..(202): a, c, t, g, unknown or other
  misc_feature (202)..(202): n is a, c, g, or t
tcagtacacgtgatcacgaccggtgctcgatttagctacgactgcaagggaaagggggaggaactgctcagttaggacccagacggaaccatggaagccccagcgcagcttctcttcctcctgctactctggctcccagacaccactggagaaatagtgatgacgcagtctccagccaccctgtctgtgtctccaggggaanagccaccctctcctgcaggccagtcagagtgtggcagcaacttagcctggtaccagcagaaacctggaccaggctcccagacgtcctcatctatcgctacatccaccgagggtccactgcctattccagtcctaggttccaggtcggcaggttgggtctgggacaggtacgtttcgactttctacgacctagtccgtagacacgtcctaggtcctagtccgtaagtaacgtacgtttccgtacggttaccttaaccgttttattaccggtacgttaccgtacgtacctaagttaccgttaaaggtaacggttccgggtacccggttagggtaaccggtttaccgggtacccgtaagggggttaccccgtaaaggggttaccgggtaaaacgtttacccggaaaaacggtaccggtttacgggtacgggttaccgtacgggtaacccgtaacccggttaacggttcctttaacccggg

SEQ ID NO: 29224 - DNA, 604 bp, Homo sapiens
  misc_feature: GYAE6OF02IO7LS.34.72.G06.1.454.CMB.1.raw
  modified_base (202)..(202): a, c, t, g, unknown or other
  misc_feature (202)..(202): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctccagataccaccggagaaattgtgttgacacagtctccagccaccctgtctttgtctccaggggaaangccacctctcctgcagggccagtcagagtgttagcggctacttagcctggaccagcagaaacctggccaggctcccaggctcctcatctatgatgcgtccaacagggccacgtggcatcccagccaggttcagtggcagtcgggtctcgggcaggacttcgactctcaccatcagcacgcctagacgtacctaaagtattttgacttaatttattacgttagttctagcttggcgttagaccgtaactcggtccttacccgttgacgtccggtccgtttccgggccggaacggggacccaacggtacgtacgggtaacggtaacgtttaaaaccggaacgttacgggtacggtaccgttacggtacctaacccgtactttaccgttcgttacccgtttaccg

SEQ ID NO: 29225 - DNA, 541 bp, Homo sapiens
  misc_feature: GYAE6OF02IAXV1.34.72.G06.1.454.CMB.1.raw
  modified_base (204)..(204): a, c, t, g, unknown or other
  misc_feature (204)..(204): n is a, c, g, or t
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagacaccactggagaaatagtgatgacgcagtctccagccaccctgtctgtgtctccaggggaaagngccaccctctcctgcagggccagtcagagtgttggcagcaacttgcctggtaccagcagaaacctggccaggctcccagacgtcctcatctatgctacactccaccagggcccactcgctattccagccaggttcagtgctagtggtctgggacagattcactctacaccntcagcagcctgcagtctaggaagtnttcngtcctaacgttttattactgtcagtctagttctaaagtagtcggtccgttgggacgttccggaccgagggtaccgtaagggtacggaaacttcgaaaaccggtacgtaggtcggactcgacaccgtattccgttacg

SEQ ID NO: 29226 - DNA, 558 bp, Homo sapiens
  misc_feature: GYAE6OF02HMOQF.34.72.G06.1.454.CMB.1.raw
tcagtacacgtgatcacgaccggtgctcgatttagctacgactgcaagggaaagggggaggaactgctcagttaggacccagagggaaccatggaagccccagctcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggcctccccgaggcctcctcattctttggcgccgtccaccgaggggcccacgtcggccactccccaagacctaggttccaggtcggctaggtggggtctggggacaggacttcacttctcaccatcagcagtacttgagcctagagtatttgactagtatattactgtacagactaatatcgagacgcacgtggtcgggtcgttcggaccgaacgggaccgaagggtagaacgtacgaaacgtacgtggtagtactagacacctagtctcgtcttatacg

SEQ ID NO: 29227 - DNA, 564 bp, Homo sapiens
  misc_feature: GYAE6OF02G1HQN.34.72.G06.1.454.CMB.1.raw
  modified_base (300)..(300): a, c, t, g, unknown or other
  misc_feature (300)..(300): n is a, c, g, or t
  modified_base (414)..(414): a, c, t, g, unknown or other
  misc_feature (414)..(414): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaagagtcaccctctcctgcagggccagccagagtgttagcagcaacgttggcctggtaccagcagaaacctggccaggctccaggctcctcatctatggtncactccaccgagggcccacgtggtactcccaagtccgtaggttcaggtcggcgaggtcgggtctggggactagacttcgactctacacatcagcagcctgctagtctagaagtntttgacttagtttacttctgtacagtactagtaataataacgtcggcccggtccgggtacgttacggaccgaacgggtaccaagggtacggaactacgaaacgtaccgtgtacggctcgaccactatcgttctcttactactcctacccg

SEQ ID NO: 29228 - DNA, 527 bp, Homo sapiens
  misc_feature: GYAE6OF02FPB06.34.72.G06.1.454.CMB.1.raw
  modified_base (203)..(203): a, c, t, g, unknown or other
  misc_feature (203)..(203): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccacctctcctgcagggccagtcagagtgttagcggctacttagcctggtaccagcagaaacctggccagcctccagactcctcattaatggtgcatactacagggcccctggcatcccagacaggttcagtgcagtggtctgggacagactcactctcaccatcaccagactggacgcctagaagtattttgctagtgtattacgtgtacaactagttcgtctcacacgtacgtggacgttcggaccgaagggaccaagggtacgaaatacgaaacgacgtgtggctgaccacattctgtcttacacttcctcccgctatcg

SEQ ID NO: 29229 - DNA, 755 bp, Homo sapiens
  misc_feature: GYAE6OF02IVN3G.34.72.G06.1.454.CMB.1.raw
  modified_base (206)..(206): a, c, t, g, unknown or other
  misc_feature (206)..(206): n is a, c, g, or t
  modified_base (311)..(311): a, c, t, g, unknown or other
  misc_feature (311)..(311): n is a, c, g, or t
tcagtacacgtgatcacgaccggtgctcgatttagctacgactgcaaggggaaagggggaggaactgctcagttaggacccagagggaaccatggaagccccagctcagcttctcttcctcctgctactctggctcccagataccaccggagaaattgtgttgacacagtctccagccaccctgtcctttgtctccgaggggaaancgccacctctcctgcagggccagtcagagtgttagcggctacttagcctggtaccagcagaaacctggccaggctccgaggctcctcatctatgatgctcaacgngggccacgtggcaactcccgagcctaggttcaggtcggctaggtcggggtcctggggcccagtaccgtttccaaccgttcgtacccaacccgtagttacccgaggtacccaacggtacccgttaaacgggaaccgtaaccccgtttaaaaaggttcgtttttaacggaacccgtttaaaattttaccgtttaaacctttagggttaacctaagggttcctagggttaccgttaagtacctaaacggttccggttaccccgttacccgtttacggaaccggttcccgggttaccccgttttacccgggggacccggtaacgggttaacccgaccggttaccggtaacgggtaacggttaaaccgttaaaaccggtaaacgttcgggtaccgggtccgttaacggtccgaacccgtaccggtttcgttacggttaccctttaccgg

SEQ ID NO: 29230 - DNA, 514 bp, Homo sapiens
  misc_feature: GYAE6OF02GTM28.34.72.G06.1.454.CMB.1.raw
  modified_base (370)..(370): a, c, t, g, unknown or other
  misc_feature (370)..(370): n is a, c, g, or t
  modified_base (393)..(393): a, c, t, g, unknown or other
  misc_feature (393)..(393): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccactggagaaatagtgatgacgcagtctccagccaccgtgtctgtgtctccaggggaaagaatcaccctctcctgcagggccagccagagtgttagcagcaacttggcctggtaccagcagaacctggccaggctcccaggctcctcatctatggtgcatccaccagggccactggatcccagccaggttcagtggcagtgggtctgggacagattcactctcaccntcagcagcctgcagtctgaagtntttgctagtttacttacgtgtcagcagttataataactggcctccggggacttcggcgtaagggaccagggtacgattacgaaacgtaacgtggtacggcgttcgcacgtactctgtcttc

SEQ ID NO: 29231 - DNA, 638 bp, Homo sapiens
  misc_feature: GYAE6OF02GROO9.34.72.G06.1.454.CMB.1.raw
  modified_base (205)..(205): a, c, t, g, unknown or other
  misc_feature (205)..(205): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggcctcccagataccaccggagaaattgtgttgacacagtctccagcccacctgtctttgtctccgaggggaaancgcccacctctcctgcagggccagtcagagtgttagcggctacttacgcctggtaccaacagaaacctggaccaggcctcccgaggcctcctcatctatgatcgccgtaccaacgacgggccacgtcggacacctcccagcccaggttacaggtcggcgaggtcggggtcgtcggggaccaggtactttccacgtctccgaacctatccgacgccacgaccgtacggacgtaaccctaaaaggtactttttacggacttaaattttacttacttacgtctaagtcttaggtcgtacgtacgtaacgttcggcccttacccgttagcgtccgtccgttccggccggacggacacggtacgtacgggagtaacgttaaacggtacgttggtacggtcgtacgacctaaccgtattcgttacgttcttactacccg

SEQ ID NO: 29232 - DNA, 639 bp, Homo sapiens
  misc_feature: GYAE6OF02JA6RI.34.72.G06.1.454.CMB.1.raw
  modified_base (203)..(203): a, c, t, g, unknown or other
  misc_feature (203)..(203): n is a, c, g, or t
  modified_base (619)..(619): a, c, t, g, unknown or other
  misc_feature (619)..(619): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccacctctcctgcagggccagtcagagtgttagcggctacttagcctggtaccagcagaacctggccaggcctcccgaggcctcctcatctatgatcgacctccaacgcgggccacgtggccactccccagcctaggttccaggtcggctaggtgggtctcgggcctaggtacctttcgaccttctaccgaacctagtccgacgccgacgtaccgtaagacgtaccttaaagtacttttcgaacttaaattttacttacgttcgtactacgtcgttcggtacgttacgaccgtaacgttccggtcccttacccgttaggaccggtccgttcccggttcggaccggtaagggacctacggtaccgtaggaacgtaacgttaaacggacgttcggtacggtactacgacctaccgtnttccgttacgttccttaccg

SEQ ID NO: 29233 - DNA, 631 bp, Homo sapiens
  misc_feature: GYAE6OF02FMFS0.34.72.G06.1.454.CMB.1.raw
  modified_base (203)..(203): a, c, t, g, unknown or other
  misc_feature (203)..(203): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaatagtgatgacgcagtctccagccaccgtgtctgtgtctccaggggaaanagtcaccctctcctgcagggccagccagagtgttagcagcaacttggcctggtaccagcagaacctggccaggctcccaggcctcctcatctagtggtgcatcccaccgagggcccacgtggtactcccgagcctaggttcagtcggcaggtcgggtctgggactaggtaattccacttctacacctatccgagcacgtcctgccgtagttccgtagtaaagttgttttcgacgttaagttttacttacgtgtacagtctaagttaacttaaagttaccgtcgggtacccggtaccgggggttacgttccgggaccgtaaacggggtacccgtaaggggttacggtaacgttacccggaaacggtaacgttagggtacggtcgttacggacctaaccgtacgttccgttacgttccgttacttacccg

SEQ ID NO: 29234 - DNA, 583 bp, Homo sapiens
  misc_feature: GYAE6OF02FXNHA.34.72.G06.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaangccaccctntcctgcagggccagtcagagtgttagcggctacttagcctggtaccagcagaaacctggccaggctcccaggcctcctnatctatgatgctccaagngggccacgtggcactcccagccaggttcaggtggctaggtcggtctgggccaggtcttcacttctcaccatccagcacgtcctaagacgacccttaaaggtcttttagacttaaatttactacgttgttacagtcgtgacgtacgacaacttcggccttcccgttggacgtccgtccgttcggccggaggacctacggacgtaggtaacgtaacgttaaaccggacgttcggttacggccttacggacctaacgtacttcgttacgtccgttacc

SEQ ID NO: 29235 - DNA, 621 bp, Homo sapiens
  misc_feature: GYAE6OF02H5IP0.34.72.G06.1.454.CMB.1.raw
  modified_base (205)..(205): a, c, t, g, unknown or other
  misc_feature (205)..(205): n is a, c, g, or t
  modified_base (471)..(471): a, c, t, g, unknown or other
  misc_feature (471)..(471): n is a, c, g, or t
  modified_base (551)..(551): a, c, t, g, unknown or other
  misc_feature (551)..(551): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagcccaccctgtctttgtctccgaggggaaangccaccctctcctgcagggccagtcagagtgttagcggctacttagcctggtaccagcagaaacctggccaggctcccgaggccttcctcatctatgatgccgtaccaaacgcgggccctaacgtcggacactcccgagccctaggttaccaggtggaccagggttcggggtctcggggaccaggttacttccgaccgtcctacacctatccgaagtccacgccctaaggacgtaccttaaagttacgttttagacttaaattttnttacctaggttctagtctagtacgtacgaccgtacgttcggcccttccgttagcgtccgtacgttcccggacgacggacnccggtacgtaggaacgtacgttaaaccgtagtcggttacgacgtcgtaccacctattacgttctattccc

SEQ ID NO: 29236 - DNA, 583 bp, Homo sapiens
  misc_feature: GYAE6OF02IU3VW.34.72.G06.1.454.CMB.1.raw
  modified_base (202)..(202): a, c, t, g, unknown or other
  misc_feature (202)..(202): n is a, c, g, or t
  modified_base (373)..(373): a, c, t, g, unknown or other
  misc_feature (373)..(373): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctccagataccaccggagaaattgtgttgacacagtctccagcccacctgtctttgtctccgaggggaangccaccctctcctgcagggccagtcagagtgttagcggtctacttagcctggaccagcagaacctggccaggcctccaggcctcctcatctatgatcgcgtccaacgcggccacgtggcactcccagcctaggttcaggtgcgtaggtgggtctcgggcagtactcactcncaccatccgagcgacgcctagacgacctaagtactttagacttaatttacttacgtgttacgtagtctcgtcgtacgactacgtccgtaccttccgtgacgtccgtccgttcggaccggtacggacgaccgtacgtacggtaacgtaacgttaaaccggacgttcggtacgtcgtacgtaccgtaccgtcgttacttcgttaccttaccg

SEQ ID NO: 29237 - DNA, 564 bp, Homo sapiens
  misc_feature: GYAE6OF02F39H1.34.72.G06.1.454.CMB.1.raw
  modified_base (203)..(203): a, c, t, g, unknown or other
  misc_feature (203)..(203): n is a, c, g, or t
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccacctgtctttgtctccgaggggaaancgccacctctcctgcagggccagtcagagtgttagcggctacttagcctggtaccagcagaaacctggccaggcctcccaggcctcctcatctatgatcgcgtccaacgagggcccacgtcggcactcccagccaggttccaggtggcaggtcgggtctgggccagtactttacnctacaccatcancagcctagactacctaaagtatttagactaatttattactgtacagtctgcgtagctacgtcgcccttccgttgacgtcgtccgttcggaccgacggacgacgtacgtacggagtaacgttaaacgacgttggtacgtcgtacgcctaacctagttcgtacggtccttagtacc

SEQ ID NO: 29238 - DNA, 591 bp, Homo sapiens
  misc_feature: GYAE6OF02GIW5N.34.72.G06.1.454.CMB.1.raw
  modified_base (206)..(206): a, c, t, g, unknown or other
  misc_feature (206)..(206): n is a, c, g, or t
  modified_base (251)..(251): a, c, t, g, unknown or other
  misc_feature (251)..(251): n is a, c, g, or t
  modified_base (275)..(275): a, c, t, g, unknown or other
  misc_feature (275)..(275): n is a, c, g, or t
  modified_base (374)..(374): a, c, t, g, unknown or other
  misc_feature (374)..(374): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccacctgtcttgctccaggggaagccacctntcctgcagggccagtcagagtgttagcgctactagcctggtaccngcagaacctggcaggctccaggcncctcagtcatgatgctccaactgggccacgtggcctatacccgagccaaggttccagtcggctagtagggtctggggccaggtacttcacgtctcaccntcacgcgagacctagacgtaccttaaagtagtttcggacttaatttacttacgtgttactagtctgtacgtagtcctaactcggtaccctccgtcgacgccgtccgttcggcccgtacgggaccaccggtaccgtgggtaacgtaacgttaaaccggtaacgttacggtacggtcgtacggtacctaaccgtacgttaccgtacgttccttaacccg

SEQ ID NO: 29239 - DNA, 738 bp, Homo sapiens
  misc_feature: GYAE6OF02GDG84.34.72.G06.1.454.CMB.1.raw
  modified_base (203)..(203): a, c, t, g, unknown or other
  misc_feature (203)..(203): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcggctacttagcctggtaccagcagaaacctggaccaggcctcccaggctcctcactctatgatcgtccgtccaacgcggggccacgtcggaccactccccgagccgtaggttccaaggtcggacgtaggttcggggttcgtcggggtacccaagtaccgtttccgaacttccgtaccaaccctagtccgaacggtccgaacgtacccgtaaaggaaccggtaacccgttaaaaggttacgtttttagaacctttaaactttttaacttaaccgttcgttacgacggttcgttacggtacgttacgaccgtaaccgttcggtaccccttcccgtttacggaccggtccggttcccgtttaccggggacccgggtaacggggtaccctaccgggtacggttacgggtaacggtaaaccggtttaaaaccgggtaccggttagggttaccggtacgttacggaccctaacccgttacgttacgtttccggttacctttaccg

SEQ ID NO: 29240 - DNA, 768 bp, Homo sapiens
  misc_feature: GYAE6OF02GBI22.34.72.G06.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaanagccaccctctcctgcagggccagtcagagtgttagcggctacttagcctggtaccagcagaacctggccaggcctccgaggcctccnatctatgatcgccgtaccaacgagggccacgtcggcactcccagccgtaggttccgaggttcggacgtaggttcggggtccgtcggggacccgtacggtacctttccaaccgttcctacccaacccgtacttaccgaacggtccaacggtacccgtaaacggtaaccgtaaacccgtttaaaacggttacgttttttaaccggaaaccttttaaaacgttttttaacttaccgtttaggttaaccgtacggttcgttacgggtaaccggttaacgtaacccgtaaccgttccgggtacccccgttttcccgttacgggtaccggtcccgttcccgggttacccgggtacccgggtaacggggtaacccgtaaccgggtacggtaacgggtaaccggtaaacgtttaaacccgtaacggttacggttacggtaccgttacggaccctaaccgtacgttccgttacgttacctttaccg

SEQ ID NO: 29241 - DNA, 673 bp, Homo sapiens
  misc_feature: GYAE6OF02IFNUC.34.72.G06.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (655)..(655): a, c, t, g, unknown or other
  misc_feature (655)..(655): n is a, c, g, or t
tcagtacacgtgatcacgaccggtgctcgatttagctacgactgcaagggaaaggggaggaactgctcagttaggacccagagggaaccatggaagccccagctcagccttctcttcctcctgctactctggctcccagataccaccggagaaattgtagttgacacagtctccgagccaccctgtctttgtctccagggaangccaccctntcctgcagggccagtcagacgtgttagcggctacttagcctggtaccagcagaacctggccaggcctccgagcctcctcatctatgactgcgtccaagcggccactcggcacgtcccgagcccgtaggttccaaggtgggacaggttcgggtcctggggcctagtacttcaaccttcgtaccacctagtaccgtacgctacgtaccctaagaaccgtaaccttaaaaggttccgtttttaggaaccttaaacgtttttacgtttaaccgtacggttaacgtacggttacgttaccggtacgggtaacgtaccgtaaaccgttcgggtacccctttccgtacggtaccgtccggtacccgttccgggaccggtaacggtaccgtaccgtagtccggtaagtaacgttaaccggacgttgtaccgaccgttcgtaccgtaccgtntaccgttgttcctacccg

SEQ ID NO: 29242 - DNA, 902 bp, Homo sapiens
  misc_feature: GYAE6OF02G4A45.34.72.G06.1.454.CMB.1.raw
tcagtacacgtgatcacgaccggtgctcgatttagctacgactgcaaggggaaagggggaggaactgctcagttaggacccagagggaaccatggaagccccagctcagcttctcttcctcctgctactctggctcccagataccacggagaaattgtgttgacacagtctccagcccaccctgttctttgtctccgaagggggaaagcgccaccctctcctgcagggccagtcagagtgttagcggtctacttagccgtaggtaccagacaacgaaacctggacccagggtcctcccgaggcctcctcattctatgatgaccgtaccgaacgtcgggcctacgtcgggccactaccccgaagccgtacgggttaccagggttcgggacgtacgggtcgggggttcgtaggggtacccaagggttaaccctttccaccgtttacctacccgaaaccctagttaccgaacggtacccgaccgggtaacccttaaaccgggtaaccgttaaacccgtttaaaaacgggtttacgttttttaaacggtaaacctttaaaacgttttttaactttaaacccgtttacgggtttacgtaaccggttaccgttacgggtaacccgggttaactaaccggtaaaccgttccccggggttaacccccctttcccggtttaagggaccccgggttacccggtttcccccggggttacccgggggtaaccccgggaaacggggttaacccgtaaccggggttaccgggttaaccgggggttaaaccgttaaaaccggggttttaaaaacccgggaaacccggtttaagggggtttaccgtaaccgggtttacccggtaacccggttaaccgttaaccgggtttacccgtttacgtttacccgtttaaccccg

SEQ ID NO: 29243 - DNA, 678 bp, Homo sapiens
  misc_feature: GYAE6OF02FFDG3.34.72.G06.1.454.CMB.1.raw
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaangccacctntcctgcagggccagtcagagtgttagcggctacttagcctggtaccagcagaacctggccaggctcccaggcctctcatcctatgactgccgtccaacgacggccactggcactcccgagccaggttcagtcggcacggttgggtcctggggcctaggacgtttcaccgttcctccaaccacgtccagcccgaacgtacccgtaacggtacgtaaccgttaaaacggttacgtttttacggaactttaaaattttacgtttaaacgttcggttacgacgttcgttacgggtaccgtaacggtaccgtaaacgtttccgggtaccccttccccgttttaggaaccggtcccggttcccggtttaccggaacccgggtagggacccaacgggtaccgtagggtaacgtaacgttaaaccggaacgttcgtacggtacttcggactaccgtacgtcttacgttccttaccg

SEQ ID NO: 29244 - DNA, 762 bp, Homo sapiens
  misc_feature: GYAE6OF02HEIAN.34.72.G06.1.454.CMB.1.raw
tcagtacacgtgatcacgaccggtgctcgatttagctacgactgcaagggaaagggggaggaactgctcagttaggacccagacggaaccatggaagccccagcgcagcttctcttcctcctgctactctggctcccagatcgccccggagaattgtgttgacgcagtcgccagacacctgtctctgtctccgagggaagacgccaccctctcctgcgagggtcagtcacgtcgttacctaacgaccgtaccttcttccggaccgttcggtaccagcaacggacgaccgtcggaccgacggcctcccgaggtccctccctacacgtttccgtttgggcgtcccgttacccgaacccgtcggggaccctaacggttccgggacctaccgttaccccgaaggtaccgtagggtttaccgaaggttcggacgtagggtcggggtctacggggtaactacgtaccttccgtaacgttcctaccgaaccgtacgtaccgacgtacgtaacgtaccgttacggacgtacccgttaaggtaaacttaggttttacgaacgttaagttaacttaacgtttaccgtacgtaaccgtagtaactaaagttacgtaacggaacgtaaccgacgtacgtcggttacgggtccgggttacggaaccggtaaacgggtaacgtaagggtaccgtaaacgtaaccgtaaaacggtacgttagggtccgttacgtaccgtacgtaaccgtgttacccgttcgttaccttacgtacccg

SEQ ID NO: 29245 - DNA, 544 bp, Homo sapiens
  misc_feature: GYAE6OF02G9OJP.34.72.G06.1.454.CMB.1.raw
  modified_base (414)..(414): a, c, t, g, unknown or other
  misc_feature (414)..(414): n is a, c, g, or t
  modified_base (539)..(539): a, c, t, g, unknown or other
  misc_feature (539)..(539): n is a, c, g, or t
tcagtacacgtgatcacgaccggtgctcgatttagctacgactgcaagggaaagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagacgcccaccctctcctggcggggccagtcagagtattagtagctacttcttagcctggtatcagcagaaacctggcctggccgcccaggcctcctcatctatatgcctatagcgaggccacgtggccgtcccgagactaggtcagtggcgtaggtgggtcgtggggcaggcttcgactctcactatcagcagactggacgccgtagaagtntttgcgtagttgttatttagtgtactagcagctatcagtcgtacacgttactacgtttcggaccgtagggaccaggcgtaggagtacgtacaaacgtacgtagtcgcgtagaccactagttcgtntaccg

SEQ ID NO: 29246 - DNA, 579 bp, Homo sapiens
  misc_feature: GYAE6OF02FIEDX.34.72.G06.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (416)..(416): a, c, t, g, unknown or other
  misc_feature (416)..(416): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagcccaccctgtctttgtctccaggggaaagngccaccctntcctgcagggccaggtcagagtgttagcggctacttagcctggtaccagcagaacctggccaggctcccaggctcctcatcctatgatcgacgtccaacaggcccactggccactcccagccctaggttcaggtcgctaggtgggtctcggggccagacttccactctccaccactcagcagcctaggacgtacctaaagtntttcgactaattttactacttgtactagtctagcgtagacctaacgttcggcccttacccgttgaccgtccgtcccgtcggacccggtagggacctacggacaggacgtaaactaacgaacgttggtcggcttagaccgtacctagtcgttgttcccttaacg

SEQ ID NO: 29247 - DNA, 823 bp, Homo sapiens
  misc_feature: GYAE6OF02I13A0.34.72.G06.1.454.CMB.1.raw
  modified_base (202)..(202): a, c, t, g, unknown or other
  misc_feature (202)..(202): n is a, c, g, or t
tcagtacacgtgatcacgaccggtgctcgatttagctacgactgcaagggaaaggggaggaactgctcagttaggacccagagggaaccatggaagccccagcgcagcttctcttctcctgctactctggcctccgagacaccactggagtaaatagtgatgacgcagtctccagccaccgtgctgtgtctccgagggaacncgccacctctctgcagggccagtcagtaggtgttacggcagcctaactacggcctaggtaccagccgagtaaccgtcgaccgacgtccaccgaggtactcctcgacgttctagtcgtacctaccgtactaccgaaccgtacggccctagttacgtaccgttactccgaacgtccggtaacgtttacgaacggtcggtacgttacgggttacggttaccggtaggtaccgtaacggttacgttaacccgtacttaaccggttaccaccggttacgtaaccgtaccggaccggttaaaccggttccgttacggtaaccgtacgggtttaccgtaaaacggttcgttaaaccgtttcgttaaacggttcccgtttaaacggttttacccgtacgtttaacggtacccgtacggttacccgttaagttaacccggttaaaggtttacccggttacggggttacccggtttaaaccgggtaccgtaacccgggtaccgggttaaacggttccgtaaaaccggggttacggttaaaacccgttaccggtaaaaccggtttaggggacccgtttacggggaaccccttaccggtacccggtaaattccccgggtttactttaaccggg

SEQ ID NO: 29248 - DNA, 675 bp, Homo sapiens
  misc_feature: GYAE6OF02JHWNF.34.72.G06.1.454.CMB.1.raw
  modified_base (140)..(140): a, c, t, g, unknown or other
  misc_feature (140)..(140): n is a, c, g, or t
  modified_base (165)..(165): a, c, t, g, unknown or other
  misc_feature (165)..(165): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
  modified_base (647)..(647): a, c, t, g, unknown or other
  misc_feature (647)..(647): n is a, c, g, or t
tcagtacacgtgatcacgaccggtgctcgatttagctacgactgcaagggaaagggggagggaactgctcagttaggacccagagggaaccatggaagccccagctcagcttctcttcctcctgctactctggctccagntaccaccggagaaattgtgttgacncgagtctccaggccacctgtctttgtacctccgagggggaaancgccaccccttntcctgacagggccagtcagngtnttaggcgcttacttagccttggaccagcagaacctggccaggtctacccgaggtcctcctcactcctattcggactcggccgtaccgaacgacgggcctaacgtggactactccccagaccccgtaggtttacaggttcgacgtagggtcgggtcgccggtcgaaggttaccttcgaactcctcgaacccagttcgacgtcgacgtcctagtacgaacctaagtacgtttgacttaactttattaccgtgtactacgtacgtgtacgtaacgccgttaaacgtccgtacctttaccggttcgtaaccggtcgtccccgtttaacggggaccgttaacggggacctacggtacgtgggaacgtaaccgttaaacggttaccgtggttacgtcgtaccggttaccnccgttaattaccggtcttaacgttccgg

SEQ ID NO: 29249 - DNA, 590 bp, Homo sapiens
  misc_feature: GYAE6OF02IS1XR.34.72.G06.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggcctcccagataccaccggagaaattgtgttgacacagtctccagccaccctgtctttgtctccaggggaaangccaccctctcctgcagggccagtcagngtgttagcggctacttagcctggtaccagcagaacctggccaggctccaggcctcctcatctatgatgccgtaccaacgacgggccacgtggcactcccgagcctaggttcaggtggctagggtgggtctgggccaggtacttcgactctcacctatcagcacgctagacgactaagtntttnacttaatttacttactagttctagtctcgtcgtacgactaacgtcggtacccttccgtagaccgtccgttcccgttcgggaccggaacgggaccgaccggacgtcggtaacgtaacgttaaacgaacgttcggtacggtcctacggacctaccgtacgttcttacgtccttaccg

SEQ ID NO: 29250 - DNA, 668 bp, Homo sapiens
  misc_feature: GYAE6OF02IZT92.34.72.G06.1.454.CMB.1.raw
tcagtacacgtgatcacgaccggtgctcgatttagctacgactgcaagggaaagggggaggaactgctcagttaggacccagagggaaccatggaagccccagctcagcttctcttcctcctgctactctggctccagataccaccggagaaattgtgttgacacagtctccagccacctgttctttgtctccgaggggaaagcgcccaccctctccgtgcagggccagtcagagtgttagcggtctacgttacgccgtaggtaccagcaacgaaaccgtggaccagggcctccccgaggccttccgtcacttctatgatcggccgtaccaacggacgggacccacgtcggcctacgtccccgagccgtaacggttccgaggtcggcgtacgggttcggggtcgtcggggacctaggtacctttacgtacctccgtaccacctaactcgtaacgcctaacggtacccgtaggaacgttaaccgttaaagttattttacgaactttaattttacgtacgttcgttacagttcgtcgtacgtacacgtacgtcgtcccgttaccgtggacgtccggtccgttacgggccgtaacggactaccgtacgtaggacgtaacgttaaagcggttgccggtactacggcctaacgtcttcggttactccgttaac

SEQ ID NO: 29251 - DNA, 929 bp, Homo sapiens
  misc_feature: GYAE6OF02I9DPF.34.72.G06.1.454.CMB.1.raw
tcagtacacgtgatcacgaccggtgctcgatttagctacgactgcaaggggaaagggggaggaactgctcagttaggacccagagggaaccatggaagccccagctcagcttctcttcctcctgctactctggctcccagataccaccggagaaattgtgttgacacagtcctccagccaccctgtctttgtcctccgaggggaaagtcgccctaccctctcctggccagggccagtcagagttgttaggccggtacttacgttacgccgtagggtaccaggtaccaacggaaaccgtcgggaccgacgggtcctaccccgacgggtcccttcccgtactacttacttacgttagtaacgttccggtaccgtacccgaaaccgtaccgggggaccctacggtaccgggacctaaccgttaccccgaaccggtacccggttaacggggtttaccgtaacgggttaccggggtaccgggtaaccggggttacggggggttaccgggttaccgggggaacccgttaaccggttaaccccgttttaacccggtaaccccttttaccccgtaaccccgttaaacccctaacgtttaaccccgaacggtaccccggtaacgttaaccccggtaaacggggtaaaccccgtttaaacccgggttaaaaacggtttttacgttttaacggtaaaccgttttaaaacgtttttaaccgtttaaccgtttacggttacctacggttaccgttacggttaccggtaacgtaccggtaaccgttccggttaccccgtttacccgtaggtacccggtcccggttacccggttccgggaccggtacgggtaaccgaccggtacggtaacggtacggtaaacgttaacggtaacggtcgggtacgtccgtacgtacctaacgtcgtacgttcgttaccttaccg

SEQ ID NO: 29252 - DNA, 727 bp, Homo sapiens
  misc_feature: GYAE6OF02IKENU.34.72.G06.1.454.CMB.1.raw
  modified_base (204)..(204): a, c, t, g, unknown or other
  misc_feature (204)..(204): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggcctcccagataccaccggagaaatagtgatgacgcagtctccagccacctgtctgtgtctccgaggggaaancgcccaccctctcctgccagggccagtcagtacgtgttcggcagactaacttggccttggtaccagacaagaaaccgtcggaccagggccttcccgaagacgtcctaccaatcctaatcgactaccgactacccgaccgtacgggcctactcggtcctacttcccgagtacccgtaggtttacgacggtgggcctagggtcgggtcgtgggaactacgtaggttcctacgtcctaccacccgtagtaccacggtaccacgtcccgtacgtacgtaggttactaggtaaacgttacttacgtacggttaccttaacgtttttacttacgtcgtttaccgtaggtacgttaacggttaacttaaacggttacgggttccggtaccgggtttaacgggttaaccgttacccggggacccgaagggggtacccgtaaaggggtaccggtaaaaacggtcccgtaaaaccgggtagttacggtaacggccgttacggacccctaaccgtacgtttccttaggttaccc

SEQ ID NO: 29253 - DNA, 777 bp, Homo sapiens
  misc_feature: GYAE6OF02I8PMZ.34.72.G06.1.454.CMB.1.raw
  modified_base (195)..(195): a, c, t, g, unknown or other
  misc_feature (195)..(195): n is a, c, g, or t
  modified_base (328)..(328): a, c, t, g, unknown or other
  misc_feature (328)..(328): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctatctggctcccagataccaccggagaaattgtgttgacacagtctccagcacctgtcttgctcagggaanagccacctctcctgaccgtaggccagtccgagtagttgttaaatagaccattcctaacgtttagccttagggtaacccagcgtaagaaacctggaccaaggccctccaagaccttccactagttaactggttnacctaataactaccgacggcccctaggcactcccaagacctagggttacacggttcggcctaaggcggttacgacgggggtaacaggtaccttttacacgtttaccgttcccgaacccttaatcccgtaaccaacgggtaaccgtagggtaccttacccgtaggtaaaccgtttaagttttaccggtacctaaggtttacccggttaaagttttaacgttcgttaacctaaacgtttaacgggtttcggttaacttacccgtaattaacccgaccggtttacggggtaaccgttttacccggggaaaccgtaaaccggggtaaacccggtaaaggtaacgggaaacccttaagggaaaccttacggtaaggtacccgggtacctaggtaacccctacgttaacggtacttacggttccctttaactacggtttcccgttacccgtaacc

SEQ ID NO: 29254 - DNA, 680 bp, Homo sapiens
  misc_feature: GYAE6OF02I0X6H.34.72.G06.1.454.CMB.1.raw
  modified_base (202)..(202): a, c, t, g, unknown or other
  misc_feature (202)..(202): n is a, c, g, or t
  modified_base (218)..(218): a, c, t, g, unknown or other
  misc_feature (218)..(218): n is a, c, g, or t
  modified_base (311)..(311): a, c, t, g, unknown or other
  misc_feature (311)..(311): n is a, c, g, or t
  modified_base (530)..(530): a, c, t, g, unknown or other
  misc_feature (530)..(530): n is a, c, g, or t
tcagtacacgtgatcacgaccggtgctcgatttagctacgactgcaaggggaaagggggaggaactgctcagttaggacccagagggaaccatggaagccccagctcagcttctcttcctcctgctactctggctcccagactaccaccggagaaattgtgttagacacagtctccagccacctgtcttgtctcgagggaanacgcccaccctctccngcgacggccagtcaggtgttgtacgcggtctacgtagcctaggtaccagcgaacgaaaccgtcggaccaggtccctacccgaggtcctccctnacttcgtatgactcggtccgtaccgaaccgacgggtccctaacgtcgtaccgttacgttaccgacgtaccgtggttaccgagggtccgcgtaaggttcgggtccggtaggacggtagtacggtttccaacgttccaccgtaactagtacctcgacacgtccctaggctagtccagaaagtcttcgtacgctttaacgtttacttaactcgtagtacgtnttaacgtactaaaggttacggtccggttacggtaacggttacgttaccggaaccggtaacggtaaacgacggttacggtaactaacgtaacgggtaatccggaggtcacggtacaacccgttgttctaccgtcttaccgccgttaccccg

SEQ ID NO: 29255 - DNA, 693 bp, Homo sapiens
  misc_feature: GYAE6OF02HRN00.34.72.G06.1.454.CMB.1.raw
  modified_base (203)..(203): a, c, t, g, unknown or other
  misc_feature (203)..(203): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtctttgctccgaggggaaancgccaccctctcctgcagggccagtcagagtgttagcggctacttagcctggtaccagcagaacctgccaggctccaggcctcctcatctatgatcgcgtaccaacgcgggccacgtggcactcccacgccgtaggttcaggttggacgtgggttcgggtcgtcggggaccctaagtaccttccgaccttcctaccaacccgtataccgacgacctacggtacccctaaggaccgtaccgttaaaagttactttttacgaacttaaattttttacgttacgttggttaccgtagtacgttcggaacggttacgaccttaacggttcccggtccccgtttacccgttagaccggttcccgttccccgttccggggacccgtaacgggtaccctacgggtaccgttaagggaacgttaaacgtttaaaacccggacgttcggttacggtccgtacgtaccacccgttacgttccgttacgtaccctttaccg

SEQ ID NO: 29256 - DNA, 682 bp, Homo sapiens
  misc_feature: GYAE6OF02GL3EJ.34.72.G06.1.454.CMB.1.raw
  modified_base (203)..(203): a, c, t, g, unknown or other
  misc_feature (203)..(203): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctccagataccaccggagaaattgtgttagacacagtctccagccaccctgtctttgtctccgaggggaanacgccaccctctcctgcgagggccagtcagagtgttagcggtactacttagccgtgtaccagcaagaaacctggaccaggcctccgagtcctcctcatctatgatcgacgtaccaacgcggccacgtgccactcccgagccgtaggttcacggtggcgagggttcgggtctcggggacctaggtacctttacgacctcgtaccacctacgtacagccgacgtacctaggacgtaacctaaagtttcgtttacgactttaattttacgtaccttagttcgagttcgaggtaccgttaggaccttaacggtcccggtacccttaccggtgtaaccgggtcccgttaccgttccggggaccggtaacggaacccgtaccgtaccggttaagggtaaaccggtaacggtttaaaaccggaggttccggttacgtaccggttacgtaccctaaccgttactttaccgtcgttaccctttaaccg

SEQ ID NO: 29257 - DNA, 714 bp, Homo sapiens
  misc_feature: GYAE6OF02I920S.34.72.G06.1.454.CMB.1.raw
  modified_base (203)..(203): a, c, t, g, unknown or other
  misc_feature (203)..(203): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccagccaccctgtcttgtctccgaggggaaancgccaccctctcctgcagggccaggtcagagtgttagcggctacttagcctaggtaccagcaagaacctggccaggcctccgagcctcctcatctagtgatcgctaccaacacgggccacgtggccagtcccagcctaggtcaggtcgctagggtcgggtctcggggaccaggtaaccttcgaaccgttcctacccaacctacgttaccgaagcctaacgtacccgtaacggaacgtaaccctaaaacggttacgttttaacggacctttaaagttttaacgtttaaacgttcgtaacgtacgttccgttacggtaaccggttaccgtaaccgtaaaccgttccgggttaccccttacccggttaggacccgttcccgggttcccgttaccggggacccgtaacggggtaccgaaccggtacgttaggaaaccgtaaccggttaaaccgtacgggttacgacgggtacctacggtaccctaaccgtatttccgtaccgtttaccgttaccg

SEQ ID NO: 29258 - DNA, 921 bp, Homo sapiens
  misc_feature: GYAE6OF02HYZGK.34.72.G06.1.454.CMB.1.raw
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtctccacgccaccctgtctttgtctccgaaggggaaagagcccaccctctcctcgcgagggccagtcaaggagttgttaggcggtactacttagcctggtaaccagacacgaaacctcggccacggcctcccaggacgtccctacactacctatcgtaccgtacctaactacccgaaccgaacggggacccaacgttcgtacctaacttcccgaagtccggtaacggtttaccgagggttcggtaccgtaggggttacgggggttcctacggggggtacctaaagggttaacgtttaccgtaaccctttaccgttacccgtaacccggtaacttacccggacggtaacccgaaccggtccccgtacgggaccccgttaacggtaacccgttaggttaaaacgggttacgtttaccggttacgttacccgtttaaacctttttaacgtttaaccgtttaggtttaacccggtaacgttaaccgtaacgtttaaccgtttaaaagttaaaccgggttaccggggtaccggggtttaccggggtaaccgggtttaacccggggtaaacccggggtaaacgggggtaaaccggtaaacgggggtttaacgggtaaaaacgtttaaacccggtaaaaccggaaaacccggttttaggggtaaccggggtaaccgtttaacccggtaacccgtaaacccgttaacggttaaccgttttaccggtttaccgtttacccgttaacccgtttacccccccgg

SEQ ID NO: 29259 - DNA, 938 bp, Homo sapiens
  misc_feature: GYAE6OF02I1UK6.34.72.G06.1.454.CMB.1.raw
tcagtacacgtgatcacgaccggtgctcgatttagctacgactgcaaggggaaagggggaggaactgctcagttaggacccagagggaaccatggaagccccagctcagcttctcttcctcctgtctactctggcctcccagactaccaccggaagtaaattgtgttgacacagtcctccacgcccacccttgttctttcggtccttaccgaagggggaaacgcgccctacccttcctccctcggacgacgggtccaggtccaggtacggttggttacggccggtacttaacgttacggtcccgttacgggtacccaaggaccgtaaacggtaaaacccggtgggaccccgtaacgggccctacccccggacggtccccttaccctacctacgttacccgtaagttacggtacgttccgggtaacccggtaaccccgaaaccgggtacgggggtacccctaacggtacggggtacccctacccgttacccccgaacggtcccccgggtaagggggtttccctaaacgggggttcggggaccggttagggggtttaccgggggtttcccggtaacggggggtacccctaacgggttacccttttacccggaaccttttccgtaaccccgaaccccttaacgtaacccgtaggtaacccggaccggttaaccccggttaaaacgggtaacccgttaaaccccggtttaaaaggtttaacgtttttaacggtaaaccttttaaacgtttttacgtttactttacggtaaccgtacgtacgttacggtaccgtagtacccgttacgtcccggtacccgttacccgtcgtacggtccgttccgttaccggggaccgtacgggactacggtacgtacggtaacgtaacgttaacgtacggttcggtacggtccgtacgaccgtacctacgtcttacttctcccg

SEQ ID NO: 29260 - DNA, 655 bp, Homo sapiens
  misc_feature: GYAE6OF02GK8H4.34.72.G06.1.454.CMB.1.raw
  modified_base (200)..(200): a, c, t, g, unknown or other
  misc_feature (200)..(200): n is a, c, g, or t
tcagtacacgtgatcacgaccggtgctcgatttagctacgactgcaaggggaaagggggaggaactgctcagttaggacccagagggaaccatggaagccccagctcagcttctcttcctcctgctactctggctccagataccaccggagaattgtgttgacacagtctccagccacctgtcttgtctccgaggggaancgccacctctccgtgcgacgggccagtcagagtgttagcggctacgttagccttaggaccagctaacgaaacccgtggaccaggtcctacccgaggccttcctcacttcgtaatcgatcgccgtaccaagacgggccctagtggaccactcccgagcctaggtcaggtgactggtcggtctgggaccagtacctttcaaccgtttcaccgaacctagtaccgagtaccgacggtacccgtaagaccgccgtaggtaacgttagtttacgacgtagttgttaacgttacgtacgtaacgtaacgttcggttcggtacctacgtactaccggtacggttagtaccgggttccggaaccgggaaacgggtaacgaagggttaacggtaactacgaacgtaacggtcgtacgtacggtccacgtacctagtaccgttgttacttctcgttaccgtcccg

SEQ ID NO: 29261 - DNA, 1005 bp, Homo sapiens
  misc_feature: GYAE6OF02HL995.34.72.G06.1.454.CMB.1.raw
  modified_base (209)..(209): a, c, t, g, unknown or other
  misc_feature (209)..(209): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggcctccagataccaccggataaattgtgttgacacgagtcctccagcccacccttgtccttgtcctccgaagggaaancgcccaccctctacctgacgacggcctagtcaggtagtcgttagcggtacttacgttacgccgtagtaccagtacgaacgaacctggaccgtaggtccctacccgaggtcccttccgtactacgttactacggtcggtaacgttcggacccgttaacccggaaacggtacccgggtaccctaaccgggtcggtaccccgttaccgtacccccgtaacgggttaccccggttacgggtttaccgggaacgggttttccggggaccggtttaaccgggggttccgggggtaccgggttacccgggggtaaccctttaaaccgggttcccgtttacccgtaccgtttacccgaaccccttaaccggttaccgtaccgggtaaaccgtcccggtaacccggttaaccggtttaaaccgaaaccgggtttaaacccttttaaaagggtttaccggtttttaaccaaaaccttttaaacgtttttaaccgttaccggttaacggtcccggtttaaacgttccggttaaacgtttaccggggaaacttacccgggttaccggttacccgggttaccccctttaacggttacgaccccgggttttaccgttccccgggttaaccgggggtacccgaacccggggttaaccgaccgggggttaacccggttaacgggtaacccggtttaaaaacggttaacccgggtttaaccgaccggggtttccggtaacccgtaaccggggtaaaccctacccggtttaacgggtttttaaccctttcccggtttaccgtttaacccccggg

SEQ ID NO: 29262 - DNA, 776 bp, Homo sapiens
  misc_feature: GYAE6OF02FW0DR.34.72.G06.1.454.CMB.1.raw
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (185)..(185): a, c, t, g, unknown or other
  misc_feature (185)..(185): n is a, c, g, or t
  modified_base (191)..(191): a, c, t, g, unknown or other
  misc_feature (191)..(191): n is a, c, g, or t
  modified_base (208)..(208): a, c, t, g, unknown or other
  misc_feature (208)..(208): n is a, c, g, or t
  modified_base (271)..(271): a, c, t, g, unknown or other
  misc_feature (271)..(271): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagaaattgtgttgacacagtcccacncnccctactnttcttntcctacggaaggaagcnccctacctctcgtgcggacgcagtcgagtagttagtacggccgtacttagtccgtcgtcgacngcgtagaccgtccgtcggaccgacggtccctaccggaggtccccttccgtactaccgttttcggttcggtccgtaccccgtacccgaccgggtacccgggtaccctacgggtccgacctaccccgtacgaacgtaccggtacggttcgtacggtcggacgttgggtcggtggacgggtacacgtcgtcacttcaccgactctacgtcgactcgtactacgaccgtcgtaagtaacgtttacgtttcgaccgtttaaggttacctttacgttacgttacgtaacgtacgtaacgtaacgttacgtaaccggtacgaaccgtacggttacggtttcggggttccgggttaccggttaccgggaaacgggtaaccgggtaaaccgggttaacggggttaaccgtaaaccgtaaaccggaaacggttcggtaacggttacggtaccgttaccgaacccgttaccttacggtttaccgtaccgttttacgttacctacccgtttccccgg

SEQ ID NO: 29263 - DNA, 892 bp, Homo sapiens
  misc_feature: GYAE6OF02I67TW.34.72.G06.1.454.CMB.1.raw
tcagtacacgtgatcacgaccggtgctcgatttagctacgactgcaagggaaagggggaggaactgctcagttaggacccagagggaaccatggaagccccagctcagcttctcttcctcctgctactctggctcccagataccaccggagtaaattgtgttgacacagtcctccagcccacccgttgtctttgtcctccgaaggggaaagacgccctaacccttctcctgcgtacgggcctagtcaggtagtgttacggcggtacttaaccgttaggccttacgggtaacccaggtaccgaaacggaaaaccccgttggaccccgtaaaccgggtccctccccgaagggtccccttccccgtactaacgttcctaaactggtaactccggtaccgtaacccgtaacggccggggacctaccggtcggacctaccgtaccccgagtaccgtagggtttacaggtcggacgtacgggttgggtccgtcgggcctaacgttcttaccgtaaccgtttccaccgaacccgttactaccgtacgtaccgaccggaacctaacggtacgtaaacccgttaaacgttacgttttacgaacgtttaacttttaacgttaaccgttacgttacgtaccgttaccggttggtaaccgtacgtacccggttaacttaccccgggttccccgttcccggttttacggaacccggtttcccggtaaccccgggtttccggggtacccgggtaaccggggtaaacccgtaacccgggtacgggtaaccggtaagggttaaaacccggtttaaacggtttaaaccggttaccgggttaccggtaacccgggttacggaaccgttaaccggtaacccttccggttccgttttaacccccttaaccgg

SEQ ID NO: 29264 - DNA, 691 bp, Homo sapiens
  misc_feature: GYAE6OF02I5G7L.34.72.G06.1.454.CMB.1.raw
  modified_base (312)..(312): a, c, t, g, unknown or other
  misc_feature (312)..(312): n is a, c, g, or t
tcagtacacgtgatcacgaccggtgctcgatttagctacgactgcaagggaaaggggagaactgctcagttaggacccagaggaaccatggaagccccagctcagcttctcttcctcctgctactctggctcccagactaccacggagaattgtgttgacacagtctcagccacctgtcttgtcctcgaggggaacagcctaccctctcctggcacgggccaagttcgagtagtcgttacgcggacttactagccttggtaccagccaacgaacctcggccacggtccgtcccgtaaggcctccctcgtacncgttacgtggtcgactacgtacccgtaccgtaacggggaccctacgtacgggtaccttacccgacgtacccgtggttaccgtagtcggtactacggtcgggttacgttaggggactaaggtacttactaactccgttaccgaaccctaggtacaccgggtacaacggcccgttagtacccgtagtaccgtaagtaacgttgttttacgatttaaccgtttacgttacgttacgacgttacgtacctaaacgtaacgtaaacgttaggtccgtaccgttcgtaactccgtaccgtaccggtaacacgggactacgtacgagtacgtagttaaaccgagttcgtaacgcgacgactacgtacgtcttcgtccgtatacccg

SEQ ID NO: 29265 - DNA, 669 bp, Homo sapiens
  misc_feature: GYAE6OF02JGIHY.34.72.G06.1.454.CMB.1.raw
  modified_base (98)..(98): a, c, t, g, unknown or other
  misc_feature (98)..(98): n is a, c, g, or t
  modified_base (210)..(210): a, c, t, g, unknown or other
  misc_feature (210)..(210): n is a, c, g, or t
  modified_base (307)..(307): a, c, t, g, unknown or other
  misc_feature (307)..(307): n is a, c, g, or t
tcagtacacgtgatcacgaccggtgctcgatttagctacgactgcaagggaaaggggggaggaactgctcagttaggacccagagggaaccatggaanccccagctcagcttctcttcctcctgctactctggcctcccagactaccacggagaacttgtacgttgacacagtctccagccacctgtactttggtcctcgtaggggaaancgcctaccgtcctcgtgacgacgggcctagtcagagtcgttagcggtctactgccttggaccagcacgtaacctggcaacggctaccgaggtcctcntatctatgatacgccgtacaacggcggacctcgcggacactacccgagtccgtaggttcaggtcggcgtacggggtcggttacgacgggaccagtaccgttacaccgtctaacgcaactcgaacgttcgaacgtacgtaacgaacgtaacctaaagttatttacgtacgttaaattttagtacgttacgtacttaggtacgtcgtactacggtcctaaacgtccggtaccttaccggtacgaaccgtccgttaacccgttcgggacccggtaacgaccgtaacggtccggtaagggtaacgtaacccgttaaagaccggttgtaacgtcgtaccggactacctagtaccgtacttcgttacc

SEQ ID NO: 29266 - DNA, 710 bp, Homo sapiens
  misc_feature: GYAE6OF02H1VO7.34.72.G06.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (295)..(295): a, c, t, g, unknown or other
  misc_feature (295)..(295): n is a, c, g, or t
  modified_base (546)..(546): a, c, t, g, unknown or other
  misc_feature (546)..(546): n is a, c, g, or t
tcagtacacgtgatcacgaccggtgctcgatttagctacgactgcaagggaaagggggaggaactgctcagttaggacccagaggaaccatggaagccccagctcagcttctcttcctctgctactctggctccagatacaccggagaattgtgttgacacagtctccagccaccctgtctttgtctccagggaaanagccacctcncctgcaggccagtcagagtgttagcgggctacttagcctggtaccagcaagaaacctggccaggctccacggtctcctcgatctaatnactgactccgaaacgcgggaccaccgtggcctacgttacccgagtacccaggtttccaaggtcgacctaggtcgggtacgtaggggcccaaggtaccttaactcctacgttacaaccccgttaagtccaaacggccgtaacgtacccgtttaagaaacggttaaccccgtaaaaaggtttaaccgttttgggtaaacctaacggttttaatttaacccgtagttaccgtaagtccttaacggtcgttaaanccgtaaacgtccggtacccgttacccgtttcgacggtaccgcccgttttacggggacccgacgggttacgaccggtaccgtacgggaacgtaatttaaaacccggaacccgttgtaacggtccgttaacgcctaaccgtattaacccgtttccgtattttcccg

SEQ ID NO: 29267 - DNA, 776 bp, Homo sapiens
  misc_feature: GYAE6OF02IHYY7.34.72.G06.1.454.CMB.1.raw
  modified_base (208)..(208): a, c, t, g, unknown or other
  misc_feature (208)..(208): n is a, c, g, or t
  modified_base (494)..(494): a, c, t, g, unknown or other
  misc_feature (494)..(494): n is a, c, g, or t
tcagtacacgtgatcacgaccggtgctcgatttagctacgactgcaagggaaagggggaggaactgctcagttaggacccagagggaaccatggaagccccagctcagcttctcttcctcctgctactctggctcccagataccacggagaaattgtgttgacacagtctccacgccacccttgtcctttcgtctccgaaggggaaancgccctaccctcctccgtgccgacgggaccagtcaggtagttggttacgcggtactacgttacgccgtaggtaccagccaacgtaacctcgggaccaggtcctcccgaacggccttctacctagttcctagtagacgtcgtaccgtaaccgaaccgagggcccctacggtggccctacgtacccgacgggtacctaggtccggagttcgggacgacggggttcggtccgtacggggacctaacggtacctttaccgaccgtttccgaacccgaacccggtttaacnccggtaaccgtcggtaaccgttacccggttaaacggtaaccggtttaaaccgttaaacgtttacgttttaacgttaaactttaaacgttttaccgttaacgttacgttacgccgttacgtacgtacgtacgaccgtacgttcccgtaccgttaccgtcgaccgttccgtaccggtaccggacggtacgacctacggtacgtaggaaccgttaaacggtaaccgtacggtacggtaccggtacgacccgtactaaccgttcgttaccgttggttaccttaccg

SEQ ID NO: 29268 - DNA, 561 bp, Homo sapiens
  misc_feature: GYAE6OF01A3KUP.39.71.G05.1.454.CMB.1.raw
  modified_base (140)..(140): a, c, t, g, unknown or other
  misc_feature (140)..(140): n is a, c, g, or t
  modified_base (167)..(167): a, c, t, g, unknown or other
  misc_feature (167)..(167): n is a, c, g, or t
  modified_base (256)..(256): a, c, t, g, unknown or other
  misc_feature (256)..(256): n is a, c, g, or t
  modified_base (429)..(429): a, c, t, g, unknown or other
  misc_feature (429)..(429): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcggngtgtttctaggtggctattttaaaggngtcagtgtgaggtgcagctgttggagtctgggggaggcttgggtacagccgggggggtccctgagctctcctgtgcagcctctggatcncttcagcagctatgccatgaccttgggtccgccaggctccagggaagggacgtggagtgggtcgtcggtctattagttggaagtggtggcttatacaaactaacgcagcctccgtcgaagggccggcttcaccatctccagagactattccaagaagcaactccttgtatctnacaatagaacacgcgtgagacgacgacggacgacgtaccgtactattagttgtagtacgtaagtagggtggggtagggtggggtcgtacgtcgttcggttcggtttacgtacgtacggtcgggtcggacggg

SEQ ID NO: 29269 - DNA, 660 bp, Homo sapiens
  misc_feature: GYAE6OF01CJ1C3.39.71.G05.1.454.CMB.1.raw
  modified_base (170)..(170): a, c, t, g, unknown or other
  misc_feature (170)..(170): n is a, c, g, or t
  modified_base (298)..(298): a, c, t, g, unknown or other
  misc_feature (298)..(298): n is a, c, g, or t
  modified_base (346)..(346): a, c, t, g, unknown or other
  misc_feature (346)..(346): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtgtcgttttctaggtggctaattttaaaaggngtccagtgtgaggtgcagctgttggagtcgtgggggagtcttggtacgaggccggggggtcctgagactctcgtgtgcagtcctgtggtacttcaccttcagcagctatcgccatcgacctgggtccncgacggctaccgaagggacggacgtggagtggtctcgtactagttagnggaagtcggtgtacttaagaacaaacgtacgcaacgccgttaccgaggaaccgggccctcttaccaaccctaacttccgtacccaagtacgtaaccttaacgttacccgaaagacggacctaacgttctagttactctacgacctaaatcgaaactacgccttaggaacgtcgaccggaacggaccgtaaccggtacccttaatactttagtggtagaacggtaaaggtggggtagggggtaggtacgggggtccttaccgtccggttagggttccggttttaaggaccgttacgggtcggggccgtaacgggg

SEQ ID NO: 29270 - DNA, 610 bp, Homo sapiens
  misc_feature: GYAE6OF01CAN7P.39.71.G05.1.454.CMB.1.raw
  modified_base (378)..(378): a, c, t, g, unknown or other
  misc_feature (378)..(378): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggagcttggtacaggccggggggtccctgagactctcctgtgcagcctcgtggacttcaccttcagcagctatgccatcgacctgggtccgcaggctccgagggaggctggagtgggtctcgtctagttagtggaagtggtgacttatacaaactacgcagcctcgtggaacggccncttcaccatcctacagacgactattaccaagagacacttctgtactctagactaaatcgaacacgcctagacgtcgaccggaggaccaccggtacccttaatacttagttggtacggacgtaaaggtcggggtaggggggtagggttcgggggtccttaccgttccgggtttcgggtttaccggttttacggaaccggtttaccgggtcgggggtacccggtaaccgggggg

SEQ ID NO: 29271 - DNA, 805 bp, Homo sapiens
  misc_feature: GYAE6OF01DU1PD.39.71.G05.1.454.CMB.1.raw
  modified_base (141)..(141): a, c, t, g, unknown or other
  misc_feature (141)..(141): n is a, c, g, or t
  modified_base (164)..(164): a, c, t, g, unknown or other
  misc_feature (164)..(164): n is a, c, g, or t
  modified_base (188)..(188): a, c, t, g, unknown or other
  misc_feature (188)..(188): n is a, c, g, or t
tcagtcgcactagtcacgaccggtgctcgatttagtgtcgtcgcaagagagagggcccagccctgggattttcaggtgttttcatttggtgatcaggactgaacagagagaactcaccatggagtttgggctgagcggtgngttctaggtcggcatttaaaggngtcagtgtgagtgcagctgttggngtcgtggggagtcttggtacgacggtcccgggggtcctgacgtcctcgtcgtgtcgcacgtcctacgtggtacttccgtaccttcgagcgagtctagtcgacctagtcgaccgttcgggccgacgtacggtcctaccggaagggaacggtacgtggaggttcggtcgttcgtacgtagttacggtaggtaacggttcggtacgtaacgttaacgtaacgtaaaccgtaccgacgtacgtcccgtacggtacggaaccggtaccgtccttaccgtaacctacgttaccgtaccgtaacgtaaccgttaaccgttaccttaaccgaaaggtacccgtacccttaccgttacgttacgttacgttacgtacgtaaccgtaaacgtaacgtaaccgtaaccgtaccgtaccgtacggtaccggtaccggaaccggtaacccggtacccggtacccgttaaccgtttaacgtttacgttacggttaacggtaacggttaaacgggttacggggttacgggggtacggggttaccggggttaccggttacccggttacccggttacgggttacggtttacggttacggttaccgggtaccggggtaccgggtacgggtaccgg

SEQ ID NO: 29272 - DNA, 711 bp, Homo sapiens
  misc_feature: GYAE6OF01AHZY6.39.71.G05.1.454.CMB.1.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (439)..(439): a, c, t, g, unknown or other
  misc_feature (439)..(439): n is a, c, g, or t
  modified_base (460)..(460): a, c, t, g, unknown or other
  misc_feature (460)..(460): n is a, c, g, or t
  modified_base (469)..(469): a, c, t, g, unknown or other
  misc_feature (469)..(469): n is a, c, g, or t
  modified_base (508)..(508): a, c, t, g, unknown or other
  misc_feature (508)..(508): n is a, c, g, or t
tcagtcgcactagtcacgaccggtgctcgatttagtgtcgtcgcaagagagaggggcccagccctgggattttcaggtgttttcatttggtgatcgaggactgaacagagagaactcaccagtggtaggtttgggctgagcggtcgttcgtttctaggtcggtacttaaagttttaaaggtcgtaccgtagttgtggaggtgcagtcgtggttggagtcggtgggggagtgttaggtacgcgggtccgggggtccngacgtctctctgngcncgcctgtgtacttcctaccttcgagcgacgtcttagcgacctagttccgacggttcgggtccccgcggtacggtcctaccggaaggggaacggtcgtggtaggtcgggtcctcgtacttagtttaggagggtaacgtgggtactacgttaacaaactaaacgcgacncgtcgtccgtaggacggtccncgtaccacntcctacgagactactactacgaagcgactactgtaactnccgtagtacgaactacgacacgtcctggtaacgtcgacggtacgaccgtaccggtacttaagttacttagttaggaagtacggtaaagggtcggggttaacggggggtcggtacggggtactttcccggtacgggtttggtttttacccgggttaagtaccgggttacccgggtagggggtcccggtaaggggttacccccgg

SEQ ID NO: 29273 - DNA, 772 bp, Homo sapiens
  misc_feature: GYAE6OF01AN3L7.39.71.G05.1.454.CMB.1.raw
  modified_base (170)..(170): a, c, t, g, unknown or other
  misc_feature (170)..(170): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcggtcgtgtttctaggtcggctaatttaaaggtntcagtgtgagtgcagctgtgagtgtgggagcttggacaggccgggggtcctgagctctccgtgtgcactcctcgtaggacttccaaccttcagcagtcctatcaccgatcgtaccgttcgggtcccaacgtacgccgtccggaagggaacgggtacgtaggacgtcgggttaacctccggttactaagttggtagggtaaagttggtcgtaactttacggtaaaccaacgttaacgcggaaactcccgtttacgtacggggaacgtccccggttactacctaaaccgtcgtaacccttcccggaagattaacccggttacttaacccggaataaccgtcgtaccttacgtacgtacgtacgtaacgtaacgtaaacgtacgtaccgtacgtacgtaacgggttaccgtaaccggtaacccgggaacgaaccccgttaccgtaactttaaacgtttaacggttacgttacggaacggtaacggttaaggggtacggggttagggggtaaccgggttaccgggttaaccttcccgggttaccggtttacgggttttaccgtaccggtaccggttaaccgggtccgggtaccggtaccggtcccg

SEQ ID NO: 29274 - DNA, 613 bp, Homo sapiens
  misc_feature: GYAE6OF01D732P.39.71.G05.1.454.CMB.1.raw
  modified_base (187)..(187): a, c, t, g, unknown or other
  misc_feature (187)..(187): n is a, c, g, or t
  modified_base (300)..(300): a, c, t, g, unknown or other
  misc_feature (300)..(300): n is a, c, g, or t
  modified_base (572)..(572): a, c, t, g, unknown or other
  misc_feature (572)..(572): n is a, c, g, or t
  modified_base (602)..(602): a, c, t, g, unknown or other
  misc_feature (602)..(602): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtgtgtttctaggtggctaattttaaaaggtgtccagtgtgaggtgcagntgttggagtcgtggggagcttggtacaggccggggggtcctgacgactctcctgtgcagtcctcgtggattcacttcagtcagtctatacgccaagtcgaccgtggggtcccnccgaacggcctaccggaagggggaagggtacgtagggaggtcggggtcttacggtctaagttaggtaggtaaagtggtggacttaagtaaacctaaacgtacgactacgtcctaccggtaggaacgggccctcttaccacctatctaccaagtacgactacgttaccaaggacactaactcgtatctacgtatacaatacgaactagcctagaagtcgaccgacgaccgacggtaccctatattacgtagtgacgtaaagtcgggtaggggnggtagggctacgtggtcgtgttcgagtcgngggctaacggg

SEQ ID NO: 29275 - DNA, 700 bp, Homo sapiens
  misc_feature: GYAE6OF01BJ117.39.71.G05.1.454.CMB.1.raw
tcagtcgcactagtcacgaccggtgctcgatttagtgtcgtcgcaagagagaggagcccagccctgggattttcaggttgttttcatttggtgatcaggactgaacagagagaactcaccatggagtttggctgagcgtggtgtttctaggtgcttaatttaaaggtgtccagtgtgaggtgcgagcgttgttggagtcgtgggggagtcgttggtacgcgggccgggggtcctgacgtacctctccgtgtgcgcgtcctgtaggtacttcctaccttcgagtacgtagtacctgtcgtacctacgtcgtaccggttcgggcccgaccgtcggaccgtacgggaacgggaacgggtacgtagggtggtcgggtctaccgttagtaaggttaggtagggtacgtggttactacttacgtaaacctaacgtacgaccgtacgtcccgtacggtacgtaacgggtccctacgttacaacgtcgttccgaacgtacgacgtacgtactaccggaatcgacctcgttactacgtagtacctaggaaactaagtcgtaacgacgtccgtgaaccgtggaccggacgtacgaccgttactaacgtctaggttcgacgtacggtaagggtggggtaacgggtcgggttacgggcttaccggtttcggaggtttccgttagaccggtacgggttcgggcgtaaaccggg

SEQ ID NO: 29276 - DNA, 761 bp, Homo sapiens
  misc_feature: GYAE6OF01BF1V2.39.71.G05.1.454.CMB.1.raw
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgttggagtcgtgggggagtcgttggtacgagggcccgggggggtccctggacgacctctccgtggtcgccacgtcccttcgtggtactttccaaccctttcgacgccaggtccttaagtccgcctaagtcggaacccgttcgggggtccccgcccgtacgggcccttaccggaagggggtaaacggggaccgtaggggacgggtttcggggttccttacggttacctttaagtttaaggggtgggtaaaggttgggttacgtactttaaacgtaacctaaaaccgtcgaccgtacggtccccgttaccggtacggaaacggggtccccgtaccgtttacccaacccgtacgttccctacccgtaaggacgtaaccttaacgttaccgaaagtacgacctacttctacgtacttcgtagaactaaatacggaactacgtcctgacggtacgaccgggaacgtaccgaacccggtcctaagttactttagttgtagacgtaaggtggggtagggggtaggtcggggtctaccggttcgtcgggttctttacggacgtcggtgggccgtacgggg

SEQ ID NO: 29277 - DNA, 731 bp, Homo sapiens
  misc_feature: GYAE6OF01A7UUW.39.71.G05.1.454.CMB.1.raw
  modified_base (183)..(183): a, c, t, g, unknown or other
  misc_feature (183)..(183): n is a, c, g, or t
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
  modified_base (319)..(319): a, c, t, g, unknown or other
  misc_feature (319)..(319): n is a, c, g, or t
  modified_base (442)..(442): a, c, t, g, unknown or other
  misc_feature (442)..(442): n is a, c, g, or t
  modified_base (458)..(458): a, c, t, g, unknown or other
  misc_feature (458)..(458): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (504)..(504): a, c, t, g, unknown or other
  misc_feature (504)..(504): n is a, c, g, or t
tcagtcgcactagtcacgaccggtgctcgatttagtgtcgtcgcaagagagaggagcccagccctgggattttcaggttgttttcatttggtgatcaggactgaacagagagaactcaccatggtaggtttgggctgtacgtcgttggttcttttcgtaggtcggtacttaagttttaaaggngtcctagtgtggagtgcgagtcgtggttcggngtcgggtggggngtcgtcggtacggccggggtccggggtctgcgtctccgtcgtgtcgctacgtcctcgtagtcctacctaccgtctacggctagtctacggtntacccgtagtccgacgtccggcccgacgacggtccgagggtacgggagggtcgtacggtaggttccggtacttcgtagttacgtacgggtagtacggtcgtacggtctaaacgtactaaccgngtccgacgtcaacggnggtaccgtctacncgtacncctagactagtactagtacacgtaacnctactacgtctacgtctacgtaacgtacgtaaactacgacgtacctacgtacggtacgtaccggtaccggtaaacggtacccggttaaccttacgttactttacgttaccggtacgttaaccggtaggttaaggggttacggggtaccgggttacggcccggggtttacctcggggttacggtttcgttcgggttacgccggttacgggccgggttaccggaccggg

SEQ ID NO: 29278 - DNA, 874 bp, Homo sapiens
  misc_feature: GYAE6OF01A1LKS.39.71.G05.1.454.CMB.1.raw
  modified_base (129)..(129): a, c, t, g, unknown or other
  misc_feature (129)..(129): n is a, c, g, or t
  modified_base (334)..(334): a, c, t, g, unknown or other
  misc_feature (334)..(334): n is a, c, g, or t
tcagtcgcactagtcacgaccggtgctcgatttagtgtcgtcgcaagagagaggagcccagccctgggtatttttcgaggttgttttcagttttggtgatcgaggactgaacagagagtaacctcaccngtgggtaggttgggcttggacgtcgtcggtttctttttcgttggtaggttacgtttaaagttttaaaggtcgtaccgtaggttggtaggtacggtggcctagttcgttgggttgggtacggttcggggtagggggtacgtttcggttacgggtacgggtaccgggggtcccggggttcctagggacgtccttcgtccgtggtacncgtcgtccgtagtacgtcttaccgtacgttacgacgtctacgtactcgtcggacctaggtccggtaccccggtgggccccgaagtaccgggtacccgggtaccggggtaaagggtacggtaccgtgggggttacgttccgggttcccgttacgttagttaacgggttaacgggtaggttaggtgttaaccgtaccgtttaaagaaacccgttacgggtcccgtatacccggtaaccggtcggtaaccgggtccggtacctaccgttacaccgtttcgaccgtaacgaacgtaccgtaacttacgtacgacgtactacgttacctgtacgtacgtacgtactaagtacgacgtacgtactacggtacggtaacgaccggtacggaaccgtaccgtacgttaacttacgttacgtacggttacggtaaccggttaggttaacggggtacggggtaccgggttgggtacccgggtttactccccgggtttggtaccgtttaccgggttaacgtacccggttagggggtcccgcgggtcccggg

SEQ ID NO: 29279 - DNA, 879 bp, Homo sapiens
  misc_feature: GYAE6OF01E36AZ.39.71.G05.1.454.CMB.1.raw
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtcttttttcttgtggtacttaagtttttaaaagggtcgtccgtagttggtggaggtgcagtcgtggttggagtcggtgggggaggtcgttgggtacgacggggcccgggggggttccctggacgaccttccgtccgttgtacgcacgtccttcgtaggtaccttcctaccgttcgacgcacgtacctatcgacctagtccggtaccgtccggggtaccccgacccgacgggtccgtaccgggaaagggtaacgggtaccgtagggtacggtttcggggttaccttacggttacgttaagttacgggttaggaaggttcggtacttacgttaactaaaccgtaaaccgtacgaccgtaccgtcccggtacggtacgggtaacgggtcccgtccgttaacccaccttaccgtcctaaccgtaacgtacgttaacctaccgttaaccaacggtacgacctaccgttacgtagttactacgtaacgaacgtaaaacgtacgaaaccgtacgacccgtgtaaccggtacggaccggaaccggtaaccgtaccccggttacttaacgtttacggtttaacgttcggttaacggtaaccgggtaaggggtttaccgggggggtaggggggttaccgggggttacggggttacccgtttacccggtttacccgggtttagggtttacccgggtttacgggtaaaccccgggttcggggttacccgggggaccgggttaacccggggg

SEQ ID NO: 29280 - DNA, 709 bp, Homo sapiens
  misc_feature: GYAE6OF01AGA31.39.71.G05.1.454.CMB.1.raw
tcagtcgcactagtcacgaccggtgctcgatttagtgtcgtcgcaagagagaggagcccagccctgggattttcaggtgttttcatttggtgatcaggactgaacagagagaactcaccatggagtttggctgagcgtgtcttttctgtggcttaatttaaaaggtgtcagtgtgaggtgcgagtctggttggagtcggtgggggaggtcgttggtacgacgggccgggggtcctggacgctcgtccgtgtcgcgacgtcctgtacggtactccgtaccttacgagtccacgctatccgactacgtcgaccggttcgggacccgccgtacggccgtaccggaacgggaggtacggtggtacgggtcggtaccgttcgtgtacgttaggtacggtaggttcggtagtaacttacgtaaccgtaaacgtacgcgaaccgtccgtaccgtaggaccgggtccctacgtcctaccgtactccgcgacgtacgtaacttactaccgaactacgacgtactcgtactactctacgaataacgacgtaacgacgtcgtaggtaccgtacgtacgaacggtacacccgttacgttagttacgttagtaccgtaggtaaccgtaaagggtcggggcggggtagggtaccggttccgttaccggttccgttagggtttccgttaacggtcggttaacgggtccgggtacggtacccggg

SEQ ID NO: 29281 - DNA, 538 bp, Homo sapiens
  misc_feature: GYAE6OF02GL58L.39.71.G05.1.454.CMB.1.raw
  modified_base (378)..(378): a, c, t, g, unknown or other
  misc_feature (378)..(378): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacaggccgggggggtccctgagactctcctgtgtagcctctggattcaccttcagcagctatgccatgaccctgggtcccgccaggctccgagggaaggactgggagtgggtctcgtctattagtggaagtggtgcttatacaaactcgcagcctcgtgaaggccncttcaccatctccagacgactattccaagagcactctgtatctgacaaatgaacagcctagagtcgccgaggaccacggcccttatattatgtgacgaagtggtagggggagtggggctacgtccgtggtcgtttcggacttacggtgggccgagggccg

SEQ ID NO: 29282 - DNA, 631 bp, Homo sapiens
  misc_feature: GYAE6OF02IF6NG.39.71.G05.1.454.CMB.1.raw
  modified_base (169)..(169): a, c, t, g, unknown or other
  misc_feature (169)..(169): n is a, c, g, or t
  modified_base (259)..(259): a, c, t, g, unknown or other
  misc_feature (259)..(259): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcggtcgtggttctaaggtcggctatttaaaggntcagtgtgagtgcagctgtggagtctgggagctgtacagccgggggtcctgagactctcctgtgcagcctctggattcaccttcagcagntatgcatgcgtcggtccgcgcgcgtaccgaggaggacgtaggaggtggtcgtcgtacgtagtaggtaggtagtggtgtacgttactaactaaacgtacgacgacgtaccgtacgtacggacggccgtctaccacctactacctaccgtacgacgtacttacttaacgtaacgacgactacgtacgtactactactacgtactaataacgtaacgtacgtacgtagtacgtacgtacgacggaccgtaccgtaccgttaacgttacgttagttagttacgtaggtaacggtagggtagggggtacgggtacgggtaccggtacgttcggttcggttcggtttacgttaccggtacggttcgggtacggtacgg

SEQ ID NO: 29283 - DNA, 848 bp, Homo sapiens
  misc_feature: GYAE6OF02GWKAC.39.71.G05.1.454.CMB.1.raw
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtggtcttttctgtggctaattttaaaggtgtccagtgtgaggtgcagctgttggagtcgtgggggagtcgttggtacgacgggcccggggggtccctggagtacctccgtccgtggtgcacgtcctcgtggtacttccgacctttcagtcgacgtctagtcgacctagtcggaccgttcggggtccccgaccgacgggcctaccgggaaggggtaacgggtacctagggaggttcgggttcgttcggttacttaagttaggtagggtaaggttggtacgtacttaacgtaacgtaaaccgtaccgtacgaacgtccccgttccggtaaggaaaccggggtcccgtccgttacccgaaccgtaccgtttcgtacccgaacggtaacgtaaccttaaccgttacccaaaggtacccgtacaaccgtttcgtaacggttactccgttacgtaacgtaaaacgttcgaaacctacgtacccggtaggtaggttacccggaccgggtaacggaaacccgttacccggtaacccgtttaaattaacggttttaacggtttccgtaacgggtaacggttaaacgggttacgggggggtcgggggggttaaacggggtccgggggttaacccgtttaaccggtttccccgggttagggttttacccggtttttaaccggacggtttaacccgggttcgggggaacccgttaacggggg

SEQ ID NO: 29284 - DNA, 613 bp, Homo sapiens
  misc_feature: GYAE6OF02JSOZ2.39.71.G05.1.454.CMB.1.raw
  modified_base (140)..(140): a, c, t, g, unknown or other
  misc_feature (140)..(140): n is a, c, g, or t
  modified_base (165)..(165): a, c, t, g, unknown or other
  misc_feature (165)..(165): n is a, c, g, or t
  modified_base (171)..(171): a, c, t, g, unknown or other
  misc_feature (171)..(171): n is a, c, g, or t
  modified_base (175)..(175): a, c, t, g, unknown or other
  misc_feature (175)..(175): n is a, c, g, or t
  modified_base (189)..(189): a, c, t, g, unknown or other
  misc_feature (189)..(189): n is a, c, g, or t
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (220)..(220): a, c, t, g, unknown or other
  misc_feature (220)..(220): n is a, c, g, or t
  modified_base (222)..(222): a, c, t, g, unknown or other
  misc_feature (222)..(222): n is a, c, g, or t
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcggngtcggttctaggcgctaattaaggncagtgngagncagtctgtgactgnggagcgtgacgnggcgggtcnganctcgtcngngcacgcgtcgtgtctctctcngangcgtgtgactacgtcgacgtcgcgcgacgacgtacggacggtacgacgtggtggtcggtcgtcgtacgtagtagtagtaggtaggtacgtacgtacgtacgtacgtacgacgtaccgtcgtacgtaggtacgtaccgtccgtaccgtaccgtacgtacgacgtacgacgtacgtacgtacgacgtacgtactacgtacgtacgtacgtcgtacgtacgtacgtacgtaacgtacgacgtacgtacgacgacgaccgtacgaccgtacttacgtacgtacgtacgtacgtagtaggtacggtacgggtacggtacggtacgtacgtacgttcggtcggttacggtacggtcggtacggtacggtacgg

SEQ ID NO: 29285 - DNA, 536 bp, Homo sapiens
  misc_feature: GYAE6OF02F1FCU.39.71.G05.1.454.CMB.1.raw
  modified_base (292)..(292): a, c, t, g, unknown or other
  misc_feature (292)..(292): n is a, c, g, or t
  modified_base (380)..(380): a, c, t, g, unknown or other
  misc_feature (380)..(380): n is a, c, g, or t
  modified_base (397)..(397): a, c, t, g, unknown or other
  misc_feature (397)..(397): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtctgggggaggcttggtacaggccgggggggtccctggagactctcctgtgcagcctctggattcaccttcagcagctatgccatgacctgggtcccnccaggctccgaggggaagggactggagtgggtctcgtctattagtggaagtggtgcttatacaaactcgcagcctcgtgaacgggccncttcaccatcctcaganactatccaagagcactctgtactctgacaaatgaacagcctgagtgccgagacacggcctatattatgtgacgaagtgggtggggggagtcgggggcttacgtccgtggtcgttttgactacggtcggggcctacgggg

SEQ ID NO: 29286 - DNA, 738 bp, Homo sapiens
  misc_feature: GYAE6OF02G8E90.39.71.G05.1.454.CMB.1.raw
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtggtcgttttctaggtggcttaatttaaaaggtgtccagtgtgaggtgcagctgttggagtcgtgggggaggtcttggtacgacggcccggggggggtccctggacgacctctccgtgtgcacgccttcgtggtacttccacctttcacgcagctatcgccatcgaccgtcggggtcccgccgacgccgtacccggaaggggaacgggcctaggggaggttcgggtccgttcgttacctagttacggtagggtaaggtggtagtacttagtaacgtaaactcggaccacgtcccgtcgtaggaacgggccgtcttaccacctactacctccaagtacgtaccttaactaccgaagtacgacctactccgttatacttctacgacgtaaacgtcgaaactacgtaccctagtacggttaccggaccggacggaacccgtacccgggtacctttaacgttaagttttacgttagttacggtaacggtaagggttcgggggtaagggggggtaacgggttcggggtaccgttaccgggttacccgtttagggggttcgttttaccggaacggtttacgggtccggggtaccggtaaccggggg

SEQ ID NO: 29287 - DNA, 673 bp, Homo sapiens
  misc_feature: GYAE6OF02GLICJ.39.71.G05.1.454.CMB.1.raw
  modified_base (150)..(150): a, c, t, g, unknown or other
  misc_feature (150)..(150): n is a, c, g, or t
  modified_base (166)..(166): a, c, t, g, unknown or other
  misc_feature (166)..(166): n is a, c, g, or t
  modified_base (190)..(190): a, c, t, g, unknown or other
  misc_feature (190)..(190): n is a, c, g, or t
  modified_base (289)..(289): a, c, t, g, unknown or other
  misc_feature (289)..(289): n is a, c, g, or t
  modified_base (314)..(314): a, c, t, g, unknown or other
  misc_feature (314)..(314): n is a, c, g, or t
tcagtcgcactagtcacgaccggtgctcgatttagtgtcgtcgcaagagagaggagcccagccctgggattttcaggtgttttcatttggtgatcaggactgaacagagagaactcacatggagtttggctgagcgtgtcgtttctaggnggactaatttaaaggngtcagtgtgaggtgcagctgtggngtcgtgggggagtcgttggtacgagggtcccggggggtcctaggaacgctcctccgttgtacgcacggcctcgtggtattccaccgttcagcagctagnaccatgaccgtggccgcgagtaccncggaagggacggtagtggagtcgggtctcggtacttaagtaggtaggaaggttggtgtaccttagtaaacgtaaacgtacgaccgaacggtcccgttacggagggtaaacgggtccgtaccgtttaaccgaaccttactaccgttaccgaacgtaacggtacttacggttacaacgggactaccgacgttactagtactctagacgtaatacaacgatcgtagacgtacggaccggacgaacgccgtaacctagttacttacgttagagaccgtaaggtacggggtggggtagggtacgggtaccttacgttccggtcggtttacggttacgtaacggtacggtcggtacggaccgggg

SEQ ID NO: 29288 - DNA, 590 bp, Homo sapiens
  misc_feature: GYAE6OF02FG1MT.39.71.G05.1.454.CMB.1.raw
  modified_base (509)..(509): a, c, t, g, unknown or other
  misc_feature (509)..(509): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggctttttctgtggctattttaaaaggtgtccagtgtgaggtgcagctgttggagtctgggggaggcttggtacagccgggggggtccctgagactctcctgtgcagcctctggattcaccttcagcagctatgccatgacctgggtccgccaggctccgagggaaggactggagtgggtctcgtctagttagtggaagtggtgcttataacaaactacgcacgtcctccgtgaacgggccgacttcactatcctcacgtgactataccaagagacactctagtatcgtacgactaaattacgaactacggcctaggagtcggccgaaggaccgtaacggccctaatactttattcgtacgtacgtaaagngggtaggggggtagtacgggggtctaaccgtcccggttcggtccggttttacgacgttacggtcggggtcccgtaacgggg

SEQ ID NO: 29289 - DNA, 698 bp, Homo sapiens
  misc_feature: GYAE6OF02GZ1OL.39.71.G05.1.454.CMB.1.raw
  modified_base (167)..(167): a, c, t, g, unknown or other
  misc_feature (167)..(167): n is a, c, g, or t
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (329)..(329): a, c, t, g, unknown or other
  misc_feature (329)..(329): n is a, c, g, or t
  modified_base (342)..(342): a, c, t, g, unknown or other
  misc_feature (342)..(342): n is a, c, g, or t
  modified_base (360)..(360): a, c, t, g, unknown or other
  misc_feature (360)..(360): n is a, c, g, or t
  modified_base (484)..(484): a, c, t, g, unknown or other
  misc_feature (484)..(484): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcggtgtgtttctaggtcggctatttaaaggntcagtgtgaggtgcagctgttggagtcgtgggggagcttggacaggccggggggtccngagctctcctgtgcagcctgtagnttcaccttcagcanctgnccatgacctgggtccgcaggcnccgagggaaggctgggagtcgggtctcggtctagtttagnggtaagtggtgtnttataacaaacgttacgngacgtcccgaccgtaggaacgggccgtcttaccgacctatttccgaccaggtaactaacgttacttacccctaaagggcggtaccaaccggtttctgggtttaactccgttaacgacttaaaanaacgtaacgtacgtacgtacggtacggtacggtaccggaaccggaccggtaccggtacccgttaacgttaacgtttacgttacgttaggtacggtaacgggttacggggttacgggggttacggggttcggggtaccggttaccggttaccggttacgggtttaccgggtttacggttaccggttaccgggttaccggggtaccgggtaccggg

SEQ ID NO: 29290 - DNA, 627 bp, Homo sapiens
  misc_feature: GYAE6OF02GAN0S.39.71.G05.1.454.CMB.1.raw
  modified_base (279)..(279): a, c, t, g, unknown or other
  misc_feature (279)..(279): n is a, c, g, or t
  modified_base (403)..(403): a, c, t, g, unknown or other
  misc_feature (403)..(403): n is a, c, g, or t
  modified_base (413)..(413): a, c, t, g, unknown or other
  misc_feature (413)..(413): n is a, c, g, or t
  modified_base (453)..(453): a, c, t, g, unknown or other
  misc_feature (453)..(453): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttgggtacaggcccggggggggtccctggagactctcctgtgcagcctctggattccaccttcagcagctangccatgacctgggtccgccaggcctccgaggggaaggcgtgggaggtgggtcctgtctagttaggtgggaaggtggtgcttataacaaacgtacgcagccctcgtgaacgggcgctcaccatcnccagacactnttacccaagcgacactctgtacttcacgactaatcgaacncgtacctaggacgtacggccgaagggacccgaccggtacccttaagttagttaagttacgttggaccgtaaaggtcggggttagggggggacgggttcgggggaccgtttacccgttccggttgggttccggtttttacggaccgtttacgggtcgggggacccgtaacggggg

SEQ ID NO: 29291 - DNA, 699 bp, Homo sapiens
  misc_feature: GYAE6OF02JCYTQ.39.71.G05.1.454.CMB.1.raw
  modified_base (148)..(148): a, c, t, g, unknown or other
  misc_feature (148)..(148): n is a, c, g, or t
  modified_base (182)..(182): a, c, t, g, unknown or other
  misc_feature (182)..(182): n is a, c, g, or t
  modified_base (543)..(543): a, c, t, g, unknown or other
  misc_feature (543)..(543): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtctttttntgtggcttaatttaaaggtgtccagtgtgaggtncagtcgtggttggagtcgtgggggaggtcgttggtacgacgggtccggggggtccctggacgtcgtcgtcctggtcgcacgtcctgtggacttcctaccttcgacggcacgtctacgtcgcctagtcgaccgtcggtacccgccgaacggtcctaccggaaggggtacgcggtggacggttcggtcgttcggttacgttaagtacggttgggaacgttggtacgtacgtttaacgtaacgtaaaaccggtcgtaactacggtccgttaccggtaagggaaccggtccgcttaaccgacttaccgtacctcgaagtacctaacgtcttaccgaagtaccgcttaacgtcgttaagtcttacncggtaatacgtacgtaaactcgtacgtcggtactcggaccgacgtaccgtcgtaacctagttagttagtgtaccgagggttagtggggtaacgggcgtgggtaccgttacgtcccggttagttcggtttagccgtacgggttacggccgtaacggg

SEQ ID NO: 29292 - DNA, 709 bp, Homo sapiens
  misc_feature: GYAE6OF02FM3QJ.39.71.G05.1.454.CMB.1.raw
  modified_base (164)..(164): a, c, t, g, unknown or other
  misc_feature (164)..(164): n is a, c, g, or t
  modified_base (178)..(179): a, c, t, g, unknown or other
  misc_feature (178)..(179): n is a, c, g, or t
  modified_base (193)..(193): a, c, t, g, unknown or other
  misc_feature (193)..(193): n is a, c, g, or t
  modified_base (200)..(200): a, c, t, g, unknown or other
  misc_feature (200)..(200): n is a, c, g, or t
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
  modified_base (581)..(581): a, c, t, g, unknown or other
  misc_feature (581)..(581): n is a, c, g, or t
  modified_base (611)..(611): a, c, t, g, unknown or other
  misc_feature (611)..(611): n is a, c, g, or t
  modified_base (700)..(700): a, c, t, g, unknown or other
  misc_feature (700)..(700): n is a, c, g, or t
tcagtcgcactagtcacgaccggtgctcgatttagtgtcgtcgcaagagagaggagcccagccctgggatttttcaggtgttttcatttggtgatcaggactgaacagagagaactcaccatggagtttgggctgagcggcgtgttcaggcgctagtttaaggngcagtgtgagtgcnntgtgagtgtgggantggtacncggccggggtctganctcgtcngtacgcgatcctagtggtacttccaccttgaggtcacgtcgtaatcgcctaaggtctaccgggtcggtcctacggacgtacccggtcggaaggggacggtacgttagggcggttcgggttcttacggtacttagttaacgggtcggtaagttcggtacggttaccttaagaacgtaaaccgtcgaccgttaacgccccggttaggtacgacgggtccctaccttaaccgccgttactaccgacctaggtacaccctttaagtaccaacggggatccccgttaatccggttataaacctttgagaaccttaagggaactaacccgggatacccgtgtaggaccggacgtagtaacccggnggttaaaccctaatttagttcggtacccgngtaaccggtaggtaccggggggtggtacgggtccgtaaccgttcgtaaccgggttgttaccgtttaacgtcccgggtaggtaccccggnggtacccgg

SEQ ID NO: 29293 - DNA, 937 bp, Homo sapiens
  misc_feature: GYAE6OF02GK431.39.71.G05.1.454.CMB.1.raw
  modified_base (119)..(119): a, c, t, g, unknown or other
  misc_feature (119)..(119): n is a, c, g, or t
tcagtcgcactagtcacgaccggtgctcgatttagtgtcgtcgcaagagagaggagcccagccctggatttcaggtgttttctatttggtgatcaggactgaacagagagaactcacanggagttgggctgagctggtctttttcgtgtggtcttaagttttaaaaggtgtaccgagtgttgaggtgcagtctggttggagttcgtgggggaggtcgttggtacgagggtccggggggtcctggaagtctcgtcctgtcgcgcgtccttcgtcggtattccgacccttcgaacggcaagtcctagtgacccgtagtcggtaacccgttcggggtccccgtccggacggtcccgtaccggaacgggggaaaacgggtcccgttaaggggaccgggttcggggttccttacccgggtttacgttaacgttttagggggtaaccggtaaacggttggggttaagtttcccgttaaacgggttaaaaccctaaaaaccgggtttcccggacgtaaaccggttccccggttaacccgggttaaggggtaaccccggggtcccgttaccttttaaaccccgggaccctaacggttccccgtaaacggttaaccggtacggtaaccgtttaaacctttcccggggaaaaacgtccggttaacctaacccgtttacccgttgttaaagttccccggttaggtaaaacccgtaaacgttaccgaaaccggttaccgttacccgggaggtaaccggtcggtaaccccgggacgggtaaaccccgtacccgttaccgttaaccttagttaaccctttagggaacccgtagggttaaaccgtggggggtccgggggttaacgggttccggggtaacccgttaccggtttaaccggtccgggtttaaggttttaccggtaaccggtcgggttacccggggacggtaccgg

SEQ ID NO: 29294 - DNA, 442 bp, Homo sapiens
  misc_feature: GYAE6OF01ADN61.18.1.A01.1.454.CMB.1.raw
  modified_base (427)..(442): a, c, t, g, unknown or other
  misc_feature (427)..(442): n is a, c, g, or t
tcagtacgagtatgcacgaccggtgctcgatttagacgtctcatcaaggaagggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctgggggcacagcggccctgggctgcctggtcaaggactacttcccatactcgtactgagcgggctggcaaggcgcatagnnnnnnnnnnnnnnnn

SEQ ID NO: 29295 - DNA, 511 bp, Homo sapiens
  misc_feature: GYAE6OF01BZRR7.18.1.A01.1.454.CMB.1.raw
  modified_base (492)..(511): a, c, t, g, unknown or other
  misc_feature (492)..(511): n is a, c, g, or t
tcagtacgagtatgcacgaccggtgctcgatttagacgtctcatcaaggaagggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagagtaattttgacttggtttacttcctacttactttgactacgtgggccaggcacgtccgtcaccgtctcctcacgccctccaccgacggcccatccggtcccttcccccgtcggcccaccctcctccaagacgccaccgtcgtcggggcacgacggccggcccgtggcctcggtcccgtaggtaccgaacggtacccttaccttacccaacttaccgttaccgtacgtggaccggtcgggtcgcgggtaccgaacgggtcacgtagtacgnnnnnnnnnnnnnnnnnnnn

SEQ ID NO: 29296 - DNA, 615 bp, Homo sapiens
  misc_feature: GYAE6OF01AIL3J.18.1.A01.1.454.CMB.1.raw
  modified_base (150)..(150): a, c, t, g, unknown or other
  misc_feature (150)..(150): n is a, c, g, or t
  modified_base (163)..(163): a, c, t, g, unknown or other
  misc_feature (163)..(163): n is a, c, g, or t
  modified_base (180)..(180): a, c, t, g, unknown or other
  misc_feature (180)..(180): n is a, c, g, or t
  modified_base (555)..(555): a, c, t, g, unknown or other
  misc_feature (555)..(555): n is a, c, g, or t
  modified_base (560)..(560): a, c, t, g, unknown or other
  misc_feature (560)..(560): n is a, c, g, or t
  modified_base (563)..(563): a, c, t, g, unknown or other
  misc_feature (563)..(563): n is a, c, g, or t
  modified_base (566)..(568): a, c, t, g, unknown or other
  misc_feature (566)..(568): n is a, c, g, or t
  modified_base (575)..(576): a, c, t, g, unknown or other
  misc_feature (575)..(576): n is a, c, g, or t
  modified_base (579)..(581): a, c, t, g, unknown or other
  misc_feature (579)..(581): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (594)..(594): a, c, t, g, unknown or other
  misc_feature (594)..(594): n is a, c, g, or t
  modified_base (598)..(598): a, c, t, g, unknown or other
  misc_feature (598)..(598): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
  modified_base (606)..(607): a, c, t, g, unknown or other
  misc_feature (606)..(607): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
tcagtacgagtatgcacgaccggtgctcgatttagacgtctcatcaagggaaggaagggctggagtggatttcattacattagtagtgctggcaataccatcctctacgcagactctgtcgaagggccgttcagccgtctccaggaaacnccaataactttcngtttctgcaaatgaacngcctgagacgccgacggacctcggccactagttacgttaccgtggtaggcggagacggtaatttttcgactttggttacttccgttactactttacgactacgtcgggcgaggctacgtccggtcaccgtctctcacgcctccacgaacggccacgtccgtacctccccgtgcccaccctccgtaccgaacgacgcctacccgtccggtacggggaccaaccggcggtccccgggtacccgtggggtcccttacggtcccgtcgggtaacgtaacgggtacccttacccgtttccccgaatttcccggttcgtaaccgttcggaacggaccgggcgttacgggacgtaacgggccgtacgtacggtaggctgcgngctangtngcnnngacgacnnagnnnacngngngngtgngcgngagngnanncgngngng

SEQ ID NO: 29297 - DNA, 523 bp, Homo sapiens
  misc_feature: GYAE6OF01BLLH7.18.1.A01.1.454.CMB.1.raw
  modified_base (409)..(409): a, c, t, g, unknown or other
  misc_feature (409)..(409): n is a, c, g, or t
  modified_base (494)..(523): a, c, t, g, unknown or other
  misc_feature (494)..(523): n is a, c, g, or t
tcagtacgagtatgcacgaccggtgctcgatttagacgtctcatcaaggaaggggaaggggctggagtggatttcatacattagtagtgctggcaataccatccctctacgcagactctgtgaagggccggttcagcgtctccagggacaacgccaataactttctgtttctgcaaatgaacagcctgagagccgaggactcggccacatattactgtgcgagagtaattttgactggttattcctattctttgactacgtgggccagggcacgtccggtcaccgtctcctcacgcccctcccaccgaacgggccccgacttccggtcccttcccccgtggtaccccaccccctccctacccaagacgccgaccgtccggtcggggcacgacggcccggcccgtgggcncggtcctggtacaacggtacttaccctccaccgttacctacgtacgtgacggtccgggtacgtcggacgaacgggcacagtacgnnnnnnnnnnnnnnnnnnnnnnnnnnnnnn

SEQ ID NO: 29298 - DNA, 432 bp, Homo sapiens
  misc_feature: GYAE6OF02H7XTG.18.1.A01.1.454.CMB.1.raw
  modified_base (414)..(414): a, c, t, g, unknown or other
  misc_feature (414)..(414): n is a, c, g, or t
  modified_base (429)..(432): a, c, t, g, unknown or other
  misc_feature (429)..(432): n is a, c, g, or t
tcagtacgagtatgcacgaccggtgctcgatttagacgtctcatcaaggaagggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaacgggcccatcggtcttccccctggccaccctcctccaagacgcacctctggggcacagcggccctgggctgcctggtcaaggactacttccatacctcgtactgagcgggcnggcaaggcgcatagnnnn

SEQ ID NO: 29299 - DNA, 481 bp, Homo sapiens
  misc_feature: GYAE6OF02FF6JO.18.1.A01.1.454.CMB.1.raw
  modified_base (162)..(162): a, c, t, g, unknown or other
  misc_feature (162)..(162): n is a, c, g, or t
  modified_base (325)..(325): a, c, t, g, unknown or other
  misc_feature (325)..(325): n is a, c, g, or t
  modified_base (432)..(432): a, c, t, g, unknown or other
  misc_feature (432)..(432): n is a, c, g, or t
  modified_base (438)..(439): a, c, t, g, unknown or other
  misc_feature (438)..(439): n is a, c, g, or t
  modified_base (442)..(443): a, c, t, g, unknown or other
  misc_feature (442)..(443): n is a, c, g, or t
  modified_base (445)..(446): a, c, t, g, unknown or other
  misc_feature (445)..(446): n is a, c, g, or t
  modified_base (449)..(450): a, c, t, g, unknown or other
  misc_feature (449)..(450): n is a, c, g, or t
  modified_base (453)..(454): a, c, t, g, unknown or other
  misc_feature (453)..(454): n is a, c, g, or t
  modified_base (457)..(481): a, c, t, g, unknown or other
  misc_feature (457)..(481): n is a, c, g, or t
tcagtacgagtatgcacgaccggtgctcgatttagacgtctcatcgagggagaaggggctggagtggatttcatacattagtagtgctggcaataccatcctctacgcagactctgtgaagggccggttcagcgtctccagggacaacgccaataactttcngttctgcaatgaacagcctgagagccgaggactcggcacatattactgtgcgagaggaattttggactggttatcctactactttgactatggggccagggcactccggcaccgtctcctcagcctccaccaaggccatcggtcttcccctggccaccgtccncctaagacgcacctactcgggggcacgagccggcccgtgggcctggccgtggtcgaaacgggtacttaccttcccatttacctcgtacctgagcgggctggcaggcncagtannagnngnnatnnagnntannnnnnnnnnnnnnnnnnnnnnnnn

SEQ ID NO: 29300 - DNA, 551 bp, Homo sapiens
  misc_feature: GYAE6OF02JY0YF.18.1.A01.1.454.CMB.1.raw
  modified_base (188)..(188): a, c, t, g, unknown or other
  misc_feature (188)..(188): n is a, c, g, or t
  modified_base (515)..(516): a, c, t, g, unknown or other
  misc_feature (515)..(516): n is a, c, g, or t
  modified_base (518)..(519): a, c, t, g, unknown or other
  misc_feature (518)..(519): n is a, c, g, or t
  modified_base (521)..(524): a, c, t, g, unknown or other
  misc_feature (521)..(524): n is a, c, g, or t
  modified_base (526)..(551): a, c, t, g, unknown or other
  misc_feature (526)..(551): n is a, c, g, or t
tcagtacgagtatgcacgaccggtgctcgatttagacgtctcatcaaggaagggaaggggctggagtggatttcatacattagtagtgctggcaataccatcctctacgcagactctgtgaaggccggttcagcgtctccagggacaacgccaataactttctgtttctgacaaatgaacagcctganagcgaggactcggcctgtatttctgtgtagacgagatacgaaaatttccctttcggtaatgttcgttagattattcggttcggggaccgaaaggggactaagtcggtacctaccgttcctacctcacgccttccaccgaacgggccacgtcggtccttaccccgtggccgaccgtgccccctgacggacgacctacccgcgaagcgcaacacggccgccggtcggctcggtacctcgggtacaacggtaccttacctcctaataccgtaccgtacgttacggaggtaccgggtcgtacggaaccgtaagggtcgacccaggtaagcnncnncnnnngnnnnnnnnnnnnnnnnnnnnnnnnnn

SEQ ID NO: 29301 - DNA, 473 bp, Homo sapiens
  misc_feature: GYAE6OF02G1OEZ.18.1.A01.1.454.CMB.1.raw
  modified_base (418)..(418): a, c, t, g, unknown or other
  misc_feature (418)..(418): n is a, c, g, or t
  modified_base (455)..(456): a, c, t, g, unknown or other
  misc_feature (455)..(456): n is a, c, g, or t
  modified_base (458)..(473): a, c, t, g, unknown or other
  misc_feature (458)..(473): n is a, c, g, or t
tcagtacgagtatgcacgaccggtgctcgatttagacgtctcatcaaggaagggaaggggctggagtggatttcatacattagtagtgctggcaataccatcctctacgcagactctgtgaagggccggttcagcgtctccagggacaacgccaataactttctgtttctgcaatgaacagcctgagagccgaggactcggccacatattactgtgcgagaggaattttgactggttattcctatactttgactactggggccagggcactccggtctaccgtctcctcagcctccaccaagggccccaagtccggtcttcccccctgggccacccctccctccaacgagccaccctcgtgggggccacacgccggcctcgggctcgcctggtcaaggactaccgttcccaattaccngtaacctggaacgcgggctgggcaagggtcgcatagnngnnnnnnnnnnnnnnnn

SEQ ID NO: 29302 - DNA, 476 bp, Homo sapiens
  misc_feature: GYAE6OF02G71DJ.18.1.A01.1.454.CMB.1.raw
  modified_base (463)..(476): a, c, t, g, unknown or other
  misc_feature (463)..(476): n is a, c, g, or t
tcagtacgagtatgcacgaccggtgctcgatttagacgtctcatcaaggaagggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggtaattttgactggttattcctactacttgactactgggccaggcactccggtcaccgtctccctcacgccctcccaccaacgggccccactccggtccttccccccgtcggtccaccccctccctacccaaagacgccaccctccgtgggggccacacgccggcccgtcgggcctcggcctcggtcaaggacctacttcccatacctcgtactgacgcggcgtggcacggcgcatacgnnnnnnnnnnnnnn

SEQ ID NO: 29303 - DNA, 626 bp, Homo sapiens
  misc_feature: GYAE6OF02I7NMF.18.1.A01.1.454.CMB.1.raw
  modified_base (136)..(136): a, c, t, g, unknown or other
  misc_feature (136)..(136): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (292)..(292): a, c, t, g, unknown or other
  misc_feature (292)..(292): n is a, c, g, or t
  modified_base (312)..(312): a, c, t, g, unknown or other
  misc_feature (312)..(312): n is a, c, g, or t
  modified_base (505)..(505): a, c, t, g, unknown or other
  misc_feature (505)..(505): n is a, c, g, or t
  modified_base (512)..(512): a, c, t, g, unknown or other
  misc_feature (512)..(512): n is a, c, g, or t
tcagtacgagtatgcacgaccggtgctcgatttagacgtctcatctaagggaagggaaggggctggagtggatttcatacgattagtagtgctggcaataccatccctctacgcagtactctgtgagggccggttnagcgtctcgaggacaacggaccaatacttctgtttctgacaatcgaacagcctgagagccgaggacgtccggaccacattatactgtgcgagagtatttgatgttatccttattacttnactgnggaccgaggctacgtccggtcgacgttctccncgcgcctcccacaacggccngtcgtccttccccgtgccgtaccctctaccaagcgctacctcggtcgggaccactacggccggtacccgttgggcctacgccggtaccggtcgaaacggtaccttacccgttccaacgtttacctcgttaccgacgtaccggcgggttaccgacggtaccggaaccgggtcgacggttactacgggacacggngaaccgngtctactacgtacgtacgtacgacgtgtacgtagtactctagtacttacgtcgtcgtacgtacgactacgtcgtacgtacgacgtacgtaacgtagttaccgtacgtcgagtcg

SEQ ID NO: 29304 - DNA, 889 bp, Homo sapiens
  misc_feature: GYAE6OF01B3FO0.1.49.E05.1.454.CMB.1.raw
tcagacgagtgcgtcacgaccggtgctcgatttagagcgactagcaacggacacaaagggaacccaaaaaccgacaccccgtccttggggagaatcccctaagatcgacagctcctccaccatggacgggtacctggagcatccttttcttggtggcagcagcaacgaggtgtcccacctccacggttccacctcggtgcagtctggagcgtgagcgtcgacagaagcctggggcctacgagtgactggtcttcctgcctagtagactttacgtaggtttaactagttcctttttaccgaacctaacggtaataaacggtaagtttcggttagaacgtaccgacgggacccccgggaggtacgggggtccttaggtaaggttgggtaaggttcggggtaacgttacggggaacttccgtaacgggtacccccgtttaaacgggaaaaaccttaaaaaccgtaggtaaagttaaggtaacgggaacgggtaaggtaaacggtttaccgaaaggggtactaacggaacgttaccaacgttaccgaacgttaccgaacccgggaccggaaccgaaccgtaacgttaccccgaaacgggtaacgttaaccgaaacggtacccttaaacgtaaggtaacgggtaaaccgttttaggaacgggttaaccgtacccgttaacgaacggtaactttaccggtaacggtaacccggttaacccgaaccggggttaccccttaaaccggttttaacggttaacccggtacggaacccggttaacgggaaacggtaacgttaaacgtttaacgttacggtaccgtaacggtttcggggtaccccgttaggggacccttaccggtaaacccgtcggttaccgtttgggtccgggtaacccg

SEQ ID NO: 29305 - DNA, 154 bp, Homo sapiens
  misc_feature: GYAE6OF01C08T7.1.49.E05.1.454.CMB.1.raw
  modified_base (124)..(154): a, c, t, g, unknown or other
  misc_feature (124)..(154): n is a, c, g, or t
tcagacgagtgcgtcacgaccggtgctcgatttagagcgactagcgaacgaccaaggtggacaagatgcctggtcaaggactacttccacgcactcgtctgagcgggctggcaaggcgcatagnnnnnnnnnnnnnnnnnnnnnnnnnnnnnnn

SEQ ID NO: 29306 - DNA, 507 bp, Homo sapiens
  misc_feature: GYAE6OF01A206N.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccagggcagagtcatcatcaccgcggacacatccacgagtacagcctacatggaactgagagcctcagatctgacgacacggccacttatactgcgcgagagattagtgcacgtggtcctggctgtaaccagtcttgtgggtaccg

SEQ ID NO: 29307 - DNA, 511 bp, Homo sapiens
  misc_feature: GYAE6OF01CCKAT.1.49.E05.1.454.CMB.1.raw
  modified_base (341)..(341): a, c, t, g, unknown or other
  misc_feature (341)..(341): n is a, c, g, or t
  modified_base (473)..(473): a, c, t, g, unknown or other
  misc_feature (473)..(473): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccactacggtatgaattggttgagacaggcccccggagaggggcttgagtggatgggatggatcagcccttaggaactaaaacngagtatgagagaagttcagggcagagtcagtcatcacgcggacacatccagagtacagcctaacatggaactggagagcctacagatctgaacgcaacgggccacttattactgcgcgtagagtatattganactggtcctgggctacgtaaccagcttggtgggtaccg

SEQ ID NO: 29308 - DNA, 519 bp, Homo sapiens
  misc_feature: GYAE6OF01DLW6Q.1.49.E05.1.454.CMB.1.raw
  modified_base (307)..(307): a, c, t, g, unknown or other
  misc_feature (307)..(307): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgngtggatgggatggatcagcccttacggaactaaaacagagtatggagagaagttccagggcagagtcatcatcaccgcggacacatccacgagtacagacctacatggaactggaggagccctcagatcagacgacacggcacttattactgcgcgagagtattagtgacacgtggtccctggcttcgtaacccacgtcttggtgggtaccg

SEQ ID NO: 29309 - DNA, 539 bp, Homo sapiens
  misc_feature: GYAE6OF01A52WU.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgaaggtttcctgcaaggcttcaggatacaccttcactaggtatgctatacattggtgcgccaggcccccggacaaaggcttgagtggatgggatggatcaacgcgtggcaatggtaacacaaaaattcacagaagtccagggcagagtcacttacaggacacatcgacgagattacttatagtggagctagagcgagcgtgagtataccgaagacgacggtctagttattattttgcgtcgtacctcgtagtgggagtacgtatttagtacgtctacgtaatttgacttcgtaggggcctagggtaaccctacggg

SEQ ID NO: 29310 - DNA, 534 bp, Homo sapiens
  misc_feature: GYAE6OF01D278R.1.49.E05.1.454.CMB.1.raw
tcagacgagtgcgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagacaggccccccggaggaggggcttggagtggatgggatgggatcagcccgttacggaaactaaaacagagtatggagagagttccagggcagagtcatcatcacgcggaacacactccacgagtacagacctacataggaactgaggacgcctcagatctagacgacacggcctacttatactgcgacgagacgatttagtgacacgttcggtcctggacttacgtaaacccacgtcttggtgggtaccgg

SEQ ID NO: 29311 - DNA, 610 bp, Homo sapiens
  misc_feature: GYAE6OF01CT1HS.1.49.E05.1.454.CMB.1.raw
  modified_base (344)..(344): a, c, t, g, unknown or other
  misc_feature (344)..(344): n is a, c, g, or t
  modified_base (430)..(430): a, c, t, g, unknown or other
  misc_feature (430)..(430): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccactacggtatgaattggttgagacaggccccggagaggggcttggagtggatgggatggatcgagcccttaggaactaaaacgngagtatggagagaagttccagggcagagtcatcatcgaccgcggacacatccacgagtaccagcctaacatggaactggaacgganccctacgagactcgtacgaaccgacgaccgggacctaacgtttaacgttaaccgtcggaccggtacgaacggtacgtaacgtttaacgttcggaccgtaaccgttggggttaccccgttaggggtaccctttaccgggtaaaacccctacgggtaccgttttgggtcggggtaaccccgg

SEQ ID NO: 29312 - DNA, 549 bp, Homo sapiens
  misc_feature: GYAE6OF01DG4HW.1.49.E05.1.454.CMB.1.raw
tcagacgagtgcgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgaattggttgagacacggccccggagagggcttgagtggagtgggatggatcgagcccgttaacggaaactaaaacagaagtagtggaagagaagttaccgagggcagagtacatcatcgaccgcgacacatccgaacgagtaacacgacctaacagtacggaactagacggagcctacagactacgtgaccgacaccggtacctacttatacctagacgacgagagtattagtcgactacgtgtccgtggactacgtaaccacgtcgttggcggtacg

SEQ ID NO: 29313 - DNA, 504 bp, Homo sapiens
  misc_feature: GYAE6OF01BSUE7.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccagggcagagtcatcatcacgcggacacatccacgagtacagcctacatggaactgaggagcctcagatctgacgacacggccacttatactgcgcgagagattatgcactggtcctggctgtaaccagcttggtgggtccg

SEQ ID NO: 29314 - DNA, 514 bp, Homo sapiens
  misc_feature: GYAE6OF01D2UW9.1.49.E05.1.454.CMB.1.raw
  modified_base (460)..(460): a, c, t, g, unknown or other
  misc_feature (460)..(460): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttgagtggatgggatggatcagcccttacggaactaaacagagtatggagagaagttccagggcagagtcatcatcaccgcggacacatccacgagtacagcctacatggaactgaggagcctacagatctgacgacgaccggccacttattacgngcgcgagagattatgcacgtggtcctggctgtaacccagtcttggtgggtaccg

SEQ ID NO: 29315 - DNA, 670 bp, Homo sapiens
  misc_feature: GYAE6OF01CXWPP.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctggttacattctttccacgtacggtatgaattggtgagacgacggccccggaggacgggtcttggagtggatgggatggatcgacgcccgttaacggaaactaaaaacgagtaagtagtaggaaggtaagaacggttccgaaggggacaaggagttacagtcaagtaccgaaccggacggaacaccgaactacccgaacggaagtaaccacgtaccctaagtacgtagggaaacgtggaacggaacgtcccgttaacgaaggtactacgtcggaaccgtaaccgaacccggtaccctaaacgtttactttaacggtcgaccggtacggaaggtagttaaacgttagttcgaccgttacgttcgggtacccgttagggtaccttaacggtaaaccccgcggttaccgtttggggtccggggtaacccg

SEQ ID NO: 29316 - DNA, 647 bp, Homo sapiens
  misc_feature: GYAE6OF01C7N3T.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtgggcctcagtgatggtctcctgcagtgcttcgtggttactacttcgtttccacctacggtatgtaattggttgagacgacggcccccggaggacggggtcttggaggtggagtgggagtggatcgacgtacccgttacggaaactaaacgagagtagtggagagacgttcgagggcagagtcatcataccgaccgacggacacactaccgacgacgtacgacgtacctaacgacgtacggaacgtaggacggacgtcccgtacgaagtactacgtacggaaccgaaccgaccggtaccctaacgtttacttaccgtaggaccggaggtaaacggagttaattacgttacggaccgttaaccggttcgggttacccgttacgggtaccgttacggttaaacccgtacggttccggtttcggggtcgggtacccggg

SEQ ID NO: 29317 - DNA, 513 bp, Homo sapiens
  misc_feature: GYAE6OF01EPBQW.1.49.E05.1.454.CMB.1.raw
  modified_base (429)..(429): a, c, t, g, unknown or other
  misc_feature (429)..(429): n is a, c, g, or t
  modified_base (458)..(458): a, c, t, g, unknown or other
  misc_feature (458)..(458): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacaggcccccggagaggggcttgagtggagtgggatggatcagcccttacggaactaaaacagagtatggagagaagttcaggcagagtcatcatcacgcggacacatccacgagtacagcctaacataggaactggaggacgcctnagatctgacgacacggaccacttattacngacgcgagagattagtgcacgtggtcctggctacgtaaccacgtcgttgtgggcc

SEQ ID NO: 29318 - DNA, 566 bp, Homo sapiens
  misc_feature: GYAE6OF01DKDDA.1.49.E05.1.454.CMB.1.raw
  modified_base (558)..(558): a, c, t, g, unknown or other
  misc_feature (558)..(558): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctggttacattcttttccacctacggtatgtaattggttgagacacggcccccggagaggggcttgagtggatgggatggatcgagccttacggaactaaaacagagtatggagagaagttccagggcagagtcagtcatcacgcggacacatccacgagtacagcctacagtaggaactgaggagcctacaggtactcgtagaaccgacaaccgggtccctaacgtttaactaccgtagaccggacgaagaacgtatttaagttcggactaacgtcggttaccgtgggtccttacggttaaacccagtcgtttggngggtaccg

SEQ ID NO: 29319 - DNA, 607 bp, Homo sapiens
  misc_feature: GYAE6OF01DN431.1.49.E05.1.454.CMB.1.raw
  modified_base (408)..(408): a, c, t, g, unknown or other
  misc_feature (408)..(408): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatggatggatcagccttacggaactaaaacagagtatggagagaagttcagggcagagtcatcatcacgcgacacatccaacgagtaacagacctaanagtaggaactgaagggagccctacgaagacttcgtacggaccgaaccgacgggtacccaactttaacttaaccgtaggacccggacggtaacggaagtaaacgtttagtttacggacctaacggttcgggttacccttaggggtacccttacgggttaaaccccgtaccggtccgttttgggttcgggggtaaccccgg

SEQ ID NO: 29320 - DNA, 589 bp, Homo sapiens
  misc_feature: GYAE6OF01C9KM4.1.49.E05.1.454.CMB.1.raw
  modified_base (219)..(219): a, c, t, g, unknown or other
  misc_feature (219)..(219): n is a, c, g, or t
  modified_base (375)..(375): a, c, t, g, unknown or other
  misc_feature (375)..(375): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctnagtgatggtctcctgcagtgcttctggttacatcttttccactacggtatgaattggttgagacgacggcccccggaggagggcttgagtggatgggatggatcacgccttaacggaactaaaacagagtatggagagaagttccagggcagagtnatcatcacgcgacacataccgagacgtacagacctacatacggaactggaggacgcctacgaagactcgtagaaccgaccgaccgggaccctaacgttaactttaaccgtcggaccgacgggtaacgaacgtaagtttaagttacggacctaacgttcgggtacccgttgggccttacggttaaacccgacggttctttgggcggggtacccgg

SEQ ID NO: 29321 - DNA, 513 bp, Homo sapiens
  misc_feature: GYAE6OF01CZZ53.1.49.E05.1.454.CMB.1.raw
  modified_base (390)..(390): a, c, t, g, unknown or other
  misc_feature (390)..(390): n is a, c, g, or t
  modified_base (423)..(423): a, c, t, g, unknown or other
  misc_feature (423)..(423): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccagggcagagtcagtcatcacgcggacanatccagagtacagcctaacatggaactgaggancctcagatctgacgcacggccacttatactgcgngagagtnttaagttgcaactgggtcctggactcgtaacccagtcttggtggtcccg

SEQ ID NO: 29322 - DNA, 520 bp, Homo sapiens
  misc_feature: GYAE6OF01EL0AK.1.49.E05.1.454.CMB.1.raw
  modified_base (425)..(425): a, c, t, g, unknown or other
  misc_feature (425)..(425): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccactacggtatgaattggttgagacaggcccccggagaggggcttgagtggatgggatggatcagccttacggaactaaaacagagtatggagagaagttcagggcagagtcatcatcaccgcggacacactccacgagtacagcctacatggaactgagagcctnagatctgacgacacggacctacttatactgcgcgagtagtattagttgctacgtcggttcctggtactacgtaaccagtacttgggtgggtaccg

SEQ ID NO: 29323 - DNA, 515 bp, Homo sapiens
  misc_feature: GYAE6OF01D7EXJ.1.49.E05.1.454.CMB.1.raw
  modified_base (507)..(507): a, c, t, g, unknown or other
  misc_feature (507)..(507): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccgaggcagagtcatcatcaccgcggacacatccacgagtacagcctacatggaactgagagcctcagatctgaacgacacggccaacttattactgcgacgagagattagtgacactggtcctggacttacgtaaccagtcgttgngggtaccg

SEQ ID NO: 29324 - DNA, 578 bp, Homo sapiens
  misc_feature: GYAE6OF01BVINJ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccaccttacggtatgtaattggttgagacgacgggccccccggaggaggggcttggagtggagtgggatggatcagcccttaacggaactaaaacagagtatggagagaagttcgaggcagagtcatcatcaccgcggacacactccacgagtacagacctacagtacggaactggaaggacgcctacgacgatcgtagaccgaaccgaccggtaccctaacgtttaacttaccgtacggccgacggacgtagtatttagtcgactacgttcgggtcctggtaccttacggtaacccacgtcgtttgggtcgggtaccg

SEQ ID NO: 29325 - DNA, 528 bp, Homo sapiens
  misc_feature: GYAE6OF01D36TG.1.49.E05.1.454.CMB.1.raw
  modified_base (429)..(429): a, c, t, g, unknown or other
  misc_feature (429)..(429): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacaggcccccggagaggggcttggagtgggatgggatgggatcgagtcccttacggaaactaaaacagagtatggagagaagttccagggcagagtcatcatcaccgcggacacactccacgagtacagcctacatggaactgaggncctcagactctgacgacacggccactttatactgcgacgagagtattagtcgacacgttggtacctgggcctaggtaacccagtctttggcgggtaccg

SEQ ID NO: 29326 - DNA, 515 bp, Homo sapiens
  misc_feature: GYAE6OF01EKXSJ.1.49.E05.1.454.CMB.1.raw
  modified_base (425)..(425): a, c, t, g, unknown or other
  misc_feature (425)..(425): n is a, c, g, or t
  modified_base (455)..(455): a, c, t, g, unknown or other
  misc_feature (455)..(455): n is a, c, g, or t
  modified_base (508)..(508): a, c, t, g, unknown or other
  misc_feature (508)..(508): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacaggccccccggagaggggcttggagtggatgggatggatcagccttacggaactaaacagagtatggagagaagtccaggcagagtcatcatcaccgcggacacatccacgagtacagcctacatcgaactgagagcctnacgatctgacgacgaccgcctacttatacngcgacagagtattagtcgctacgtcggtacctggctacgaaccacgtcttggnggtaccg

SEQ ID NO: 29327 - DNA, 534 bp, Homo sapiens
  misc_feature: GYAE6OF01EQ3IW.1.49.E05.1.454.CMB.1.raw
  modified_base (418)..(418): a, c, t, g, unknown or other
  misc_feature (418)..(418): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
  modified_base (466)..(466): a, c, t, g, unknown or other
  misc_feature (466)..(466): n is a, c, g, or t
  modified_base (486)..(486): a, c, t, g, unknown or other
  misc_feature (486)..(486): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggccccccggagagggggcttggaggtggagtgggatgggatcgagcccttacggaactaaaacagagtagtggagagaagttccagggcagagtacatcatcacgcggacacatccacgagtacagcctanatggaactgagngcctcgagatcngacgacgaccggcctacttatacngcgcgagagtattagttcgntacgtggtaccgtggccttacggtaacccaggtcgttggtgggtaccg

SEQ ID NO: 29328 - DNA, 506 bp, Homo sapiens
  misc_feature: GYAE6OF01CHLWL.1.49.E05.1.454.CMB.1.raw
  modified_base (423)..(423): a, c, t, g, unknown or other
  misc_feature (423)..(423): n is a, c, g, or t
  modified_base (455)..(455): a, c, t, g, unknown or other
  misc_feature (455)..(455): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccagggcagagtcatcatcacgcgacacatccagagtacagctacatggaactgagagcctnagatctgacgacacggccacttatactgacgngagagattagtgcagtcggtcctggctacgtaaccacgtcttggtgggtcg

SEQ ID NO: 29329 - DNA, 546 bp, Homo sapiens
  misc_feature: GYAE6OF01B1ST4.1.49.E05.1.454.CMB.1.raw
  modified_base (409)..(409): a, c, t, g, unknown or other
  misc_feature (409)..(409): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagtacaggcccccggagaggggcttggagtggatgggatggatcagcccttacggaactaaaacagagtatggagagaagtcagggcagagtcatcatcacgcggacacactccagacgtacagcctanatggaactggagacgcctacagatcctgacgaccgaccggtaccaacgtttacttacgtcgcgcggaagtacgattacgttgactacttcgggtcctggtaccgttacgtaacccgtacgtcttgggtcgggtaccg

SEQ ID NO: 29330 - DNA, 528 bp, Homo sapiens
  misc_feature: GYAE6OF01BZRZA.1.49.E05.1.454.CMB.1.raw
  modified_base (429)..(429): a, c, t, g, unknown or other
  misc_feature (429)..(429): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctggcagtgcttctggttacatcttttccacctacggtatgaattggttgagacaggcccccggagaggggcttgagtggatgggatggatcagccttacggactaaaacagagtatggagagagtcaggcagagcagtcatcacgcggacacactccacgagtacagacctaacagtaggaactggaggacgcctanagatctagacgacacggtccacttagtactgcgacgagacgtattaacgtgacacgtggtcctggaccgttcgtaacccaggtccttggtcgggtaccg

SEQ ID NO: 29331 - DNA, 517 bp, Homo sapiens
  misc_feature: GYAE6OF01ENKRH.1.49.E05.1.454.CMB.1.raw
  modified_base (388)..(388): a, c, t, g, unknown or other
  misc_feature (388)..(388): n is a, c, g, or t
  modified_base (405)..(405): a, c, t, g, unknown or other
  misc_feature (405)..(405): n is a, c, g, or t
  modified_base (419)..(419): a, c, t, g, unknown or other
  misc_feature (419)..(419): n is a, c, g, or t
  modified_base (508)..(508): a, c, t, g, unknown or other
  misc_feature (508)..(508): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacaggccccccggagaggggcttgaggtggagtgggatggatcagccttacggaactaaacagagtatggagagagtcagggcagagtcatcatcaccgcgacacanccacgagtacagcctanatggaactgaggancctcagatcgtgacgaccgacggtccacttatactgcgcgagagattatgactacgtggtcctgggacttcggtaaccacggtcttggngggtaccgg

SEQ ID NO: 29332 - DNA, 649 bp, Homo sapiens
  misc_feature: GYAE6OF01AM4PH.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggccctcgagtgagtcggtctccgtgcagtgtcttcgtggttacattctttacccacgtacggtatgtaagttggttgagacgacgggcccccggaggaggggtcttggaggtggtagtgggatggatcgacgtacccgttaacggaactaaacgagtagtagtggaagagtaacgttcgagggtcaggtacgtacatcaacgtccgacccggacggtaacacgacgttacccgaacggacgttaacgacgtaccctaacgtaacgtacggtaacgtagggaacggacgtaccgtacaggtacttcgaacgaccgacgaccggtaccgtactttaacgtacgtacggcgacgtaagacgtatttacgtacgtcgtaccggtcgttacccggtgttaccgttacgtaaacccgtacgtcgttcgggtcgggtacccg

SEQ ID NO: 29333 - DNA, 636 bp, Homo sapiens
  misc_feature: GYAE6OF01ACSJL.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacaggcccccggagaggggcttgagtggatgggatgggatcagcccgttacggaactaaaacagagtatggagagaagttccagggtcagagtcatcactcgaccgacggacacactaccgaacggtacgtaacgacgtacctacgagtacgggtaactagggacggacgcccgtacgtaacgacttacgtacgaaccgaaccggaccggtacccttaacgtttaacgttaccgtacggtaccggacggacgtaacggtaactttagtaccggtacttaccggttcgggttcccgttacgggttaccgttaacggttaaccccggacggtttcccgttggggtcgggtacccggg

SEQ ID NO: 29334 - DNA, 510 bp, Homo sapiens
  misc_feature: GYAE6OF01A6K9Q.1.49.E05.1.454.CMB.1.raw
  modified_base (428)..(428): a, c, t, g, unknown or other
  misc_feature (428)..(428): n is a, c, g, or t
  modified_base (456)..(456): a, c, t, g, unknown or other
  misc_feature (456)..(456): n is a, c, g, or t
  modified_base (497)..(497): a, c, t, g, unknown or other
  misc_feature (497)..(497): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttgagtggatgggatggatcagccctcacggaactaaaacagagtatggagagaagttccagggcagagtcatcatcaccgcggacacatccacgagtacagcctacatggaactgaggagcctnagatctgacgacacggccacttattacngcgcgagagattattgctacgtcggtcctggctcgtaaccncgtcgttgtcggg

SEQ ID NO: 29335 - DNA, 621 bp, Homo sapiens
  misc_feature: GYAE6OF01CK0JH.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtgggcctcagtgatggtctcctgcagtgcttctggttacattctttccaccgtacggtatagtaattggttgagacgacgggcccccggaggacgggggcttggaggtggagtaggggtagtggtatcgaacggtacccgttaacggaaactaaaacgagtaaggtacgtagggaacgtaaggaacgttaccgaagggacaggacgtacagtacacgtcgaccgcggaacacgactaccgaggaacacgagtacctaacgtagtacgaacgtggacggactaccgtacgaagactcgacgacgaccgaccggtacctacttagttacgcggacgacggagtagtattagtcgtactacgttcggtccgtaggtccgttacgtaacccgagttcgttgggtcgggtaccgg

SEQ ID NO: 29336 - DNA, 580 bp, Homo sapiens
  misc_feature: GYAE6OF01BB0D4.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccaccttacggtatgaattggttgagacacggcccccggaggaggggcttggaggtggagtgggatggatcagcccttaggaactaaaacagagtatggagagaagttcgagggcagagtcatcatcaccgcggacacatccacgagtacacgtcctaacagtacggaactaggacggacgacctcgagtactcgtacgaccgacgaccggtacctacgtttattactcggacgacggaagtacgtatttacgtcgtacctacggttcggtcccgtgggtaccttacggtaaccctaccggttcgttgggtcgggtacccgg

SEQ ID NO: 29337 - DNA, 606 bp, Homo sapiens
  misc_feature: GYAE6OF01AUK5G.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccactacggtatgtaattggttgagacgtacgggcccccggaggacgggggcttggaggtgggagtgggagtggagtcgacgtcccgttaacggaaactaaaacgagaagtagtaggagagaacgttcgagggacagagtcatcatcaccgcgacacatccagacgtacacgtcctaacacgtaggaacgtggaacggacgaccgtacgaagtactcgtacggaccgacgaccggtacctaacgttacttacgtacgtccgacggtaggagtacgttacgttcgtacgtacgttcggtacccgttaggtaccgttacgtaacccgtacgtcgttggtcgggtaccgg

SEQ ID NO: 29338 - DNA, 531 bp, Homo sapiens
  misc_feature: GYAE6OF01DBNSQ.1.49.E05.1.454.CMB.1.raw
  modified_base (424)..(424): a, c, t, g, unknown or other
  misc_feature (424)..(424): n is a, c, g, or t
  modified_base (444)..(444): a, c, t, g, unknown or other
  misc_feature (444)..(444): n is a, c, g, or t
  modified_base (458)..(458): a, c, t, g, unknown or other
  misc_feature (458)..(458): n is a, c, g, or t
  modified_base (474)..(474): a, c, t, g, unknown or other
  misc_feature (474)..(474): n is a, c, g, or t
  modified_base (517)..(517): a, c, t, g, unknown or other
  misc_feature (517)..(517): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagacaggcccccggagagggggcttggaggtggagtgggatggatcgagcccttaacggaaactaaaacgagagtatggagaagaagttcgagggcagagtcatcatcgaccgcggacgcatccacgacgtacacgcctanagtggaactggaggagcctnagatctagacgacncggaccacttattacngcgcgagtagattagtgctacgtcggtcctggctacgtaaccngtcttggtgggccg

SEQ ID NO: 29339 - DNA, 516 bp, Homo sapiens
  misc_feature: GYAE6OF01BW6HU.1.49.E05.1.454.CMB.1.raw
  modified_base (425)..(425): a, c, t, g, unknown or other
  misc_feature (425)..(425): n is a, c, g, or t
  modified_base (476)..(476): a, c, t, g, unknown or other
  misc_feature (476)..(476): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccgagggcagagtcatcatcaccgcggacacatccacgagtacagcctacataggaactgaggngcctcagatctgacgacacggcctattatactgcgcgagagtattagtcgntactggtacctggctcgtaacccacgtcttggtggtaccg

SEQ ID NO: 29340 - DNA, 519 bp, Homo sapiens
  misc_feature: GYAE6OF01E46G3.1.49.E05.1.454.CMB.1.raw
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
  modified_base (478)..(478): a, c, t, g, unknown or other
  misc_feature (478)..(478): n is a, c, g, or t
  modified_base (511)..(511): a, c, t, g, unknown or other
  misc_feature (511)..(511): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactccccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagccttacggaactaaacagagtatggagagaagttccagggcagagtcatcatcaccgcggacacatccacgagtacagcctanatggaactgaggacncctcagatcgtgaacgacacgggcctacttattactggcgcgagagattagtcgntacgtggtcctggccttgtaaccacgtcttggngggtaccg

SEQ ID NO: 29341 - DNA, 540 bp, Homo sapiens
  misc_feature: GYAE6OF01DU8DQ.1.49.E05.1.454.CMB.1.raw
  modified_base (416)..(416): a, c, t, g, unknown or other
  misc_feature (416)..(416): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggagtggatgggatggatcgagcccgttacggaaactaaacagagtatggagagaagttcgagggacagagtcatcatcaccgcgaacacataccacgagtacagcctaanatcggaatgaggacncctanagatcagacgacaccgggccacttacttactgacgcgagagtattattgatacgttcggtaccgtggcctacggtaaacccacgttcgttcgggtgggtacccg

SEQ ID NO: 29342 - DNA, 683 bp, Homo sapiens
  misc_feature: GYAE6OF01B2XCP.1.49.E05.1.454.CMB.1.raw
  modified_base (219)..(219): a, c, t, g, unknown or other
  misc_feature (219)..(219): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctnagtgatggtctcctgcagtgcttctggttactattctttccacctacggtatgtaagttggttagagtacgacggcccccggaggacggggtcgttggaggtgggacgtggggagtgggtactcgaacggtacccgttaaacggaaaccgtaaaacgaggtaacggtagtaggaaggaaggtaaacggttaccgtaacggggacgaaggtaacggtacgtacgtacgaacgttacccgaacccggaccggaaccgaaccgacctaccgaacgtaacgtaacgaccgacctaacgtaacgtacgggtaacgtaggacggtacgtaccgtacaaggtactcgtacgaccgaacgaccggtacctacgttacgttacgtcggacgacgaagtagtaacttagttcgtacctacggtcggtccgtacggtacgtacggtaaccctacggtcgttgggtcgggtaccgg

SEQ ID NO: 29343 - DNA, 646 bp, Homo sapiens
  misc_feature: GYAE6OF01CZIFN.1.49.E05.1.454.CMB.1.raw
tcagacgagtgcgtcacgaccggtgctcgatttagagcgactagcaacacgacaaaggggacccaaaaaccacacccctccttgggagaatcccctagatcacagtctcctcaccatggacgggacctggagcatccttttcttggtggcagcagcaacaggtgcccactcccaggttcacctggtgcagtctggagctgagctgcagaagcctggggcctcagtgatggtctcctgctaggtgcttctggttacattctttaccacctacggtatgtaattggttgagacgacggcccccggaggacggggcgttaggacggtgggagtgggagtggatcgagtacccttaacggaaactaaaacgagtaacgtagtaggaagaagaacgttacgaagggcagacgtcatcatcgaccgcgaacacactaccgaacgaacgtacacgtacctaacgacgtacggaactggacggacgtacctacgaacgtactacgtaacgaaccgaacgaaccgggtacctaacgttacttaacgtcggaccggtacgaagtacgtaatttacgtcggtacgtaccggttcgggttacccgttagggtaccttaccggtaaacccgtacggttcgttgggttcggggtacccgg

SEQ ID NO: 29344 - DNA, 642 bp, Homo sapiens
  misc_feature: GYAE6OF01EQWTB.1.49.E05.1.454.CMB.1.raw
tcagacgagtgcgtcacgaccggtgctcgattttagagcgactagcaacgtacgaccaaaaaggggacccaaaaaacccaccaccccgtccttgggtacgaatcccctagatcaccagcctcctcgaccagtcggacgggacctggagcctatccttttctggtggcagcagcaacacggtgccccaactccccaggttccaccgtggtgcagtctcggagctgagctcgcgagaaggcctaggggcctcagtgagtcgtctcctgctagtgtcttctggttacagttctttccaccgtacgtatcgtagttggtgagtacgacggcccccggaggacggggcgttggacggtggagtgggacgtaggatcgagaccgttacggaactaaaacgagtagtaagtggaagtagtaacgttccgaggcagagtcatcagtcaccgcgacacgatccacgacgtacagacctaagagacggaactcgacggacgcctacagacgtcgtcgacgtacgaccggtacctaacgtttagttaccgtagaccggtcgtaagtagtaactttagttcggacgtacggttggtacccgtaggtaccccgttaaggtaacccctaggtccgtttccggtcgggtaaccccgg

SEQ ID NO: 29345 - DNA, 591 bp, Homo sapiens
  misc_feature: GYAE6OF01B4XAV.1.49.E05.1.454.CMB.1.raw
  modified_base (458)..(458): a, c, t, g, unknown or other
  misc_feature (458)..(458): n is a, c, g, or t
  modified_base (464)..(464): a, c, t, g, unknown or other
  misc_feature (464)..(464): n is a, c, g, or t
  modified_base (517)..(517): a, c, t, g, unknown or other
  misc_feature (517)..(517): n is a, c, g, or t
tcagacgagtgcgtcacgaccggtgctcgatttagagcgactagcaacacacaaaggggacccaaaaccacaccctcttgggagaatccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctggttacattcttttccactacggtatgaatttggttgagacgacggcccccggaggacggggtcttggagtggagtgggatggatcgagtacccgttaacggaactaaaacgagaacgtagtaggaaggagaagttaccgagggacaggagtacgatcatcgaccgacggacacataccgacgagtacgagtaccactagtaggaactaggacggacnccgtanagatccgtaggaacgaccgaaccgggtcctaacgttaacgttacacggaccgnggtaagaacgtaagttagttcgatacgtcggttccgtggtcctacgtaacctacgtcgttcggtcgggtaccgg

SEQ ID NO: 29346 - DNA, 513 bp, Homo sapiens
  misc_feature: GYAE6OF01CL6AW.1.49.E05.1.454.CMB.1.raw
  modified_base (498)..(498): a, c, t, g, unknown or other
  misc_feature (498)..(498): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccaggcagagtcatcatcacgcggacacatccacgagtacagcctaacatggaactggagagcctcagatctagacgacacggccacttacttactgcgcgagagattatgactacgtcggtcctggctcgtaaccngcttggtgggtaccg

SEQ ID NO: 29347 - DNA, 524 bp, Homo sapiens
  misc_feature: GYAE6OF01BSBRO.1.49.E05.1.454.CMB.1.raw
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacaggcccccggagaggggcttgagtggatgggatggatcgagcccttaggaactaaaacgagagtatggagagaagttccagggcagagtcatcatcacgcggacacatccagagtacagcctacatggaactggagancctcanatctgacgacaccggcctacttatactgcgcgagagtattagttcgactacgtcggtcctggccttacggtaacccacgtcgttgggtcgggtacg

SEQ ID NO: 29348 - DNA, 623 bp, Homo sapiens
  misc_feature: GYAE6OF01BXANI.1.49.E05.1.454.CMB.1.raw
  modified_base (530)..(530): a, c, t, g, unknown or other
  misc_feature (530)..(530): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagccgtgggcctcagtgatggtctcctgcagtgcttctggttacattctttccacgtacggtatgtaattggttgagacgacggtcccccgggaggaggggtcttggaggtggagtgggagtggatcgacgtacccgttaacggaactaaaacgaggtagtacgtagggagaagtaacgttcgagggcaggagtctagtacagtcgaccgacgacacatccgaacgtagtacacgacctaacgagtacgggaactagggaacggacgacctacgaagtactcgtacgaaccggaccgtaccgaccttaacgtttaacttaccgnggtaccgacggtaagacgttattacgtcgaccgtacggttcggttacccgtggtaccgtacgtaacccacggtcgtttcgggcgggtacccgg

SEQ ID NO: 29349 - DNA, 549 bp, Homo sapiens
  misc_feature: GYAE6OF01DOD2G.1.49.E05.1.454.CMB.1.raw
  modified_base (435)..(435): a, c, t, g, unknown or other
  misc_feature (435)..(435): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtgtagtgggatggatcacgcccttaacggaactaaaacgagaagtataggagaagaacgttccgagggcagagtcatcatcaccgcggacacataccacgagtacagcctaacatggaactgaggancctgagatctagacgacacggcctacttattactgcgacgagagtattacgttgacctacgttcggtcccgtgggtccttacggtaaacccacggtcgttgggtgggtacccgg

SEQ ID NO: 29350 - DNA, 739 bp, Homo sapiens
  misc_feature: GYAE6OF01CZ96L.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtgcccactccccaggttccacctggtgcagtctggagctgagctgcagacgccgtggggcctcgagtgatggtctcctgcagtgcttcgtggttactattccttttaccacgttacggtatagtaagttggtagagtaccgacgggcccccggaggtacggggtcttagggaggtggagtggggagtggtatcgtacgtacccgttaacggaaactaaaacgaggtaacggtagtagggaaggtaaggaacggtttaccggaagggaccaagggtacgtacgtaagtaccgtaacgttacccggacccgaccgggaacctaaccgtaaccgtacccggaaccgtaaacggtaacccgacgtaaccccgtaaacgtaaggtaccgggtaaacgttagggaacggaccgtacccgtaacgtaacgtacgttcgtaacggaaccgaacccggtacccgggtaacctaaaccgtttaacgtttacgacggaccggtagaacggtagttaacttgtacggtcctacggttcggttaccgtggaccgttacggtaacccgtgttaccgttgggtccggtaccgg

SEQ ID NO: 29351 - DNA, 651 bp, Homo sapiens
  misc_feature: GYAE6OF01D6CC6.1.49.E05.1.454.CMB.1.raw
  modified_base (244)..(244): a, c, t, g, unknown or other
  misc_feature (244)..(244): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttntgttacattctttccacgtacgtatgtattggttgagtacgacggcccccggaggacgggtcgttggaggtggagtgggagtggatacgacgtacccgttaacggaaactaaaacgagaagtagtaggaagagtaacgtcgaggacaggagtcatacatacgaccgcgtaccaacactaccgaagacgtacgacgtacctatacgtagaacgtaggaggacgacctacgaagtactacgtcggaaccgtaccgaccgggtaacccttaacgtttaacgttaccgtcggaccgacgggtaagtacgtaagttttacggtacggtaccgttaccggttcggtacccgtttacgggcctttaaaccggaacccgttaaccggttcgtttacggggtcggggtaacccggg

SEQ ID NO: 29352 - DNA, 513 bp, Homo sapiens
  misc_feature: GYAE6OF01B2VUZ.1.49.E05.1.454.CMB.1.raw
  modified_base (433)..(433): a, c, t, g, unknown or other
  misc_feature (433)..(433): n is a, c, g, or t
  modified_base (463)..(463): a, c, t, g, unknown or other
  misc_feature (463)..(463): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggtgagacaggcccccggagagggggcttggagtggatggggatggatcagtcccttacggaactaaaacagagtatggagagaagttccgagggcagagtcatcatcaccgcgacacatccacgagtacagcctacatgggaactggacgagcctanagatctgacgacacggccacttatctgcgngagagtattatgcagtcggtcctggctgtaaccacgtcttggtggtaccg

SEQ ID NO: 29353 - DNA, 668 bp, Homo sapiens
  misc_feature: GYAE6OF01CSM6D.1.49.E05.1.454.CMB.1.raw
  modified_base (437)..(437): a, c, t, g, unknown or other
  misc_feature (437)..(437): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattccttttccacctacggtatgtaattggttgagtacgacggcccccggaggaggggtcttggaggtggatggggatggatcgagtacccgttaggaaactaaacgagtagtagtaggagagagttacgaggcagagtcatacatcgaccgcgaacacactccgaagacgtaacgacgtacctanagtacggaacttggaacggacgcccgttacgaagtacttaccgtacgaaccggtacccgaaccgggtacccttaaaccgtttaacgtttaaccgcggtaaccggtaccggtaaaggtacgtaaagttttacgttcggtaacccgttaccggttcgggttccccgttagggtcccttaacgggttaaacccccgtacgggtttccgtttaggggttccggggtaaccccggg

SEQ ID NO: 29354 - DNA, 634 bp, Homo sapiens
  misc_feature: GYAE6OF01DGQSE.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagacacggcccccggagaggggcttggagtggatgggatgggatcgagtaccccgttacggaaacctaaaacgacgaagtagtaggagaagtaagttccgaagggcagacgtacatacatcgaaccgtcggaacacactaccgaacgacgtacagacctaacagtacggaactggaggacgcctacagtactcgtacgacgaaccgacgggtaccctaacgttacttaacgtggaccggaccggtaaggacgtaagtttaagttacggaccgtacggtttacgggtacccgttacgggacccttacgggttaaaaccccgaccggttaccgttggggttcggggtaacccgg

SEQ ID NO: 29355 - DNA, 587 bp, Homo sapiens
  misc_feature: GYAE6OF01CUDLN.1.49.E05.1.454.CMB.1.raw
  modified_base (426)..(426): a, c, t, g, unknown or other
  misc_feature (426)..(426): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagtacacggccccccggaggaggggcttggacgtggagtgggatggatcgagcccttacggaactaaacagagtagtggagagaagttcgagggcagagtcatcatcgaccgcgacacactaccacgacgtacgagccctaanagtacggaactggaacggacgcccgtacagactcgtcgaaccgaccgaccgggtacctaactttaacttaccgtgaccggacggagacgtattagttcggactacgtcggtcccgtgggtaccttacggtaacccacggttccgttgggtcgggtacccgg

SEQ ID NO: 29356 - DNA, 532 bp, Homo sapiens
  misc_feature: GYAE6OF01ALKN5.1.49.E05.1.454.CMB.1.raw
  modified_base (410)..(410): a, c, t, g, unknown or other
  misc_feature (410)..(410): n is a, c, g, or t
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagtacaggcccccggagaggggcttggagtggagtgggatggatcgagcccttagaactaaacagagtagtggagagaagttcagggcagagtcatcatcacgcggacacactccacgagtacagcctanataggaactggagagcctanagtacncgtgaacgacgacggccacgttacttacgtgcgacgagagtattagtgaccacgttcgtccgtggcgttacgtacccagtcgttggtcgggtaccg

SEQ ID NO: 29357 - DNA, 559 bp, Homo sapiens
  misc_feature: GYAE6OF01ACWA2.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgaattggttgagacgacggcccccggaggagggggcttgagtggagtgggatggatcgagacccgttaacggaactaaaacgagagtagtggagagaacgttcgagggcaggagtcatcatcgaccgcggacacactccgacgagtacagacctacagtaggaactggaggagcctagagtatcgtagaacgaccgaccggtacctaacttattacgtgacgcgaagagtattagtcgactacgtcggtacctggacttacgtaaccacggtcttgggtgggtaccgg

SEQ ID NO: 29358 - DNA, 537 bp, Homo sapiens
  misc_feature: GYAE6OF01CMAMI.1.49.E05.1.454.CMB.1.raw
  modified_base (356)..(356): a, c, t, g, unknown or other
  misc_feature (356)..(356): n is a, c, g, or t
  modified_base (459)..(459): a, c, t, g, unknown or other
  misc_feature (459)..(459): n is a, c, g, or t
  modified_base (492)..(492): a, c, t, g, unknown or other
  misc_feature (492)..(492): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggccccccggacaaaggccttgagtggatgggatggatcaacgctggcaatggtaacacaaaaaattcanagaagttccaggcagagtcacctttaccagggacacatccgcgaggattacttatatggagctgagcagcctgagatccgaagacacggctgtatatttttgngtcgaccttctagtggaggtctatttattacgnttacaattttcgacttccgtggggcccaggggaccccgttacggg

SEQ ID NO: 29359 - DNA, 605 bp, Homo sapiens
  misc_feature: GYAE6OF01DQ9FC.1.49.E05.1.454.CMB.1.raw
tcagacgagtgcgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagacaggcccccggagaggggcttgaggtggatgggatggatcagcccgttacggaactaaaacagagtatggagagaagttccgagggcagagtcatcatcaccgcggacacatccacgacgtacagcctaacataggaactggaggacgcctacgaacgactcgtacgaccggaaccgtaccgggaccctaacgtttacgttaccgtcggaccggacggtaaggacgtaagtttaacgttacggaccgttaaccggttcgggtacccgttcgggtaccttacggttaaaccctaccggttacgttcgggtcgggtacccgg

SEQ ID NO: 29360 - DNA, 562 bp, Homo sapiens
  misc_feature: GYAE6OF01D6GF9.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggagtgggatggatcagcccttacggaactaaaacagagtatggagagaagttcgagggcagagtcatcatcaccgcggacacactccacgagtacagacctaacagtcggaactggaggacgcctacgagatcgtagacgacgaccggcctaacttacttacgtcgcggacgagacgtattacgttcgactacgttcggtacccgtgggtaccttacggtaaaccctacggtccgttgggtcgggtacccgg

SEQ ID NO: 29361 - DNA, 563 bp, Homo sapiens
  misc_feature: GYAE6OF01D499L.1.49.E05.1.454.CMB.1.raw
  modified_base (399)..(399): a, c, t, g, unknown or other
  misc_feature (399)..(399): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgtaattggttgagacgacggcccccggaggaggggtcgttggaggtggagtgggatggatcgagtacccttaacggaaactaaacagagtagtaggagagagtcgaggcagagtacagtcatacacgngacacactccgagacgtacagcctagataggaactggacgacgcctgaagtatcgtagaaccacgaccgtacctaacttacttacgtggaccgacgaggagtaagttagttcggactacgtggtacccgtggacctacggtaaccaccgtcgttggcggtaccg

SEQ ID NO: 29362 - DNA, 523 bp, Homo sapiens
  misc_feature: GYAE6OF01DOITF.1.49.E05.1.454.CMB.1.raw
  modified_base (413)..(413): a, c, t, g, unknown or other
  misc_feature (413)..(413): n is a, c, g, or t
  modified_base (430)..(430): a, c, t, g, unknown or other
  misc_feature (430)..(430): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagtacaggcccccggagagggggcttggaggtggagtgggatggatcgagcccttacggaactaaaacagagtatggagagaagttcgaggcagagtcatcatcaccgcgacacatccagatacagcctanatgaactgagagcctanagatctgaacgacgaccggtcacttatactgaccgcgagagtattagttgacactcggtcctggctacgtaaccacggtcttggtcggtaccg

SEQ ID NO: 29363 - DNA, 662 bp, Homo sapiens
  misc_feature: GYAE6OF01DAWHQ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttctggttacattcttttccacctacggtatgtaattggttgagtacgacggcccccggaggacggggtcttggaggtggagtgggagtggatcgagtacccgttaacggaactaaacgagtagtagtaggagaagaacgttcgaggacagacgtacagtacagtaccgaccgacggaacacgactacccgacgagtaccgacgtaccctaacgtagtaacgggtaacctaggaacggacgtacccgtacgaacgtacttaccgtacggaaccggtacccggaacccggtaccctaacgttttacgtaaccgtcggtacggaaccgtaggtacgttaagtttacgttcgtacctacggttcgggttaccccgtggtacccgttaccggtaaccgtaccggtcggttcgggtcgggtacccgg

SEQ ID NO: 29364 - DNA, 577 bp, Homo sapiens
  misc_feature: GYAE6OF01BWU9C.1.49.E05.1.454.CMB.1.raw
  modified_base (220)..(220): a, c, t, g, unknown or other
  misc_feature (220)..(220): n is a, c, g, or t
  modified_base (442)..(442): a, c, t, g, unknown or other
  misc_feature (442)..(442): n is a, c, g, or t
  modified_base (494)..(494): a, c, t, g, unknown or other
  misc_feature (494)..(494): n is a, c, g, or t
  modified_base (500)..(500): a, c, t, g, unknown or other
  misc_feature (500)..(500): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctnagtgatggtctctgcagtgcttcgtggttacattcttttccacttacggtatgtaattggttgagacacggcccccggaggaggggcgttggaggtggagtgggatggatcgacgtcccgttaacggaactaaaacgagaagtagtaggagagtaacgtcgagggcagagtacatcatcgaccgacgacacactaccgacgataccagcctacgataggacnggagacgtctacagtactcgagaccgacgtaccggacctaacttacgtacgngaccgnggagtagtattacgttcgacgacgttggtacccgtggacccgttacgaacccgtagtcgtttgggcgggtaacccgg

SEQ ID NO: 29365 - DNA, 512 bp, Homo sapiens
  misc_feature: GYAE6OF01CGWTL.1.49.E05.1.454.CMB.1.raw
  modified_base (428)..(428): a, c, t, g, unknown or other
  misc_feature (428)..(428): n is a, c, g, or t
  modified_base (467)..(467): a, c, t, g, unknown or other
  misc_feature (467)..(467): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggtgagacaggcccccggagaggggcttgagtggatgggatggatcagcccttacggaactaaaacagagtatggagagaagttcgagggcagagtacatcatcaccgcggacacatccaacgagtacagcctaacatgaactgagagcctnagatctgaccgacgacggccacttatacgtcgcgcgganagattagttgacatcggtcctggctagtaccagctggtggtaccg

SEQ ID NO: 29366 - DNA, 609 bp, Homo sapiens
  misc_feature: GYAE6OF01DCOAU.1.49.E05.1.454.CMB.1.raw
  modified_base (399)..(399): a, c, t, g, unknown or other
  misc_feature (399)..(399): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactccccaggttcacctggtgcagtctggagctgagctgcagagcctggggcctcagtgatggtctcctgcagtgcttcgtgttactattcttttaccacctacgtatgtaattggttgagacgacggcccccggaggacggggtctttggaggtggagtgggatggatcacgtaccgtacgaaactaaacgagagtatggagagagtcgaggcagagtcatcatcacgcgacncactcgacgagacagacctagactaggaacgtaggacggactacctacgagactcgtaagaccggaacccgtaccggtcctaacgtttaccgttacgtcggacggagtaacggtaacgttaagtttagttcggacctacggtttccgggtaccctagggtacccttaacgggtaaacccgtcggttaccggttgggtcggggtaacccgg

SEQ ID NO: 29367 - DNA, 657 bp, Homo sapiens
  misc_feature: GYAE6OF01CZ3OG.1.49.E05.1.454.CMB.1.raw
  modified_base (474)..(474): a, c, t, g, unknown or other
  misc_feature (474)..(474): n is a, c, g, or t
  modified_base (501)..(501): a, c, t, g, unknown or other
  misc_feature (501)..(501): n is a, c, g, or t
tcagacgagtgcgtcacgaccggtgctcgatttagagcgactagcaacacacaaaggggacccaaaaccacacccctccttgggagaatcccctagatcacagctccctcaccatggacgggacctggagcatccttttcttggtggcagcagcaacaggtgcccactcccaggttcacctggtgcagtctggagctgagctgcagaagccgtggggcctcgagtgatggtctcctgcagtgcttcgtggttactatttccttttacccaccgttacggttattaggtaagttgggttagacggacgaccgggcccccggtaggacggggtcttggagtggacgtgggtataggacgtcgacgtccgttaacggaaactaaaacgagtagtagtaggaagtagaaggttaccgagggacaggagtcactcacgtcgaccgacgacacacgtaccgacgacgtacacgacctaanagtacgaacgtgagggacaccgtgaanactccgtaaggaaccgaccgaccgggtaccctagtttacgtacgaccggtccggacgtaaggtagttacttaacggttcgaccgtttacggtcgggttcccgttagggtacccttacgggttaaccccagttcccgggtttgggtcgggtacccgg

SEQ ID NO: 29368 - DNA, 672 bp, Homo sapiens
  misc_feature: GYAE6OF01CP1R5.1.49.E05.1.454.CMB.1.raw
  modified_base (286)..(286): a, c, t, g, unknown or other
  misc_feature (286)..(286): n is a, c, g, or t
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccactacggtatgtaattggttgagacncggcccccggagaggggcttggagtggatgggatggatcagtacccgttacggaactaaaacgagaacgtagtaggaagagtaagttaccgagggacaggtagtcatacatcaccgcggaacacatccgaacgagtaacgagtacctaacgagtacggaaccgttaggaacggacgacctagacgtacgtacgttacggaaccggtaacgaaccggggtacctaacgtttacgtttaaccgtcggaaccgggtacgtaacggaggttaacgtttaacgttacggtacccgttaaccggttacggggttaccccgttaggggttacccgtttaaccgggttaaaccctaccgggttaccgtttacggggttccggggtaaccccggg

SEQ ID NO: 29369 - DNA, 557 bp, Homo sapiens
  misc_feature: GYAE6OF01BSYJ2.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacgacggccccccggaggagggggcttggaggtggagtgggatggatcagcccttacggaactaaacagagtagtggagagaagttcgagggcagagtcatcatcacgcggacacactccacgagtacagcctacagtaggaactgaggacgcctcagactcgtacgacgacgaccggtacctactttacgtactcgacgcggagtacgtattagttcgctacgtcggttaccgtggtacttacgtaaccctacggtcgttggtgggtacccgg

SEQ ID NO: 29370 - DNA, 521 bp, Homo sapiens
  misc_feature: GYAE6OF01A6Q94.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttgagtggatgggatggatcagcccttaggaactaaacagagtatggagagaagttcagggcagagtcatcatcaccgcgacacatccacgagtacagcctacatggaactggacgagcctcgagactcgtcgacgacgacggaccacttactactgcgcgagagtattagtgactacgtcggtcctggctacgtaaccacgtcgttggtggtaccg

SEQ ID NO: 29371 - DNA, 579 bp, Homo sapiens
  misc_feature: GYAE6OF01CA1EH.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttcacctacggtatgaattggttgtagacaggtccccccggagagggggcttggagtggatggggatgggatcagccttacggaactaaaacagagtatggagagaagttccagggcagagtcatcatcaccgcggacacgatccgaacgagtacagcctacagtggaactggaggagcctacagatcagacgacacgggaccctacttacttaacgcgtacggacgtaacgaaggtactttaaagttcgacaccgtttggggtcccttagggaccgtttacggttaaaccccgaacggtccctttgggttcgggaacccggg

SEQ ID NO: 29372 - DNA, 567 bp, Homo sapiens
  misc_feature: GYAE6OF01ARZI8.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaatttggttgagacaggcccccggagagggggcttggaggtggagtggggatggatcgacgtcccgttaacggaaacttaaaacgagaacgtaagtagggaagaaggtaacggttacgaggggacagagtcatcatccgaccgcgacacactccacgagtacagtcctacagtgaactgaggagccctgagtactcgtcggaaccgacgaccgtacctacttacgttactcgcgcgacgagtattagtcgactacgtcggtccgtggctacgtaaccgagtcttggtcggtaccg

SEQ ID NO: 29373 - DNA, 556 bp, Homo sapiens
  misc_feature: GYAE6OF01DHYVW.1.49.E05.1.454.CMB.1.raw
  modified_base (307)..(307): a, c, t, g, unknown or other
  misc_feature (307)..(307): n is a, c, g, or t
  modified_base (345)..(345): a, c, t, g, unknown or other
  misc_feature (345)..(345): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgattctggttacatcttttccacctacggtatgaattggttgagacaggcccccggagaggggcttgngtggatgggatggatcgagcccttacggaactaaaacngagtatggagagaagttcgagggcagagtcatcatcacgcgacacatccacgagtacagacctaacgactaggactagaggacgcctacagactctacgaccgtacaccgggtcctacgttacttacctggccgacgaaggacgtattaacgttgactaacgtggttacccgtggccgttacgtaacccgtagtcttgggtgggtacccgg

SEQ ID NO: 29374 - DNA, 711 bp, Homo sapiens
  misc_feature: GYAE6OF01CN9CN.1.49.E05.1.454.CMB.1.raw
  modified_base (245)..(245): a, c, t, g, unknown or other
  misc_feature (245)..(245): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttntggttacattcttttccaccgtacggttatgtaagtttggttgagtacgacggcccccggaggtagggggcttggaggtggatgggagtggactcgacgtcccgttaacggaactaaaaaccgagtaagtagtaggaagagtaacgttaccgagggacaggagttcagtacacgtacgaccgtacggacacgactcccgaacgtacgtacgaacgtacctaacgagtacgaaacgttggaacggacgacccgtacgaagtactacgtacggaaccggtaacgaacccgggtaccctaacgtttaacgttaccgttacggaccggtaacgtaacgggtacgtaacgtttttaacgttacggaccgttaacggttccggggttacccgttacggggtaccctttaacggggttaacccccgtaaccggtttacccgggtttcgggtacccgggggttaaaccccgggg

SEQ ID NO: 29375 - DNA, 572 bp, Homo sapiens
  misc_feature: GYAE6OF01E0I8U.1.49.E05.1.454.CMB.1.raw
  modified_base (508)..(508): a, c, t, g, unknown or other
  misc_feature (508)..(508): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccaccttacggtatgaattggttgagacgacggcccccggaggacgggggcttggaggtgggagtgggagtggatcgacgtcccgttaacggaactaaaacgagagtagtaggagagaagtacagggcagagtcatcatacgaccgcgacacgactccgacgtacgtacacgacctaacgagtaggaactggaggacgacctacgagatacgtgacgaccgacggtacctaacttacttactcggacgnggtagtagtagttagtcgctacgtggtcctggacttacggtacacggtcgttggtcgggtaccg

SEQ ID NO: 29376 - DNA, 551 bp, Homo sapiens
  misc_feature: GYAE6OF01D9MSZ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggaggtggagtgggatggatcgacgcccgttacggaactaaaacgagagtatggagagagttccgagggcagagtcatcatcacgcggacacactaccgacgagtacagacctaacactagggaactggaggacgccgtacagtactcgtagaccgacacggccctacgtttacttactacgcgacgagagtattacgtgctacgtcggtcctggtacgtacgtaaccagtcgttggtcggtaccg

SEQ ID NO: 29377 - DNA, 507 bp, Homo sapiens
  misc_feature: GYAE6OF01BJN8A.1.49.E05.1.454.CMB.1.raw
  modified_base (421)..(421): a, c, t, g, unknown or other
  misc_feature (421)..(421): n is a, c, g, or t
  modified_base (470)..(470): a, c, t, g, unknown or other
  misc_feature (470)..(470): n is a, c, g, or t
  modified_base (500)..(500): a, c, t, g, unknown or other
  misc_feature (500)..(500): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacaggcccccggtagaggggcttgagtggatggatggatcagcccttacggactaaaacagagtatggagagaagttcaggcagagtcatcatcacgcggacacatccagagtacagcctacatggaactgagagcctnagatctagacgacacggtccacttattactgcgtcgagagattagttgntactggtcctggctagtaacccagcgttgnggtaccg

SEQ ID NO: 29378 - DNA, 657 bp, Homo sapiens
  misc_feature: GYAE6OF01A7KN4.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacgtatgtaattggttgagacaggcccccggagagggcgttgagtggagtgggatggatcgacgtacccgttaacggaaacttaaaacgagtaagtaagtagggaagtaaggaacgttaccgagggacgaaggtacgtacaatacgagtaccgaccggacggacaaccgtactaccgaacgaacggtaaccaacgtacctaaccgtagtacgggtaacgttacgggaaggacgtaccgtacgaagtacgtacgtacgtaaccgaaccgacccgggtacctaacgtttacttaccgtacgaccggacgtaaggtagtagtttacgtgtacctacgttcgggtcccgttaggtaccgttacgtaacccgtacggttcgttcgggtcgggtaccgg

SEQ ID NO: 29379 - DNA, 599 bp, Homo sapiens
  misc_feature: GYAE6OF01B2DI2.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaaactaaaacagagtatggagagaagttccgagggcagagtcagtcatcaccgacggacacgatccaacgagtaacacgacctaacagtcgggaactggaaggacgccgtacagtaacgtctaggaaccgaccgaaccgggtccctaacgtttaacttaacgcgacggcgtaaggaacgtatttaagttcgaccgtaacgttcgggttaccccgtgggtaccgttacggtaaaccctaaccggtcgtttgggtcggggtacccgg

SEQ ID NO: 29380 - DNA, 701 bp, Homo sapiens
  misc_feature: GYAE6OF01CQFRN.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtgcccactcccgaggttccaccgtggtgcagtctggagctgagctgcagacgccgtgggcctgaggtgatcggtctctgcgtagtgtcttcgtggttactactttctttaccacgtacgtatagtaattggttgagacgacggccccgaggacgggtcttggagtggagtgggatggactacgacgtaccgtaggaactaaacgagagtagtagaagaggtagtacgaggacgagagtacatcgtacgtaccgaccggacggaacaacgtacgtaccggacgtaacggtaccggtctaacgacgtacgggtaacgtaggacgggtacgaccgttacgaaggttacgtccgtaacggaacccgacggtaacccggtacccttaacgtttaccgtaaccgttcggaccggtaacggaggttaacgtaacgttttacgttacggtaaccgttcgggtaccggttcccgggttacgtacccggttacggttaaaccccggtacggttccggttttaccggggcgggtcccgttaacccgggggg

SEQ ID NO: 29381 - DNA, 642 bp, Homo sapiens
  misc_feature: GYAE6OF01CO9RH.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttcgtggttacattcttttccacctacggtactgtaatttggttgagacgacggccccccggaggacgggggcttggaggtggagtgggagtggactcgacgtacccgttaacggaactaaaacgagtaacgtagtaggaagagtaacgttacgagggtacgaggtagtcagtacgacgtcgaccgcgacacgactacccgacggagtaaccgacgaccctaacgagtacggaaccgtggacggacgtccgtacgagtactacgtacgaaccgaccgaccggtacctaacttagttacgtcgacgtacgagacgtagtttacgttcggtactaacggttcgggttacccgtaggtacccttacggttaaacccgtaccgtccgttgggtacgggtacccgg

SEQ ID NO: 29382 - DNA, 853 bp, Homo sapiens
  misc_feature: GYAE6OF01CRP0R.1.49.E05.1.454.CMB.1.raw
tcagacgagtgcgtcacgaccggtgctcgatttagagcgactagcaacacacaaaggggacccaaaaccacacccctccttgggagaatccctagatcacagctcctcaccatggacgggacctggagcatccttttcttggtggcagcagcaacaggtgcccactcccaggttcacctggtgcagtctggagctgagctgcaggaagcctggggcctcagtgatgggtctcctgcagtgcttctggtacattctttcacctacggtatgaattggttgagtacacggcccccggaggagggggcttaggaggtgggagtggggatagggacgtcgacggtaccccttaacggaaaacctaaaacgaaggtaacggttagttaggggaaggaagggtaaacggtttacccgggaaggggtaccgtaagggtaacggttaccgtaaacgtaccgtaaacgttaccccggaacccgggtacccggggaaacccgaaccggtaaccctttacccccggaaaccggtaaacggggtttaaaccccaaccggggtaacccctaaaccggtaacggttacggggaaaccgttacgggaacgggaacggtaccccgtttacggaacgttaacgttccggttaaacgggtacccggaaacccggtaacccgggtacccgttaaccgttttaaacgttaacccggtcgggtaccggaacggtacgggtaaaggtaacgttttacgttacgggtacccttaacgggtttccgggttacccggtttaacgggtaccccgttaacgggttaaacccccgggtacccggtttaccggtttggggttaccgggggtaaccccggggg

SEQ ID NO: 29383 - DNA, 626 bp, Homo sapiens
  misc_feature: GYAE6OF01AD0V8.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgtcttctggttacattctttccacctacggtatgtaattggttgagacgacgggcccccggaggacggggtcttggaggtggagtgggagtggatcgagacccgttaacggaactaaaacgagagtagtaggagagtaacgtcgagggacagagtacatcatcaccgcgacacatccaacgagtacacgacctacgagtacggaactaggacggacgccctacgaagtactcgtacgaaccgacgaccggtacctaacgtttacgttactcggtaccggacgtaagacgtaagtttacgttcggaccgttacggttcgggtacccgttacgggtaccgttaccggtaaccccgtacggttccggtttagggtcggggtaacccggg

SEQ ID NO: 29384 - DNA, 651 bp, Homo sapiens
  misc_feature: GYAE6OF01CVMQZ.1.49.E05.1.454.CMB.1.raw
  modified_base (362)..(362): a, c, t, g, unknown or other
  misc_feature (362)..(362): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtcgtggagctgagctgcagagccgtgggcctgagtgagtggtctctgcagtgtctgtgtacattctttccacgtacgtatagtagttggtgagacgacgggccccggaggaggggtcttaggaggtggaagtggggattggactcgaggtaccccgttaaggaaactaaaacgnggtaacgtagtaggaagtaaggtaacgttcgaagggcaaggacgttacagtaccgataccgacggacgacactataccgaacgtaacacgactaccgtagaagtacggactagggacggacaccgtacgaagtacttacgaacggaccgaccgtaccggtacctaacgtttacgtactcggacggacgtaacgagttaacgttacgttaggacccgttacggtccgggtttaccgtacgggtccttaaacggtaaccctacgggttcgttgggtaccgggtacccgggg

SEQ ID NO: 29385 - DNA, 588 bp, Homo sapiens
  misc_feature: GYAE6OF01EYR07.1.49.E05.1.454.CMB.1.raw
  modified_base (454)..(454): a, c, t, g, unknown or other
  misc_feature (454)..(454): n is a, c, g, or t
  modified_base (577)..(577): a, c, t, g, unknown or other
  misc_feature (577)..(577): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccaccttacggtatgtaattggttgagtacaggcccccggaggaggggcttggaggtcggagtgggatgggatcgacgcccgttaacggaactaaaacgagacgtatgggagagaacgttccgagggcagagtcatcatcgaccgcggacacgactccgacgagtacaacgtcctacagtaggaactaggaggacncctacgagatcgagaaccgacgacccggaccttaacttacgttaaccgtcgaccgtacggaacgagtaattagttcggactacgttcggtccgtggccttacggtaacccgagttcgttcggngggtaacccgg

SEQ ID NO: 29386 - DNA, 555 bp, Homo sapiens
  misc_feature: GYAE6OF01C2REM.1.49.E05.1.454.CMB.1.raw
  modified_base (401)..(401): a, c, t, g, unknown or other
  misc_feature (401)..(401): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagtacacgggcccccggaggacgggggtcttggagtggatgggatggatcagcccttaacggaactaaaacgagagtagtggagagagttcgaggcagagtcatcatcacgcgacacanaccacgagtacacgctacagtacggaactggaggacgcctacgagactcgtacgacggaaccacgggccctacgtttaattactgcggacgtaggagtatagttcgactacgtcggttacctggtctacggtaccagtcgttggtcgggtaccg

SEQ ID NO: 29387 - DNA, 646 bp, Homo sapiens
  misc_feature: GYAE6OF01AHDND.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttctggtggcagcagcaacaggttgcccactcccaggttcacctggtgcagtctggagctgagcgtgcagaaggcctggggcctcagtcgagtggtctcctgccagtgcttctaggttacatcgtttccacctacggtatgaattggttgagacgacggcccccggaggacggggcttggacgtggagtgggagtgggacttcgacgtcccgttaacggaacgttaaaacgagtagtagtaggaagagaagttaccgagggactagagtacgatcacgtcaccggacgaccaacgacttaccgacgtacgtaccaacgcctaacgtagtacggaactacggaaggtacgacccgttacgagtactcgtacgaaccgtaacgaccggtacctaacttacttaccgacggaccgtaccgaaggacgttagttaacgttcgtacgttaacgttcggtacccgttggtacccgttacggtaacccgaacggttccgttcgggtcgggtacccgg

SEQ ID NO: 29388 - DNA, 532 bp, Homo sapiens
  misc_feature: GYAE6OF01AXIM5.1.49.E05.1.454.CMB.1.raw
  modified_base (387)..(387): a, c, t, g, unknown or other
  misc_feature (387)..(387): n is a, c, g, or t
  modified_base (434)..(434): a, c, t, g, unknown or other
  misc_feature (434)..(434): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccactacgtatgaattggttgagacgacggcccccggagaggggcttgagtggatgggatggatcagccttacggaactaaaacagagtatggagagagtaccgaggcagagtcagtcatcacgcgacanactccacgatacagcctacagtgaactggacgacgcctcgagatcgngaacgacgacggacctacttatactgcgacgagtacgtagttactggactacgtcggtccgtggaccgttacgaacccgtagtcttgggcggtaccgg

SEQ ID NO: 29389 - DNA, 599 bp, Homo sapiens
  misc_feature: GYAE6OF01DJDCK.1.49.E05.1.454.CMB.1.raw
  modified_base (421)..(421): a, c, t, g, unknown or other
  misc_feature (421)..(421): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagacaggcccccggaggaggggcttgagtggagtgggatggatcagcccttacggaactaaacagagtatggagagaagttccgaggcagtagtcatcatcaccgcggacacacgtaccacgacgtacacgacctaanacgtaggaacgtaggaggacgcctacgagactcgtacgaaccgtaaccgaccggtacctaactttacttacgtcggaccgaccgtaagacgttagtttacgtcgtacttacgttcgggttacccgtgggtaccgttacggttaaacccgtacggtaccgtttgggtcgggtacccggg

SEQ ID NO: 29390 - DNA, 718 bp, Homo sapiens
  misc_feature: GYAE6OF01B2Q73.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttgggtggcagcagcaacaggtgcccactcccaggttcacctggtgcagtctggagctgagctgcagaagccgtggggcctcgagtgatggtctcctgcagtgcttctggttacattcttttccaccttacggtatgtaattggtgacgacgacggccccggaggaggggtcttggaggtggagtgggatggatcgacgtacccgttaacggaaactaaaacgaggtaacgtagtagggaagaaggtaacgttaccgagggtacaaggtaacgtacaatcaagtcgaccggacgaacacactaccgaacgtagtaaccacggtacctaacgtacgtacgggtaaactggaacgggtaccgacccgtaacgtagacttaccgtaacggaacccgtaaccgaacccgggtacccttaacgtttaacgttaccgtcggacccggaccggtaaagtacggttaaattttacggttacggtacccgttaacggttccggggttacccgttacggggttacccgtttaacgggtaaaccccgtaccgggttacggtttcgggggtaccggggttaaccccgggg

SEQ ID NO: 29391 - DNA, 719 bp, Homo sapiens
  misc_feature: GYAE6OF01B3YVH.1.49.E05.1.454.CMB.1.raw
  modified_base (599)..(599): a, c, t, g, unknown or other
  misc_feature (599)..(599): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttgggtggcagcagcaacaggtgcccactcccaggttcacctggtgcagtctggagctgagctgcagacgccgtggggcctcgagtgatggtctccgtgctagtgcgttctggttactactttccttttccaccgttacggttatagtaagtttggttagacgtacgaccgggtccccggagggacggggtcttggaggtggtagtcgggtagtggactacgaccggtaccgttaacggaaactaaaacgtggaagtacgtaggagtaagtaacgttaccgagggtacgagtagtacacgtactacgtaccgaccggacggaaccacgtaacgttacccgaaggtacgtaacacgtaacccgtaatagttacggaacggtaggaacggtacgacccttagacggtaacttcgtaccggaaccggtaaccgaacccgggtaccctaattttaacgttacncgggaaccggagtaacggagttaaacgtttcgtacggtacgtacggtttcccgggtacgttacgggttaaccgtttaccggtaaacccgttccggtggtttccggggcgggttaacccgg

SEQ ID NO: 29392 - DNA, 689 bp, Homo sapiens
  misc_feature: GYAE6OF01BK56N.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcagtgagtggtctctgcagtgtcttcgtggttactattctttccaccgttacggtatgtaagttggttacgagaccgtacgggaccccggaggaggggtcttggagtggagtgggatggattcgacgtacccgttaacggaaactaaaacgaggtaacgtagtagggaagacggtaacgttaccggagggacgtaaggacggtacgtaagtccgtaagtacccgaccgggaccggaacaaccgtacgtacccgaacggaacgttaaccacggtaccctaagtacgtacgggtaaaccgtagggaacggtaccgccgttacgaagtacgtacgtacggaaccgaccgaacccgggtacctaacgtttaacgtaccgtacggaccgtacggaagtacgttatttacgtacgtcgtacggtcggttccgtaggtaccgtacgtaacccgacgttcgttcgggtgggtacccgg

SEQ ID NO: 29393 - DNA, 613 bp, Homo sapiens
  misc_feature: GYAE6OF01ELP1K.1.49.E05.1.454.CMB.1.raw
  modified_base (486)..(486): a, c, t, g, unknown or other
  misc_feature (486)..(486): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttcgtggttacattcctttccaccgttacggtatagtaagttggttgagacgacggcccccggaggagggtcgttggaggtggagtgggagtgggatcgacgtacccgttaacggaaacctaaacgagtagtaagtaggaagaagtaacgttacgagggacagacgtacatacacgtcgaccggacgacacactaccgacgaacgtacacgtacctaacgagtaggaactaggaggacgcctanagactcgtacgaaccgaccgaccggtacctaacgtttacttaccgtggaccgtacgagtagtaatttacgtcgtactacgtcggtacccgtggaccttacgtaacccgagttacgttggcggtacgg

SEQ ID NO: 29394 - DNA, 606 bp, Homo sapiens
  misc_feature: GYAE6OF01CYE3G.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagtaacaggtgcccactcccaggttcacctggtgcagtctggagctgagctgcagaagccgtgggcctcagtgatggtctcctgcagtgcttctggttacattcttttccactacggtatgaattggttgagacacggccccggagagggtctgagtgagtggatggatcagtacccttaacggaaactaaaacaggagtagtaggagaagtaacgttaccgagggcaagagtactactcaagtaccgaccggacggaaccacgtaactaccgaacggtaacgtacacgtaccttaacgagttaacggaaccgtaggaaggtacgaccttacgaaggtactccggtacgaaccgaccgaccggtacctaacgttaacttacgtcgacgacggaagtacgtattacgtcgctagtcgtcgcggtctacgtaacctcgtgttcggtcgcgtaccggg

SEQ ID NO: 29395 - DNA, 637 bp, Homo sapiens
  misc_feature: GYAE6OF01DDEA2.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagaagcctggggcctcagtgatggtctctgcagtgcttcgtggttacattcttttccacctacggtatgtaattggttgagacgacgggcccccggaggagggggtcttggaggtggaggtgggagtggatcaggtacccgtaacgaaactaaaacagagtagtagagagtagtccgaggcaggagtcgatcatcgaccggacggacacgactaccgaacgacgtacacgacctaacgacgtacggaacgtagggaacggacgtaccctacgacgacgtcgtaacgaaccggaaccgtacccgggtaccttaactttacgttacgtcggaccggacgtacggagttattagtcggtacctaccggttcgggtcccgttacgggtacgttaaccggttaacccgtaccggttacgttcggggtcgggtacccggg

SEQ ID NO: 29396 - DNA, 543 bp, Homo sapiens
  misc_feature: GYAE6OF01D5KRO.1.49.E05.1.454.CMB.1.raw
  modified_base (401)..(401): a, c, t, g, unknown or other
  misc_feature (401)..(401): n is a, c, g, or t
  modified_base (419)..(419): a, c, t, g, unknown or other
  misc_feature (419)..(419): n is a, c, g, or t
  modified_base (443)..(443): a, c, t, g, unknown or other
  misc_feature (443)..(443): n is a, c, g, or t
  modified_base (469)..(469): a, c, t, g, unknown or other
  misc_feature (469)..(469): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagacacggcccccggaggacgggggcttggaggtggagtgggatggatcgagcccttacggaactaaaacagagtagtaggagagaagtcgaggcagagtcatcatcaccgcgacacanccacgagtacagacctanagtaggaactggaggacgcctganatcagaccgacacgcctacttatcgngcgcgagagtattacgttgactacgtcggtccgtggtactacggtaacctacggtacgttgggtcgggtaccgg

SEQ ID NO: 29397 - DNA, 539 bp, Homo sapiens
  misc_feature: GYAE6OF01BAI93.1.49.E05.1.454.CMB.1.raw
  modified_base (531)..(531): a, c, t, g, unknown or other
  misc_feature (531)..(531): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggtcttgagtggatgggatggatcgagcccttaacggaactaaaacgagagtatggagagaagttcgaggcagagtcatcatcaccgcggacacactccacgacgtacagcctacagtacggaactggaggacgcctcagactcgagaccgacgacgcctactttatacgtgcgacgagagtattagtcgacacgttcggtccgtggccttcggtaaccacgtcgtttggngggtaccg

SEQ ID NO: 29398 - DNA, 707 bp, Homo sapiens
  misc_feature: GYAE6OF01DIWK2.1.49.E05.1.454.CMB.1.raw
  modified_base (614)..(614): a, c, t, g, unknown or other
  misc_feature (614)..(614): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtgggcctcagtgatggtctcctgcagtgcttgtggttactattcctttccaccgttacggttatagtaagttggttagacgacgtacgggcccccggaggacggggtcttggaggttggagtgggagtggtactacgtacggtacccgttaacggaaaactaaaacggagaagttaaggtagggaaggaaggtaacgttaccggaagggtacgaaggtacgtacgaacgtacgtaactaccggaacccgacgggacctaaccgacttaccgaacgtaacgttaaccgacgtaacccgtaacgtacgtacgggaacgtaggaacgggtaactcccgtaacgaaggtaccgttacgtacggaacccggaaccgtacccgggtaacctaacgttacgtttaaccgnggacccggtaggaacgtacgttaattacgtgtaccgtcgttcggtacccgtgaccgttaccggtaacgtccgtcgttcgggtcgggtacccgg

SEQ ID NO: 29399 - DNA, 552 bp, Homo sapiens
  misc_feature: GYAE6OF01EDEOC.1.49.E05.1.454.CMB.1.raw
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagacaggcccccggagaggggcttggaggtggagtgggatggatcgagtcccgtaggaactaaacagagtagtggagagagttccgaggcagagtcatcatcaccgcgacacactccacgagtacagacctanatggaactgacggcnccgtcagntcgtacgacaccgacggtacctacgttacttactaggcgacggagtagtattacgttcgactacgttcggtccctggtaccgtcgtaaaccgaccggtcgttggtgggtacccg

SEQ ID NO: 29400 - DNA, 592 bp, Homo sapiens
  misc_feature: GYAE6OF01E02WA.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagacgacggcccccggaggagggggcttggaggtggagtgggagtggatcgacgtcccttaacggaactaaacgagagtagtggagagaagttcgaggcagagtcatcatcaccgcgacacactccaacgacgtacacgacctacgagtacggaacgtggaacggacgtcctacgaacgactcgtacggaaccgaaccgaccggtacctaactttacttaccgtacggacgacgagtagtatttagtcgtactacgttcggtacccgtggtaccgttacggtaacctacggtcgttgggtcgggtaccgg

SEQ ID NO: 29401 - DNA, 749 bp, Homo sapiens
  misc_feature: GYAE6OF01CWFQ1.1.49.E05.1.454.CMB.1.raw
  modified_base (194)..(194): a, c, t, g, unknown or other
  misc_feature (194)..(194): n is a, c, g, or t
  modified_base (335)..(335): a, c, t, g, unknown or other
  misc_feature (335)..(335): n is a, c, g, or t
  modified_base (430)..(430): a, c, t, g, unknown or other
  misc_feature (430)..(430): n is a, c, g, or t
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtgcccactcccaggttcacctggtgcagtctgganctgagctgcagaagccgtggggcctcagtgagttggtctacctgctagtgtactttcgtaggttactatttcctttaccaaccgtaggtaatgtaacttggttagacgtacgaccggccccggagggacgggtccttaggnggtggagtacgggactggtactcgacgtaccgtaacggaaactaaacgagtacgtagtaggacgagtaacgtcgaggacagtacgtacatactanaccgaccggacgaacacgacgtaccgaacgagtacctacggtactacgtagttaacgacgtaggaggtactaccgtacgaagtacgttcgaacgtaccccgaacgtaccggttacccgtaagtttacgttaaccggtcggaaccgtaacggtaaacggtaacgtttaacgttttaaccggttaccggtaaacccgggtttaccggttttccgggggtacccctttaagggtaaccccgggttttaaaacccgggttaaaacccccggttcgggtttaaccggttttccgggggggtaaccgggtttaaaccccccgggg

SEQ ID NO: 29402 - DNA, 515 bp, Homo sapiens
  misc_feature: GYAE6OF01BIW6Y.1.49.E05.1.454.CMB.1.raw
  modified_base (452)..(452): a, c, t, g, unknown or other
  misc_feature (452)..(452): n is a, c, g, or t
  modified_base (472)..(472): a, c, t, g, unknown or other
  misc_feature (472)..(472): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagtacaggcccccggagaggggcttgagtggatggtatgggatcagcccttacggaactaaaacagagtatggagagaagtcagggcagagtcatcatcacgcggacacatcacgagtacagcacatagaactgagacgcctcgagatctgacgacacgactacttatacgngacgcgagacgattagtcgnacgtcggtactggactacgtaaccacgtcgttggtgggtaccg

SEQ ID NO: 29403 - DNA, 606 bp, Homo sapiens
  misc_feature: GYAE6OF01D6LRZ.1.49.E05.1.454.CMB.1.raw
  modified_base (445)..(445): a, c, t, g, unknown or other
  misc_feature (445)..(445): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctccgtgcagtgcttctggttacattccttttccaccgttacggtatgtaagttggttagagtacgcggccccggaggagggtcttggagtggagtgggatggatcgacgtaccgtaacggaaactaaacgagagtagtaggaagagtaacgtccgaggacgaggatacatcagtccgaccgacggacacactaccgacgagtacacgacctaanacgtaggaacgtggaacggacgtcctacgaagtactacgtacggaaacccgacggaccgtacccgttaagtttacgtacgtcgacggacgaaggtagactttagtcgtactacggttcgtccgtcggtacttacgtaccgaggttcgtgggtcggtaccgg

SEQ ID NO: 29404 - DNA, 662 bp, Homo sapiens
  misc_feature: GYAE6OF01EEMKF.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggttacattctttccaccttacggtatgaattggttgagacgacggcccccggaggagggggtcttggtaggtggagtggggatgggatcgacgtcccttaacggaaactaaaacgagaggtacgtagggagaggtaagtccgaggacagagtcatcgactccacgacggacacgtactaccgaacgacgtaacgacgacccgtacgtaactacgggtaaactcgggaacgggtacgacccgtacgaaggtaacgttcgtacgggaaccgaccgtaacccgggtacccttaacgtttacttaaccgtcggaccgtacggaaggtaagtaacgtttagttcggaccttacggttcggtacccgttggaccgttaacggttaaacccgccggttacggttgggtccggggtaacccgg

SEQ ID NO: 29405 - DNA, 584 bp, Homo sapiens
  misc_feature: GYAE6OF01EZ9X7.1.49.E05.1.454.CMB.1.raw
  modified_base (460)..(460): a, c, t, g, unknown or other
  misc_feature (460)..(460): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctgttacatctttcacctacgtatgaattggttgagacgacggcccccggaggagggggcttggaggtgggagtggggatgggatcgacgacccgttaacggaaactaaaacaggaagtactaggagaggaacgttcgagggcagagtacgatcactcgaccgcgacacactaccgacgtagtacacgtcctacagtacggaactaggaggacgaccngaacgcgtacgtacgaaccgacgaccggtacctacttacgtacgtcggacgcggagtagtatttagtacgctacgtcggttcctaggtcctacggtaacccgtacggtcgttgggcgggtacgg

SEQ ID NO: 29406 - DNA, 589 bp, Homo sapiens
  misc_feature: GYAE6OF01ALWBG.1.49.E05.1.454.CMB.1.raw
tcagacgagtgcgtcacgaccggtgctcgatttagagcgactagcaacacacaaaggggacccaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacattctttccaccgttacgtatagtagttggttgagacgacgggcccccggaggacggggtcgttgaggtggacgtgggagtggatcgacggacccgttaacggaactaaacgagtagtagtaggagtagtacgtacgaggacagagtacatacacgtacgaccgacgacacactccagagtacagacctacgagtacgaacgtgaacggacgtactcgaagtactacgtacgaaccgaccggaaccgtccgttaacttacgttacgcgcgacggagtacgtattagtcgtactacgttcggtccgacgtcgttacgtaccacggttctcggtggtaccgg

SEQ ID NO: 29407 - DNA, 753 bp, Homo sapiens
  misc_feature: GYAE6OF01EO4MK.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttctggttacacttccttttaccaccgtacggtatagtaagttggttgacgacgtacgggcccccggagggacggggtcgttggaggtggagtggggagtgggatcgacgtacccgttaacggaaactaaacgagagtagtaggagagtaagtcgaggcagagtcatcatccgacgacgacacgactaccgacgagtacacgacctacgagtaggaacgtggacggtacgcccgttacgaacgtacgtaccgtaacggaacccgtaaccgacccgggtaacccctttaacgttttaaaccgttaccgttaccgggtaccgggtaaccggtaacggtaaaccgggttaaagttttaacccggttacgggtaaccccgtttaacccggggtttaacccgggggtttacccccgttacggggggtttaacccctttaaacccggggtttaaaacccccgggttaacccgggtttacccgggttttcgggggtacccgggggttaaacccccggggg

SEQ ID NO: 29408 - DNA, 671 bp, Homo sapiens
  misc_feature: GYAE6OF01DZ8U9.1.49.E05.1.454.CMB.1.raw
  modified_base (331)..(331): a, c, t, g, unknown or other
  misc_feature (331)..(331): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtgcccactcccaggttcacctggtgcagtctggagctgagctgcagaagcctggggcctcgagtgatggtctcctgcagtgtcttctggttactattctttccaccttacggtatgtagttgttgagacgacggcccccggaggaggggtcttggaggtggagtacgggntggactcgacgtacccgttaacggaaactaaaacgagaagtagtaggagtaaggtagttccgaagggacagtagtacatcaactaccgaaccggcggaaccacgaacctacccgtaacggaacgtaaccgacgaccctaaacgtaacgtacggtaacgtggaacggacgtacctacgaacgtattcgaacgaccgtaaccgaccgggtacccttaacgtttaacgttacgtcgtacgacggtaacgtagtaagttttagtccgtacgtaccgttcgggttaccgttcgggtaccttaacggttaacccgaccggttacggtttgggtacgggtacccggg

SEQ ID NO: 29409 - DNA, 628 bp, Homo sapiens
  misc_feature: GYAE6OF01AOM4C.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatggtctcctgcagtgcttctggttactattctttccaccgtacggtatgtaagttggttgagacgacggccccggaggaggggtcttggaggtggagtgggagtggatcgacgtacccgttaacggaaacttaaaacgaggtaaggtagtaggaaggaaggtaacgttacgagggcaggagtcagtcatccgacgcggacacacgtaccgaacgtacgtaaccacgacctacgagtacggaacgtagggacggacgtacctacgaggacttacgacggaaccgaccggacccggtaccctaacgtttacttacgacggccgacggagtacgtatttacgttcgacctacggttcggtaccgtaggtaccgtacgtacccgaggtcgttcgggcggtaccgg

SEQ ID NO: 29410 - DNA, 610 bp, Homo sapiens
  misc_feature: GYAE6OF01D4I7D.1.49.E05.1.454.CMB.1.raw
  modified_base (600)..(600): a, c, t, g, unknown or other
  misc_feature (600)..(600): n is a, c, g, or t
tcagacgagtgcgtcacgaccggtgctcgatttagagcgactagcaacgacgacaaaggggacccaaaaccacacccctccttgggagaatcccctagatcgacagctcctcaccaatggacgggacctggagcatccttttcttggtggcagcagcaacaggtgcccactcccaggttcacctggtgcgagtctggagctgagctgcagaagcctggggcctcagtgatggtctcctgcagtgcttctggttacatctttccacctacggtatgtaattggttgagacaggcccccggaggaggggcttggagtggagtgggatgggatcgagtacccgttacggaaactaaaacgaggtaagtagtagggaagagtaacgttaccgagggacgagacgtcatcgatccgaccggacggaacacgtacctaccgacgaacgtacgacgacctacgacgtagggaactaggacggacgtcctacgagtacgtcgtacgaacgaccgtaccggtacctacgtttactacgtcgcgtacgaagtagtattgttacgactacggttcggtaccgtggtacgttacgtaaccgacgtcgttggngggtacccgg

SEQ ID NO: 29411 - DNA, 697 bp, Homo sapiens
  misc_feature: GYAE6OF01A33JJ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagctggggctcagtgatggtctcctgcagtgtcttctggttacattcttttccaccttacggtatgtaattgggttgagcgtacgggcccccggaggagggggtcttggaggtggagtgggagtggatcgacggtaccccgttaacggaaacgttaaaaccagaaggttaacgtagggaacgtaaggtaacggttaccgaaggggcaaggagtacgacgtacaactcgaacccgcggaaccactacgtacccgaacgacgtaccgacgcctaaacgacgtaggaacgtaggaacggacgtaccctcgaacgtactacgacgaaccgaccgaaccgggtccctaaccttttaacgttaccgtaggtaccggacggtaacgtagttaaacgtttagtttacgaccggtacggtttcgggttacccgttaggggtacccgtttaaacggttaaccccggaccgggtttaccgtttcggggtcggggtacccggg

SEQ ID NO: 29412 - DNA, 753 bp, Homo sapiens
  misc_feature: GYAE6OF01ELDKB.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgtaattggtgagacacggcccccggaggaggggtcttggaggtgggagtggggatggatcgacgtacccgttaacggaaactaaaaacgagaagtagtagggaagtaaggtaacggttaccgagggacgaaggtacgtacagtacaactaccgaaccggacggtaaccaaccacgtacccgaaccggtaacgtaaccacggaccctaacgtaacgtacgggtaaaccgttagggaacggtacgtacccgtacgaacggacttaccggtaacgaaccggaacccgaaccggggtacccttaaaccgttttaacgtttaaccgtaccgggaccggtaaccgggtaacggtaacggttaaactttttaacggtttcggtaacccgttaaccggtttccgggttaccccggttacgggtaacccgttaccgggttaaaccccgtaccgggttaccggtttaccggggttcgggggtaaccccgggg

SEQ ID NO: 29413 - DNA, 632 bp, Homo sapiens
  misc_feature: GYAE6OF01CGNRN.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgtaattggttgagacgacggcccccgggagacgggggtcttggagtggagtgggagtggatcgacgtacccgttaacggaaactaaaacgagaagtagaggagaggtaagttccgaggcaagagtacatacacgtcaccggacggaaccacgtaactcccgaacgacgtacaacgcctaacagtacggaactggacggacgacctacgaagtactcgtacgacggaaccgaccggtacctaactttacgttaacgtcggaccgcgggaacgtagtaactttacgttcgacttaaccggttcggttacccgtaggtaccgttacggtaaacccctacggtcgtttgggtcggggtacccggg

SEQ ID NO: 29414 - DNA, 811 bp, Homo sapiens
  misc_feature: GYAE6OF01C8QA9.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcgagtgattgggtcctcctgcagtcgtcttcgttcggttactacgtttccttttacccaccgttacggttatagttaagttggttacgacgtaccgaccgggtccccgggaaggtacgggggtcttaggacggtggaggtggggtagtagggtactacgaacggtcccgttaaacggaaaaccgtaaaacgaggtaaggtaggtaggaagtaaaggtaacgttccggaagggtacaaggtacgtataacgtaccgtacgtacccgacccggtacgggaacctaaccgtaacttacccggaacggtaaacggtaacccgaacgggtacccttaaacgacggttacgggaaaccgtggggaacgaacgtaccgtagaacggtagtaccgtaacgggaacccgaacccggaaccgggttaccctaaacggttttacccgtaacggttcggaacccggtaacggtaaccggtaaaggttacgtttaacggttcccggtacgttaacccgggttcggttacccggtgggtttaaccccggttaccggttaaaaccccggtgggtttcccgggttacggggtacgggtaacccccggg

SEQ ID NO: 29415 - DNA, 579 bp, Homo sapiens
  misc_feature: GYAE6OF01AR6K0.1.49.E05.1.454.CMB.1.raw
  modified_base (243)..(243): a, c, t, g, unknown or other
  misc_feature (243)..(243): n is a, c, g, or t
  modified_base (519)..(519): a, c, t, g, unknown or other
  misc_feature (519)..(519): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttntggttacatctttccacctacggtatgaaattggttgagacaggcccccggaggacgggggcttggagtggagtggggatggatcacgcccttaacggaactaaacagagtagaggagagagttccgaggcagagtcatcatacaccgacggacacactccaacgagtaacacgacctacatacgggaacgtggaggacgcctacagtactcgtagaaccgacgaccggtcctaacgtttacttaaccgcgcgtacggagacgtatttaagttcgntaaccgttcgggtccgtacggtaccttacggtaacccgacgttcgttggtcgggtaccgg

SEQ ID NO: 29416 - DNA, 649 bp, Homo sapiens
  misc_feature: GYAE6OF01CPKI7.1.49.E05.1.454.CMB.1.raw
  modified_base (367)..(367): a, c, t, g, unknown or other
  misc_feature (367)..(367): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttcgtggttacattcttttccaccttacggtatggtaatttggttagagtaccgacgggcccccggaggacgggggctttggaggtggagtgggatggatcgacgtcccttaacggaactaaaacngaagtagtaggagagtacgttacgagggcaagagtacatacgatcgaccggcggaacacactaccgacgaagtacgacgtcctaacgagtagggaactggaacggacgaccgtacgaagtactcgtagaaccgaccgaccgggtaccctaacttacgttacgtacggaccggtacgaaggagttagtttacgttacggacttacccgggttcgggttaccctaggggtaccgttaccggtaaacccggtccgtttcggttggggtacccggggttacccggg

SEQ ID NO: 29417 - DNA, 622 bp, Homo sapiens
  misc_feature: GYAE6OF01DGMHG.1.49.E05.1.454.CMB.1.raw
  modified_base (468)..(468): a, c, t, g, unknown or other
  misc_feature (468)..(468): n is a, c, g, or t
  modified_base (532)..(532): a, c, t, g, unknown or other
  misc_feature (532)..(532): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttgggtggcagcagcaacaggtgcccactcccaggttcacctggtgcagtctggagctgagctgcagagccgtggggcctcagtgatggtctcctgcagttgcttcgtggttactacttcttttccaccgttacggttatgtaattggttgaacgtacgacgggcccccgggaggacgggggtcttggaggtggagttggggatggatcgacgtacccgttaacgaaactaaaacgagagtagtaggaagaagtaacggttcgaagggctaaggacgtacatacctagtacgaccggacgacacgataccgagactaacagaccgtanagtagacgtaggacgactcctagagtactcgtacgacgtaccgccgtaccttaacttactacgngacgacgagtacgtagttagttcgaccgtacggttcggttaccgtggacccgttactaacccgtcggttcgtttcgggtcgggtacccgg

SEQ ID NO: 29418 - DNA, 581 bp, Homo sapiens
  misc_feature: GYAE6OF01A1WZ1.1.49.E05.1.454.CMB.1.raw
  modified_base (451)..(451): a, c, t, g, unknown or other
  misc_feature (451)..(451): n is a, c, g, or t
  modified_base (471)..(471): a, c, t, g, unknown or other
  misc_feature (471)..(471): n is a, c, g, or t
  modified_base (559)..(559): a, c, t, g, unknown or other
  misc_feature (559)..(559): n is a, c, g, or t
  modified_base (569)..(569): a, c, t, g, unknown or other
  misc_feature (569)..(569): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggatcatcctttcttggtggcagcagcaacaggtgcccactcccaggttcacctggtgcagtctggagctgagctgcagaagcctggggcctcagtgatggtctcctgcagtgcttctggttacatctttccactacggtatgaattggttgagaccgacggccccccggaggacgggggtcttggaggtggagtgggagtggatcagtacccttaacggaactaaaacgagaagtagtaggagtaagaacggttcgaagggactaggagtacgtaagtaatccaaccggacggacacactaccaacgtacgtaacacgacctanagtaggaactgaacgggacnccgtacagactcgagtaccgacgacgacctacttatacgtgcgcgagtagtattattacgctacgtcggtcctaggcttacgtaaccncgtattcggnggtccgtacggg

SEQ ID NO: 29419 - DNA, 640 bp, Homo sapiens
  misc_feature: GYAE6OF01CTGGG.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattccttttccacctacggtatgaattggttgagacaggccccccgggagacgggggcttggagtggatggggatgggatcgaggtccccttaacgggaaaccttaaaaacgacggaagttagtaggggaaggaaggtaaacgtttccgaaggggtcaggagtcaatcatccgaccgcggaaccacatacccgaacgaagtaaccacgacctaacacgtaggaactgggacgacgtcctacgagactcgtacgtaccgacgaccgggacctacgtttattaccgttggccggtaccgaaggtagtatttacgttacgactaccggttcggttcccgttcgggccgtttaccggtaaccctaccggttcgtttgggtggggttaccccggg

SEQ ID NO: 29420 - DNA, 526 bp, Homo sapiens
  misc_feature: GYAE6OF01BD727.1.49.E05.1.454.CMB.1.raw
  modified_base (407)..(407): a, c, t, g, unknown or other
  misc_feature (407)..(407): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacaggcccccggagaggggcttgagtggatgggatggatcagcccttacggaactaaacagagtatggagagaagttcagggcagagtcatcatcaccgcggacacatccacgagtacagcctanatggaactggaggagcctcagatcgtagaccgacacggcctacttattacctgccgcgagagtattattcgatacgtcgggtcctgggtctacggtaacccagtcttggtgggtaccgg

SEQ ID NO: 29421 - DNA, 645 bp, Homo sapiens
  misc_feature: GYAE6OF01C2SC0.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtgcagcagcaacaggtgcccactcccaggttcacctggtgcagtctggagctgagctgcagaagcctggggcctcagtgatggtctcctgcagtgcttctggtacattctttcacctacggtatgtaattggttgagtacacgggccccccggaggacggggtcttggagtggagtgggagtgggatacgagtacccgttaacggaaacctaaaacgaagagttagtagggagtaggaacgttccgaagggcaggacgtcatacatcaccggtcgaacacactccaacgacgtaccagacctaacagtacggaactaggacggacgtacccgtacaacgtactacgtaaggaccgaacggaccgggtacctaacgtttaacttaaccgtggaccggtaccgtaagtaacggttattaagttcgacgttaaccggttcgggtacccgttacgggtaccttaaccggtaaacccgtaccggtacgttgggtcgggtaacccggg

SEQ ID NO: 29422 - DNA, 701 bp, Homo sapiens
  misc_feature: GYAE6OF01D76CT.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacggacctggagcatcctttcttggtggcagcagcaacagtgcccactcccaggtcacctggtgcagtctggagctgagctgcagaagccgtggggcctcagtgatcggtctccgtgctagtcgtcttcgtggttactacttccttttaccaccttacggtatgtaagttggttgacgacgaccgggcccccgggaggacgggtcgttggaggtcggtagtgggagtggatccgtaggtaccccgttaacggaaaactaaaacggagtaaggtaagtaggaagtaagtaacggttacccggagggtaaccgaggacgtacgagtccgaacgtaccgaccggtaacggaacctaccactacccgaacggtaacgtaacgtacgacctaacgacgtacgggaacgtggaacggtacctccgtacggtaatacgtcgacgaaccgtaaccgtaccggtaccttaaccgttacttacgacggtccggaacggtaacgtacggttattacgtacggacttaacggttccggttaccggttgaccgttaccggtaaaccgtaccggttcgttagggcccggttaaccggg

SEQ ID NO: 29423 - DNA, 656 bp, Homo sapiens
  misc_feature: GYAE6OF01DPUPK.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcacctggtgcagtctggagctgagctgcagaacgccgtggggcctcgagtgagtggtctcctgctagtcgtcttcgtggttacacttcttttaccaccgttacggtatagtaattggttagagacgacgggccccggaggaggggtcttggaggtggagtgggagtggactcgacgtacccgtaacgaaactaaaacgaagtagtacgtaggagtaagtacgttccgaagggtacaaggtagtacgatacgtacgtaccgaaccggcggaacacgaacgtacccgaagtaacgtaaccacggaaccctagacgtacgaacgtacgaggacgtcctagacgtagtcgacgaaccgaccgacggtccttaactttacgtacgttacggacgtacggaagtacgtaagtttacgtacgtacgttacgttcgggtaccctggaccgttaacggtaacccacgttacggttggacgggtacccg

SEQ ID NO: 29424 - DNA, 611 bp, Homo sapiens
  misc_feature: GYAE6OF01BMGJR.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacttacggtatgtaagttggttgagacgacgggcccccggaggaggggcttggaggtggagtggggatgggatcaggtaccccgttaacggaaactaaaacgagagtagtaggagagaagttccgagggacagagtacatcatacgaccggaccggaccacacgtccaacggacgtaacacgaccctaacagtacgggaactaggaaggacgccgtacgagtactcgtacgaaccgaccgaaccgtacctaactttacgttacgtcgacggcgaagtacgtaatttagtcgtacgtacgttcgggttccgtggtacgtacgtaaccgacgtcgttgggtgggtacccggg

SEQ ID NO: 29425 - DNA, 566 bp, Homo sapiens
  misc_feature: GYAE6OF01BT0LB.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacacggcccccggagaggggcttgagtggagtgggatggatcacgtcccttacggaaactaaacagagtagtaggagagaagttcgagggcagagtcatcatcgacgcggacacactccgacgagtacacgcctaacgagtaggaactggacggacgcctacgagatcgacgacgacgaccggacctactttactactcggccgtcgagtacgtagttacgtcggtacctacgttcggtcctaggtcctacggtaaccacggtcgtttgggtcgggtacccgg

SEQ ID NO: 29426 - DNA, 597 bp, Homo sapiens
  misc_feature: GYAE6OF01BR8N9.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggttacattctttccacctacggtatgtaattggttgagacgacggcccccggaggaggggcgttggaggtggagtgggagtggagtcgacgtacccgttaacggaaactaaaacgagaagtagaggagagaagttcgagggcagagtacatcatacgacgcgacacactcacgacgtacacgacctaacagtaggaactggacggacgaccgtacacgtactcgtaacggaccgtaccggaccggtacccgttaactttacgttacgtcgaccggcgtaagagtaagtttagtcgtactacggttggtccgtggtccttacgtaacccgacgtcgttggtcgggtaccgg

SEQ ID NO: 29427 - DNA, 694 bp, Homo sapiens
  misc_feature: GYAE6OF01BG759.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtcgcccactcccaggttcacctggtgcagtctggagctgagctgcagagcctgggcctgagtgatggtctctgctagtcgcttcgtggttactattcctttaccaccgtacggtatagtattggtagagacgtacggccccggagacgggtctggaggtggagtgggagtggacgtcgacggtacccgttaacggaaaaccgtaaacgaggtaagtaggtaggaaggtaacggtaagttaccggaagggtacgaagtacggttacgattacgacgtacgaccgtacggaacactactaccgacgtacgtacgacggtacctaacgacgtagaaccgtaggacggacgtccgtaagtacgacttacgaacggaacccgtacgacccgggtaaccttaacgtttactaccggtacggtacggtaacgtaacggtacgttaacgtttacgtcgtaccgttacggttccggtaccggttacggaccggttaacggttaaccccgtagggttcccgttaggggttcgggtaaaccccggg

SEQ ID NO: 29428 - DNA, 679 bp, Homo sapiens
  misc_feature: GYAE6OF01EIR7A.1.49.E05.1.454.CMB.1.raw
  modified_base (220)..(220): a, c, t, g, unknown or other
  misc_feature (220)..(220): n is a, c, g, or t
  modified_base (285)..(285): a, c, t, g, unknown or other
  misc_feature (285)..(285): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtgcccactcccaggttcacctggtgcagtctggagctgagctgcagagccgtgggcctnagtgatggtctcctgcagtgtctttcgtggttacattctttcctacctacgtatagtaattggtnagtacgacggccccggagaggggtctggaggtcggagtggatggacgtcgacgtacccgtaaacgggtaaactaaaacgtagaagtaagtagggaagaaggtaaggttaccgtaagggacgtaaggtagttactacgacgtccgaccgacggtacactaacgtaccgaacgtacgaactacggaccttaagacgtaaggtaacgtaggaacggacctacgtacgacgtaactcgtacgaaccgaaccggaccggtacccttaaccttacgttaacgtacgacggtaccgtaagtagttacgttaagtcgtaccgtacggttaccggttccttacgggtaccttaaccggttaaccgtacggttaccgtttggggcccgggtactaacccggggg

SEQ ID NO: 29429 - DNA, 931 bp, Homo sapiens
  misc_feature: GYAE6OF01EDTFZ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcactttccttttcgttgggtggcacgcgacgaccaaacgtaggtccgaccctaccctcccgtacggtttccaccgttggtgctagttcgtgggagtcgtggacgcgttggacgaaggaaccgtccgggttcggggcccttacgaggtagtagttcggttcctccgtgcgtaggttcgttccgttttcgttacggtttacctacttttcccttttaccccgaaccgtttaacggttattacgttaaggttttgggttacgacggaccgtaccccggggacccccgggtaaggggtacgggggttcgtttagggtagggttacggggtagggttagggggtagttacgggtaacgttaccggtaaccggttaaccccggtttaaaaccgggtaaaaaccttaaaaagggtaacggtaaaggtttaacggtaggggtaaaacggtaaacgggtttaacggttacccgggaacggggtaacgtaacggtaacggttaacctaacgtttaccgtaaacgttaccccggaacccgggttaacccgggaacctaaacccgttaccgtaaccccggtaaacgggtaacccgtaaccgtaacccgtaccctaaggtaacggtaacgggtaacccggtaggacgggtacctaccgtagtacgtacgtcgtaaccggacccgaacgtaccggtaaccctttagttacgttacgacgcgtaacgagtacgttagtttacgtcgaccgttacggttcggtaccggttacgtccgttaacccgtaccgtaggttcgttgggtccggtaacccggg

SEQ ID NO: 29430 - DNA, 696 bp, Homo sapiens
  misc_feature: GYAE6OF01C0ES7.1.49.E05.1.454.CMB.1.raw
tcagacgagtgcgtcacgaccggtgctcgatttagagcgactagcaacgacacgaaagggtaccaaaaccacgacccctccttgggagaatcccctagattccgacacgcgtcctcaccatggacgggacctggacgcatccttttctggtgcagcagcaactagggtacgcccactcccaggttcacctggtgcgagtctggacgctgagtcttggcctaggtaacgccgtggggcctcgagtgactacggtccctaccgtcgctagtcgtcttcgtggttacctaattctttaccgaccgtacggtactcgtaagttcggtgtacgacgcggccccggaggtacgggtctaggacgtggtagtcggagtggactacacggtaccccttaacggaaacctaaaacgagtaacggtacgtagggaacgtaaggaacgtttccgaacgggacgtaacgtaacgtacgtaagtaccaacgtaccgtaccgtcggttaactaccgtacgtaccgtacggacgtaaccgacgaccgtaacgacgtacggaacgtacggaaggacgtccgtacgacgtactcgtacgaaccgaccgtaccggtacctaacgttacgttaccgtcgaccgacgtacgtagtacttagttcgactacgtcggtccgtaggcgtaccgtaccaggtacgttcggtcggtaccgg

SEQ ID NO: 29431 - DNA, 626 bp, Homo sapiens
  misc_feature: GYAE6OF01AT5NJ.1.49.E05.1.454.CMB.1.raw
  modified_base (238)..(238): a, c, t, g, unknown or other
  misc_feature (238)..(238): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcngtgcttctggttacattctttccacctacggtatgtaattggttgagtacgacggcccccggaggaggggtcgttggaggtggagtgggacgtaggagtcgacgtaccgtaacggaaactaaaacgagtaacgtagtaggaagtaggtaacgttaccgagggactaagacgtacgatacgactacgaccggacggacacgtacgtaccaacgacgtacgacgtaccctaacgagtaacggaacgtcggaacggtcgacctacgacgtactcgtagaccgaaccgaccgtcctaacttagtacgtgaccgtacggtagtaacgtaattacgtcgactacgttcggtcctggtacctacgtaacccgtagtccgttgggcgggtacccgg

SEQ ID NO: 29432 - DNA, 524 bp, Homo sapiens
  misc_feature: GYAE6OF01EOMM8.1.49.E05.1.454.CMB.1.raw
  modified_base (410)..(410): a, c, t, g, unknown or other
  misc_feature (410)..(410): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccaccttacggtatgaattggttgagacaggcccccggagagggcgttgagtggatgggatggatcagtccttacggaactaaaacagagtatggagagaagttccgaggcagagtcatcatcacgcgacacatccacgagtacagcctanataggactgaggagcctacgagatcgtagacgacgacgcctacttatactgcgcgagacgtattagtcgacacgtggtccgtggcgtacgtaaccacgtcgttggtgggtaccg

SEQ ID NO: 29433 - DNA, 606 bp, Homo sapiens
  misc_feature: GYAE6OF01C4KCQ.1.49.E05.1.454.CMB.1.raw
tcagacgagtgcgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttcacgtacggtatggtaattggttgagacacggccccggagagggcttgagtgagtggatggatcagccgttaacggaaactaaaagagtagtagtggaagagaagtccgagggacaggagtcgatcgatccgaccgagggaacaacgactaccgaacgagtaaccagtaccctaacgaattacgggaactgggaacggacgaccgtacgagtattcgaggaacccgaacgaaccggtccctaaacgtttactttacacggacggtacggaagacgttaattagttacggactacgttcgggtccctagggtactaacgtaaccccgaagttcgttgggtcgggtaccgg

SEQ ID NO: 29434 - DNA, 676 bp, Homo sapiens
  misc_feature: GYAE6OF01B2D8Y.1.49.E05.1.454.CMB.1.raw
  modified_base (246)..(246): a, c, t, g, unknown or other
  misc_feature (246)..(246): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcagtggggcctcgagtgatggtctcctgcagtgcttntggttacattccttttccacctacggtatgtaattggttagacgtacgacgggccccggaggacggggtcttggaggtggagtgggagtggatcgacgtacccgttaacggaaactaaaacgaggagtagtaggaagaggtaagttccgaagggactagacgtacatacaacgtccgaaccgtacgacacacgtaccgaacgtagtaccgacgtacctacagtacggaactaggaacggtacgccgtacgagtacgtacgtacgaacggaccgaacccggtaccttaaccgtttacgttaccgttacggacccggtaacggaacggtaaggttaacgtttacgtacggtaccgtaccggttccgggtacccgttacgggtacccgtttaacggtaaacccgtacccggttcgtttacggggtacccgggg

SEQ ID NO: 29435 - DNA, 709 bp, Homo sapiens
  misc_feature: GYAE6OF01DUHGV.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtcgcccactcccgaggttccacctggtgcagtctggagctgagctgcagagccgtgggcctcagtgagtggtctcctgcagtgcttcgtaggttactattccttttcctaccgttacggttatagtaagtttggttagagaccgtaccgggcccccgggtaggacggggtcttaggtaggtggagttgggatggatacgacgtacccgttaaacggaaaccgtaaaacgaggtaacgtagtacggaaggtaagaaggttaccgagggacgaagtagtactagtacactaccgaccggaccggaacactacgtacccgaagtacgtaaccgacggacctaagtaagtacggaacgttcggaacgggacctccgtagaagtactcgtacgaaccgtacgacccggtaccttaacttaacgttacgtacggaccgtacgaaggtagttaaatttacgttcggtaccttacgggttacccggttccggttaagggtacccgtttaacggtaaacccggttaccggttacggtttacgggtcgggtacccggg

SEQ ID NO: 29436 - DNA, 681 bp, Homo sapiens
  misc_feature: GYAE6OF01EB4YR.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatggtctccgtgcagtgtcttctggtactattcctttccactacggtatgtaattggttgacgacgacggcccccggaggacggggtcgttggaggtggaggtgggagtgggactcgacgtacccgttaacggaaactaaaacgacgtaagtagtagggaaggaagtaacggttacgagggacgaggagtacactacgacgtaccgaccggacggaaccactaactacccgaacgtacgtaacgacgtacccgtaacgtaacgtacgggtaaccgtaggaacggacgtaccctacgaacgtacgtcgtaacggaccgaaccggaccggtaccttaacgtttacgttacgtacggaccggacggtagtaagtaagtttacgtacggtacctacggttccggtccgttcggtaccgttaacgtaacccgtacggttcgttgggtccgggtacccggg

SEQ ID NO: 29437 - DNA, 546 bp, Homo sapiens
  misc_feature: GYAE6OF01BD363.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacacggcccccggagaggggcttggagtggagtgggatggatcagccgttacggaactaaacagagtatggagagaagttcgagggcagagtcatcatcaccgcggacacatccacgagtacacgcctaacagtaggaactggaacggacgacctacgagactcgtcgaaccgacgacggcctaattacttacgtgcgcgagagtattagttgtactacgtcggtccgtcggactacgtacctagtcgttgggtcggtaccgg

SEQ ID NO: 29438 - DNA, 660 bp, Homo sapiens
  misc_feature: GYAE6OF01BO7EK.1.49.E05.1.454.CMB.1.raw
  modified_base (406)..(406): a, c, t, g, unknown or other
  misc_feature (406)..(406): n is a, c, g, or t
tcagacgagtgcgtcacgaccggtgctcgatttagagcgactagcaacacacaaaggggacccaaaaccacaccctccttgggagaatcccctagatcacagctcctcaccatggacgggacctggagcattccttttcttggtggcagcagcaacaggtcgcccactcccaggttcaccgtggtgcagtctggagctgagctgcagagccgtgggcctgagtgagtggtctcctgctaggtgtcttcgtggttactattcctttccacgttacggtataggtaagttggttagacgacgaccgggccccgggaaggtcggggtacttggacggtggagtagggagtaggacttcgacgttacccgtaaggaaactaagagtagtagaggaagagtaagtcgaggngtagagtacacgtcactaccgacgacgacacataccgaagtagtaccacgtacctaagtagtacgggaacgtaggaacggacgtccgtaagacgtacgttccggaagacccggaacctaccgggtaacccttaacggtttaacttacggtggaacccggagtaaacgagtttaacttacggtgtaaccaggttcccggttacgtggttaccgtaccggttaacccgtggtaccgggtttggtacgggtacccgg

SEQ ID NO: 29439 - DNA, 705 bp, Homo sapiens
  misc_feature: GYAE6OF01EUD0Q.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtgggcctcgagtgatggtctccgtgactgtgtcttcgtggttactattctttccacgtacgtatgtattggtgagtacgacggccccggaggacggggtcgttggaggtgggagtggggagtggactcgtacgacccgtttaacgaaacgtaaaacgagtagtagtacgggaagtaacggtaacgttccggaaggaccgagtacgtacgattacgacgtaccgaccggtacgtaacaaccgtaacctaccgaacgtaacgtaacacgtacttaacgacggtacggaacgtaggacggacgtccgtagaactacgttacgtaacggaaccggacccgtaccggtaacccttaacgttaaccgttagtaccggacggtaacgtaacggttaacgtaagttttacggacgttaacgtaccggtttcggttaccggtacggtacccgttaacggtaacccgtaacgggtttccgttacggggtagggttaaccccggg

SEQ ID NO: 29440 - DNA, 606 bp, Homo sapiens
  misc_feature: GYAE6OF01BLGL0.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagccgtggggcctcagtgatggtctcctgcagtgtcttcgtggttactattctttccaccgttacgtatgtaagttggttagagacgaccgggcccccggaggtacggggtcgttggaggtggaggtgggtagtggtatccgacgtacccgttaacggaaactaaacgagtagtagtaggaagaagtacgtacgagggacagacgtacatacgacgtaccgaccgacgacacgtactaccgacgacgtacgacgtacctaacgagtacggaacgtaggacgacgccgtacgagtacgtcgtacgaccgaccgacggtacctacgttacgtacgacgacgagagtagtagttagtcgtatacggtcgtccgtgacgtacgaccgtgtcgttggtcggtacg

SEQ ID NO: 29441 - DNA, 524 bp, Homo sapiens
  misc_feature: GYAE6OF01BBHUS.1.49.E05.1.454.CMB.1.raw
  modified_base (452)..(452): a, c, t, g, unknown or other
  misc_feature (452)..(452): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (487)..(487): a, c, t, g, unknown or other
  misc_feature (487)..(487): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgacgactaggcccccggagaggggcttggagtggatgggatggatcgagtcccttaaggaactaaaacgagagtatggagagaagttccagggcagagtcatcatcaccgcggacacagtccagacgtacagcctaacagtcggaactggagtagcctacagatcagacgacncggtaccattactacngccgngagagattagtcgnacgtcgtcctggctacgaaccaggcttggcggtaccg

SEQ ID NO: 29442 - DNA, 588 bp, Homo sapiens
  misc_feature: GYAE6OF01C8VA2.1.49.E05.1.454.CMB.1.raw
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctggttacatctttccacctacggtatgaattggttgagacaggcccccggaggagggtcttggagtggatgggatggatcgacgtcccttaacggaactaaaacgagtagtaagtcggaagagaacgttccgagggcagagtcatcatcacggcgacacgatccgagagtacgancctaanagtagaacgtggaaggacaccgtacgaggtactcgtaggaaccgaccgaaccgggtacctacgtttaagttaccgcggacgacggagacggtattacgtcgactaccgttcggtaccgtggtaccttaacggtacccaacgttcggttcgggcgggtacccggg

SEQ ID NO: 29443 - DNA, 602 bp, Homo sapiens
  misc_feature: GYAE6OF01A51OO.1.49.E05.1.454.CMB.1.raw
  modified_base (536)..(536): a, c, t, g, unknown or other
  misc_feature (536)..(536): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagacgtacgggccccccggaggtacgggggtcgttggaggtgggagtggggtagtggactacgacggtaccccgttaacggaaaacgtaaaacgaggaggttaagtagggaaggaaggaaggtttccgaagggcaggagtcatcagtaccaccgcgacacactccaacgagtacacgcctacagtaggaacgtggacggacgtcctacagacgtacgtgaaccgacgaccgtaccctagttacttacgcgcgngagagtattagtcgagtacgttcggtccgtggacttacggtaacctacggtcgttggtgggtaccg

SEQ ID NO: 29444 - DNA, 628 bp, Homo sapiens
  misc_feature: GYAE6OF01ESX0I.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggtgcagctggtgcagtctggggctgaggtgaagaagcctggggcctcagtgaaggtctcctgcaaggcttctggatacaacttcaccgcctcctatatacactgggtacgacacggcccctggacaaggactttggagtggatgggatggatcgaacctaaagtggtggcacaatctctgcacagtaactttcgaagggctgggtcacatcgaccgagggacacgtccaataccaaaacgcgccctctcgtaggacgcgtagaaccagacctgaagtactcgtacggaaccgaacgaccgggtccgttagttaactttacgtggtacggacggaaggacggtaacggggttaacctaacgtacgttacgggttcgtacggggtaccggttaccgggtacggggggtacccgaaacgggggtaccccgtaccgggttcccgaaccccggttacccg

SEQ ID NO: 29445 - DNA, 601 bp, Homo sapiens
  misc_feature: GYAE6OF01BIYKO.1.49.E05.1.454.CMB.1.raw
  modified_base (404)..(404): a, c, t, g, unknown or other
  misc_feature (404)..(404): n is a, c, g, or t
  modified_base (457)..(457): a, c, t, g, unknown or other
  misc_feature (457)..(457): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (513)..(513): a, c, t, g, unknown or other
  misc_feature (513)..(513): n is a, c, g, or t
  modified_base (535)..(535): a, c, t, g, unknown or other
  misc_feature (535)..(535): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcagtgatcggtctccgtgcgagtgtacttctggttacattccttttccacctacggtatgtaattggttgagacgaccgggcccccggaggaggggtcgttggaggtggagtgggatgggatcgacgtaccccgttaacggaaacctaaaacgagagtagtaggagagtaaggttcgaacgggtnaaggacgtacatcactccgaccggcggacacactaccagactacgacgcctanagtgaactggaggcncccngagtctcgcgacgacgaccggtacctatttactacgngaccgaggagtagttaacgttnttaccgtactacggttcggttcccgtaggtcgtacggtaccctagggtctggggttcgtacccggg

SEQ ID NO: 29446 - DNA, 823 bp, Homo sapiens
  misc_feature: GYAE6OF01CU26K.1.49.E05.1.454.CMB.1.raw
  modified_base (524)..(524): a, c, t, g, unknown or other
  misc_feature (524)..(524): n is a, c, g, or t
tcagacgagtgcgtcacgaccggtgctcgatttagagcgactagcaaccacacaaaggggacccaaaaaccacacccctccttgggagaatcccctagatcacagctcctcaccatggacgggacctggagcattccttttcttggtggcagcagcaacaggtcgcccactcccacggttcaccgtggtgctacgtcgtggagctgagctgcagagccgtgggcctgagtgagttcggtctccgtgcgtagttcgtcttcgttacggttactacttttccttttacccgtaaccgttacggttaagttagtttaagttttgggttacggaacggtaaccggtaccggggacccccggggtaagggtacgggggttcgttagggtacggttaggggtagtagggggtagtacgggtaacgtcggaacccggttaacccggttaaacggaaaaacgttaaaaccggaggttaaacggtaaggtagggaaacgtaaggtaaggttaccgaaggacgtaagtacgtanacgtacgtaacgacgtaacccggacgtaaccgaacgtacgtaccccgaaggtaaacggttaacaaccgtaccgttaaacggagttaacgggtaacgtaggtacggactacccgtacgaggttaactccgtaacggaccgtacccgtaaccggttacctaaaccgttttacgttaccggacggtaccgaacggtaaggtaaacgttacgtttagggtaccgtacgttaacggttccggttacggtaccggccgttttaaaccggaacccgttaggtccgggtttgggacggggtacccgg

SEQ ID NO: 29447 - DNA, 617 bp, Homo sapiens
  misc_feature: GYAE6OF01BSIFP.1.49.E05.1.454.CMB.1.raw
  modified_base (257)..(257): a, c, t, g, unknown or other
  misc_feature (257)..(257): n is a, c, g, or t
  modified_base (609)..(609): a, c, t, g, unknown or other
  misc_feature (609)..(609): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcgagaacggcctgggggcctcgagtgatggtctcctgcagtgcttcgtggttacnttcctttccactacggtatgtaattggtagagacacgggccccggaggacggggtcttggaggtggtagtggggatgggactcgacgtaccccgttaaggaaactaaaacgacgtaagtagtaggagaaggaacgttacgagggacaggagtacaagtcactaccgaccggacgaccacacgtccgaacggtacgtacgaccgtactacaaggtcggtaaacgtggaacggacgtcctacgagacgttcgtaagaacccgacgaccgggtaccttaacgttattacgcgcgacgaagtacgtaattgtcgactacgtcggtaccgtggtacctcgtaaccgtgtcgttgggnggtaccgg

SEQ ID NO: 29448 - DNA, 582 bp, Homo sapiens
  misc_feature: GYAE6OF01EWI1V.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgtaattggttgagacgacgggcccccggaggagggggtcttggaggtgggagttggggatggatcgacgtcccgttaaggaaactaaaacgaggagtagaggaagagtaagttccgagggcgagagtcatcagcgaccgcggacacactccgacgacgtacacggcctacgagtacggagtaggacggactccgtacgagtcgtcacgacgaccgacgacctaacttagttacacggcgtagagtagtattagtcgtactacggtcgttacgtcggtacgtacgtaccgacggttcgttggcggtaccggg

SEQ ID NO: 29449 - DNA, 628 bp, Homo sapiens
  misc_feature: GYAE6OF01DYJMZ.1.49.E05.1.454.CMB.1.raw
  modified_base (561)..(561): a, c, t, g, unknown or other
  misc_feature (561)..(561): n is a, c, g, or t
  modified_base (620)..(620): a, c, t, g, unknown or other
  misc_feature (620)..(620): n is a, c, g, or t
tcagacgagtgcgtcacgaccggtgctcgatttagagcgactagcaacacacaaaggggacccaaaaaccacacccctccttgggagaatcccctagatcacagcctcctcaccatggacgggacctagagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagtacgacgggcccccggaggacggggtcttggagtggagtgggacgtggatacgacgtacccgttaacgggaaacttaaaacgagtaacggtagtagggaagaaggtaacgttacgaagggtacaaggtagtacgaattacaactccgaaccggtacggaacaacctactacccgaacggtaacgtaaccgaacgacccttaacaggttacggaaacgtaggaacggtacgccctagaacgattacgtcgaacgacaaccgggtcctaacttattacngcgagtagatagttacgtgactagttcggtactggtactacgtaacctacgtcgttggnggtaccgg

SEQ ID NO: 29450 - DNA, 717 bp, Homo sapiens
  misc_feature: GYAE6OF01BKP70.1.49.E05.1.454.CMB.1.raw
  modified_base (241)..(241): a, c, t, g, unknown or other
  misc_feature (241)..(241): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatcctttcttggtggcagcagcaacaggtgcccactcccaggttcacctggtgcagtctggagctgagctgcagagcctgggcctgagtgagtggtctcctgcagtgcttntggttacattcgtttccactacggtatgtaattggttgagacgacggaccccggaggacgggtcttggagtggagtgggagttggatccgacgtacccgttaaacggaaactaaaacgagtaagtaagtagggaagaacggtaacgttaccgaaggggtacaaggtacggttaccaagtaccgtaagtaccgaccggaccgggaccaacgtactacccgaacggtaacgttaaccgacggtaaccctaacgtaacgtacggggaaacgttcgggaacggtaacgccccgttacgaaggtaacgttaccggtacggaaaccgtaccgaaccgggtaacccttaaaccgtttacgtaccgtacggaccggaacggtaagtacgttaatttacggttacgtaccgtaccggtttcgggtaccccttaggggacctttaccggaaacccgttaggttcccgttgggtcggggtaacccgg

SEQ ID NO: 29451 - DNA, 666 bp, Homo sapiens
  misc_feature: GYAE6OF01C691K.1.49.E05.1.454.CMB.1.raw
tcagacgagtgcgtcacgaccggtgctcgatttagagcgactagcaacgacacaaaggggacccaaaaaccgacacccctccttgggagaatcccctagatcacagctcctcaccatggacgggacctggagcatcctttcttggtggcagcagcaacgaggtcgcccactcccaggttcaccgtggtgcagtctggagctgagctgcagacgccgtggggcctcgagtgtatggtcctccgtgcagtcgcgttcgtggttactacttccttttacccgaaccgttacggtagtagtaacgttggttagacgaccgaccgggacccccggagggtacgggtcgttggtaggtggtaggtagggagtggacgtacgaccgtacccgtaacgaaacctaacgagtagtagaggacgagacggtacgaggcagtcgtacatacgactaccgaccgacgaccacgtaccgtaccgacgtacgtacaccgtacctaacgacgtacgaacgtacggacggtaccgacctacgacgactaccgacggaccgaccgaccgtaccttacgttacgttacgtacgacggtacgtaagtattacgttacgtcgtacgtacggttcgtacccggttagtacccgtacgtaccgtacgttcgttgggtcgggtacccgg

SEQ ID NO: 29452 - DNA, 769 bp, Homo sapiens
  misc_feature: GYAE6OF01CU4IR.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcctttccacctacggtatgtaattggttgagacacgggtcccccggaggacgggggtcttgagtggagtgggatggatcacgccttaacggaaactaaaacgagagtatagggaagaggtaagttccgagggacaggtagtcaatctatacgaccggtcggaactaacacgttacccgaacggtacgtaaccaacgtaccctaacgaacgttacgggaaaccttcgggaaacgggtaacgtacccgtaccgtaagtaacgttaccgtaacggaacccggtaacccgaaacccggggaccctttaaacccgtttaaacgtttacccgttacgggacccgtaacgggtaacgggtaaacgttaagggttttactttaaccgggtaccgttaacccgggtttacccggggtttaccccggttaccggggttaacccgtttaacccgggttaaaaccccccgttaccggggttttaaccccggtttcggggggtttcccgggggttaaaccccccgggg

SEQ ID NO: 29453 - DNA, 641 bp, Homo sapiens
  misc_feature: GYAE6OF01BFWQN.1.49.E05.1.454.CMB.1.raw
  modified_base (245)..(245): a, c, t, g, unknown or other
  misc_feature (245)..(245): n is a, c, g, or t
  modified_base (489)..(489): a, c, t, g, unknown or other
  misc_feature (489)..(489): n is a, c, g, or t
  modified_base (632)..(632): a, c, t, g, unknown or other
  misc_feature (632)..(632): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggacctcagtgatggtcctcctgcagtgcttntggttacattcttttaccaccgttacggtatgtaatttggtgagtacgacggcccccggaggagggtcttggaggtcggagtgggagtggatcgtacgtacccgtaaggtaaactaaaacgagtaacgtagtaggtaagaacggtaagttcgaagggacgtaaggagtacaatacgactacgacccgacgaaccgacactacgacgaagtacaacgactaacagtacggacgtagacggaaccnctacgagtacctaggtaccgaaccgaccgtaaccggacccttaacgtttacgttactcggaccggtacgtagacgtaaagtttcgtcgactaacggttcggtccctaaggccgttaacggtaaccgtcgtacggtttcggggnggtacccgg

SEQ ID NO: 29454 - DNA, 718 bp, Homo sapiens
  misc_feature: GYAE6OF01D4XZL.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtggggcctgagtgatggtctcctgcagtgcttctggttacattcttttccacctacggtatgtaagttggttgagacgacgggcccccggaggtacggggtcttaggaggtgggagtggggtatgggatccgacggtacccgttaacggaaactaaaacgaggtaagtagtagggaagaaggtaacggttaccgaagggcaaggtagtactatacgtactaccggaccggacggaaccacgtaacctacccgaacgtacgtaacgaaccgtacccgttaacaacggttacgggaaacgttgggaaacgggtaccgacccgttaccgaaggtacctacggttacggaacccgtacggaacccggtacccttaacgtttactaaccggttcggccggtaggacgtaagttaagtttacgttcgggtactacgggttccggtcccggttaagggtcccgttaaccgggtaacccgtaccggtttccggttcgggtcgggtaacccggg

SEQ ID NO: 29455 - DNA, 659 bp, Homo sapiens
  misc_feature: GYAE6OF01DWO55.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctccgtgctagtgcttcgtggttactattcctttcccaccgttacggtatagtaacgttggttgagtacgaccggcccccggaggacggggtcttggaggtggtagtgggagtggatcgacgtacccgttaacggaaacctaaaacgaggtagtacgtagggaagtaaggtaacgttccggaagggacaggtagtacagtacataccgaaccggcgaacacactccgaacgtacgtacgaacgtacctaacgagtacggaacgtaggacggtacgtccgtacgagactacgtacgaaccgaaccgtaccgggtaccttaacgtttactaccgtcggaccgtaggaacgtagtacgttacgtcgtacgtacggttccggttaccgtcggtaccgttaccgtaaccgaccgttcgttcgggtcgggtacccgg

SEQ ID NO: 29456 - DNA, 685 bp, Homo sapiens
  misc_feature: GYAE6OF01DS6AE.1.49.E05.1.454.CMB.1.raw
  modified_base (602)..(602): a, c, t, g, unknown or other
  misc_feature (602)..(602): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcctaggttcacctggtgcagtctggagctgagctgcagaagcctggggcctcagtgatggtctcctgcagtgcttctggttacattcttttccacctacggtatgtaattggttgagacgacggccccccggaggacggggtcttggtaggtgggtagtggggagttggatcgacgtacccgttaacggaaacctaaaaacgaggtaagtaagtagggaagtaaggtaacggttaccgaagggtacaaggtaagtaccaagttacctaacgtccgtaacccgggacgggaaccaaccgtacgtacccgaaacggtacgtaacccaacggtaccctaacgtaagtacgggaactagggaacggacgtccctaacgaagacgtcgtacgaaccggtaccgaaccgggtacctaacgtttaacttaccgtagaccggngaacggtacgtaatttacgtcgtacctacggtcggttcccgtggccgttacggtaacccgtaccgtcgttggtcggtacccgg

SEQ ID NO: 29457 - DNA, 616 bp, Homo sapiens
  misc_feature: GYAE6OF01A0OIK.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgtaattggttgagacgacgggcccccggaggacgggggtcttggaggtggagtggggtatggatcgacgtaccgttaacggaactaaaacgagagtagtaggaagagaacggttcgagggacaggagtcatcagtcgaccggcgaacacacgtaccgaacgagtaccgacgacctaagagtaggaacgtaggacggacgtccgtacgacgtacgtacgtacgaaccgaccgacggtaccctaacgtttagtaccgtgccggagtaacgataagttacgttcggactacggtcggttaccgtcgggtactacggttaacccgcggttcgttaggtcgggtaacccg

SEQ ID NO: 29458 - DNA, 609 bp, Homo sapiens
  misc_feature: GYAE6OF01ACVZD.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggaggaggggcttgagtggagtggggatggatcgagcccttacggaactaaaacagacgtatggagagaacgttccgagggcagagtcatcatcgaccgacgggacacacgttccaacggacgtaccagacctaacgagtgggaacctggacgggagccctacgagactcgtagaaccgacgaaccgggtacccaacgtttacttacgtcggaccgtacggacggtaaggattttagtacggtcctaacgttcgggttccccgtgggtacccgttacggttaaaccccgaccggttcgtttgggtccgggtaccgg

SEQ ID NO: 29459 - DNA, 600 bp, Homo sapiens
  misc_feature: GYAE6OF01A1JA5.1.49.E05.1.454.CMB.1.raw
  modified_base (452)..(452): a, c, t, g, unknown or other
  misc_feature (452)..(452): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgagtggtctcctgcagtgcttcgtggttacattccttttccaccgttacggtatgtaagttggttgagacgacgggcccccggaggaggggtcgttggaggtggagtgggatggactcgacgtacccgttaacggaaactaaaacgagagtagtaggaagagtaacgtcgagggacaggagtacagtcataccgacgcgacacgtactacgacgagtacacgacctanagagtaacgtaggacgacgcctacgagtactcgtacgaaccgaccgacggtacctaactttacgtacgtcgaccgtaggtaagtagtagttagtcgacgtacgtcggtaccgtgtaccttacggtaccctaggtcgttggcggtacgg

SEQ ID NO: 29460 - DNA, 614 bp, Homo sapiens
  misc_feature: GYAE6OF01EOYXY.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgaattggtgagacacggcccccggaggaggggcttggaggtggagtgggatggatcgagtacccgttaacggaaactaaacagtagtagtggagagaagttcgaggcagagtcatcatacaccgacggacacactaccaacgacgtaacacgacctaacgacgtaggaacgtaggaacgggacgtccctacgaagacgtacgtacggaaccgaacgaccggtacctaaccgtttaacttaccgtacgaccggacggaagtagtaactttagtcgtacgtacgttcgggttacccgtgggtaccgttacggtaacccgtacggtcgtttgggtcgggtacccgg

SEQ ID NO: 29461 - DNA, 564 bp, Homo sapiens
  misc_feature: GYAE6OF01AV8AB.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgagtggtctccgtgcagtgtcttcgtggttacattccttttccaccgtacggtatgtaattggttgagacgacgggcccccggaggaggggtcttgaggtggagtgggtatggatcgacgcccgttaacggaactaaacgagagtagtggagagaagtcgaggcagtagtacatcatcgaccgacggacacactccgacgacgtacacgcctaacagtacgggaactggacggacgcctacagactctgacgacgacgacctacttattacgtgcgacgagagtattagtctacgtacgtcggtaccgtggccgtacgtaccgacgtcgttggtggtaccgg

SEQ ID NO: 29462 - DNA, 535 bp, Homo sapiens
  misc_feature: GYAE6OF01AN0CB.1.49.E05.1.454.CMB.1.raw
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
  modified_base (435)..(435): a, c, t, g, unknown or other
  misc_feature (435)..(435): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccactacggtatgaattggttgagacaggcccccggagagggggcttgaggtggatgggatggatcagcccttacggaactaaaacagagtaatggagagaagttccgagggcagagtcatcatacgaccgcgacacatccacgagtacagcctanatgaactgagacncctgaganctgacgacacggcacttatactgcgcgagacgtattacgttcgacacgttcggtcctagggtccttacggtaaacccacggttcttgggtcggggtaccg

SEQ ID NO: 29463 - DNA, 770 bp, Homo sapiens
  misc_feature: GYAE6OF01CT7JL.1.49.E05.1.454.CMB.1.raw
  modified_base (660)..(660): a, c, t, g, unknown or other
  misc_feature (660)..(660): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgacgagacgtccggtcgggcctgtagtgagttggtcctccgtgacgtagtcgtcctttcgttacggttactacttttacccttttaccgaaccgttaggtattagttaaggtttgggtagaacgacggacccggggccccggtaagggcggggtcttagggagtaggtaggtagggtagtacgggtactaccgtaaccggttacccgttaaacggaaaacgttaaaacgaggtacgtaagagggaagtaagtacggtacgaaggcgaaggtacgtacacgtacgacgtacccgaccgggacgtaaccaacgtaccgtaccgaaggtaacgtaccgtaaccgaccgttaacgaacggtttaaccgggaacgttagggaaacggtccctaccgttaagacgtaccgttacgggaaccgaaccggtaccggtaaccccgtacttaaccgtttagttacccgngggaaccggaacggtaagtaaacggtttattacggtcggaacccgtttcgtcgggttcccgtggttaaccgttaccggtaccgtcggttcggttgggaaccggttcccgg

SEQ ID NO: 29464 - DNA, 674 bp, Homo sapiens
  misc_feature: GYAE6OF01CASSJ.1.49.E05.1.454.CMB.1.raw
  modified_base (222)..(222): a, c, t, g, unknown or other
  misc_feature (222)..(222): n is a, c, g, or t
  modified_base (607)..(607): a, c, t, g, unknown or other
  misc_feature (607)..(607): n is a, c, g, or t
tcagacgagtgcgtcacgaccggtgctcgatttagagcgactagcaacacacaaaggggacccaaaaaccacacccctcttgggagaatcccctagatcacagctcctcaccatggacgggacctggagcatcctttttcttggtggcagcagcaacaggtcgcccactcccaggttcaccgtggtgcagtctggagctgagctgcagacgccgtgggcctnagtgagtggtcctcctgcagtcgtctttcgtggttacattccttttccaccgttacggtatagtaattggtgagtacgacgggcccccggaggaggggtcttggaggttggaggtagggagtggatcgacgtacccgttaaacggaactaaaacgagtagtaagaggtaaggaagtaacgttcgaagggctaggagtacgatacgtacgtaccgaccggccggaactaccgtactaccgaacggtaacgtaaccgaacggtaccctaagacggttaagggaacgtagggacgaccgtccgtaacgagtacgtacgtacggaaccgaccgtacggtaccttaacgtttacgtacgtcgacgcgtaagtacggtattagttaccgtntaaccggttcggtaccgttcggtacgttacggtaaccccgtaggttccggttgggcgggttaccggg

SEQ ID NO: 29465 - DNA, 654 bp, Homo sapiens
  misc_feature: GYAE6OF01COH19.1.49.E05.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (247)..(247): a, c, t, g, unknown or other
  misc_feature (247)..(247): n is a, c, g, or t
  modified_base (386)..(386): a, c, t, g, unknown or other
  misc_feature (386)..(386): n is a, c, g, or t
tcagacgagtgcgtcacgaccggtgctcgatttagagcgactagcaacacacaaaggggacccaaaaccacaccctccttgggagaatccctagatcacagctcctcaccatggacgggacctggagcatccttttcttggtggcagcagcaacaggtgcccactcccaggttcacctggtgcagtctgganctgagctgcagagcctggggcctnagtgatggtctcctgcagtgcttctggtacnttcttttcacgtagtatgtaattggttagagacgacggccccggaggacggggtcttggagtggagtgggatggatcagtccttaacggaactaaaacgaggtagtaagtggaaagagtaacgtccgaggcagtacgtnatcactcgaccgacggacactactccgaacgtagtaacacggacctaacgacgtacgggaacgttaggaacgggactaccctacggaagtacgtaccgtacgaaccggtaaccgacccgggtacccttaacgttacgttaaccgtcggacggaccgaaggtaacgttacgtttaacgttccgtaccgtacgtttcgggtaccccgttacgggaccttaaccgggttaacccctaacggttccggtttacggggtccgggtaacccggg

SEQ ID NO: 29466 - DNA, 827 bp, Homo sapiens
  misc_feature: GYAE6OF01B09NB.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgagtggtctccgtgcgtagtcgtcttctcggttactactttccgttttacctaccgttacggtactaggtaacgtttggttagaacggacggtaccgggacccccgggagggacgggggttcgttagggtaggtacggggtaggttacggggtagtacgggtacgttaccgtaaccggttaaccccggttaaaacggtaaaaccgttaaaaacgacgggtaaaggttaacggtaagggtaaaggtaaacgggtaacggttacccggaaggggacgtaaggtacgtactacgtacgtaccgaccggtaccggaccgaaccgaacctaaccgtaccgtaaccgtaacgtaccaacgtacctaacgtaagtacgggtaaccgtaggaaccggtacgaccgtaacgaaggtaccttacggacggtaaccggaacccgtaaccgggtaacccgtttaaacgtttaaccgttaccggtaggtaacccgtaacgggtaacgttacgtaagtttaccggtttcggacgttaaccggttcgggttccggtacggttaaccgttaaccggttaaccccggtacggttaccggttggggtacgggtaccccggg

SEQ ID NO: 29467 - DNA, 650 bp, Homo sapiens
  misc_feature: GYAE6OF01EJWHR.1.49.E05.1.454.CMB.1.raw
  modified_base (360)..(360): a, c, t, g, unknown or other
  misc_feature (360)..(360): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacattcttttccaccttacggtatgtaattggttgagtacgacgggccccccggaggaggggtcttggaggtggagtgggatgggatcgagtccgttaacggaactaaacgngagtatggagagtaagtacgagggacaggagtacatcgatcgaccgcggacactactaccgacgacgtacacgacctagagtaggaactggacggacgcctagacgtactacgtacgaaccgaaccgtaccgggtcccttaacgtttacgtaacgtacggaccgtacgggaacgtaaggttaacgtttacgttacggtaccgtaaccgttcggggttaacccgttaggggtacccgttaaccggtaaacccgtaccgggttcggtttacgggtcggggttaacccccggg

SEQ ID NO: 29468 - DNA, 634 bp, Homo sapiens
  misc_feature: GYAE6OF01E4NS6.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtggggcctcgagtgagtggtctcctgcagtgcttcgtggttactattccttttccaccgttacggtatgtaagttggttgagacgacgggcccccggaggacggggtcgttggaggtggagtgggagtggatcgacgtaccttaacggaaactaaacgagagtagtaggagagtaacgtcgaggcgagagtacatacgactacgaccgacgaccacactaccgacgtagtaccagacctagacgtacggaatgggacgacgtcctacgatacgtcgtacgaaccgaccgtaccggtacctactttacgtacgtacggaccgtacggagtacggttaagttacgtcgtacgtacggttcggttacccgtaggtacccgttaaccggtaacccggtaggttcgttcgggtcgggtaccccggg

SEQ ID NO: 29469 - DNA, 624 bp, Homo sapiens
  misc_feature: GYAE6OF01BJI90.1.49.E05.1.454.CMB.1.raw
  modified_base (615)..(615): a, c, t, g, unknown or other
  misc_feature (615)..(615): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgagtcggtcctccgtgcagtcgtcttcgtaggttactacttccttttaccgaccgttacggtatagtagttggtagacgacgaccggaccccggagggacgggtcgttaggaggtggaggtgggtatggatccgacgtaccgttaacggaaactaaaacgaggaacgtagtaggagaaggtaacgttcgaggacgaggtacgtacagtactactaccgacggaccgaacacctaccgtaccgaacggtacgtacgaccgtactaacgacgtaggacgtaggacggtacgacctgacgactcggacacgaccgacgtacctaattctacgcgcgagtagtagtattgacgctacggttcgacggtcacgttacgacccgtagtcgttgggngtacccggg

SEQ ID NO: 29470 - DNA, 571 bp, Homo sapiens
  misc_feature: GYAE6OF01AMD2F.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgaattggttgagacacgggcccccggaggagggggtcttgagtggagtgggatggatcagcccttaaggaactaaaacagagtagtggagagaagttccgagggcagagtcatcatcaccgcggacacactccgacgagtacagcctacagtggaactggacggacgcctagagatcgtcggaaccgacgacgggtccctaacttacttacgtacgcgtacggagtagtaattacgttcgactacggttcggtccgttcggacgttacggtaacccacggtctttgggtcgggtacccgg

SEQ ID NO: 29471 - DNA, 683 bp, Homo sapiens
  misc_feature: GYAE6OF01B3F39.1.49.E05.1.454.CMB.1.raw
  modified_base (254)..(254): a, c, t, g, unknown or other
  misc_feature (254)..(254): n is a, c, g, or t
  modified_base (394)..(394): a, c, t, g, unknown or other
  misc_feature (394)..(394): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctctgcagtgtcttgtggttactnttctttccaccgtacgtatgtaagttggttagacgacgacggaccccggaggacgggtcttaggaggtggagtgggagtcggtatcgacgtacccgttaacgaaactaaacgagagtagtaggagagtacgtacgagganagtacgtacacgtacacgtacgaccggtacggaaccaccgtactaccgaacgtaacgtaccgaacggtactaacgaggtaacggaacgttacggacggtactaccgtagacgtacgtcgtaacggaaccgtaaccggaccggttaaccctaagtttacgtaccggttggaacccgtagggtaacgtaacgttacggtttaagtccggaccgttaacggttcgggttcccgttacggtacgttaaaccggtacccttaacgggtcggtttcgggtccgggtaacccgggg

SEQ ID NO: 29472 - DNA, 610 bp, Homo sapiens
  misc_feature: GYAE6OF01BLTTD.1.49.E05.1.454.CMB.1.raw
  modified_base (437)..(437): a, c, t, g, unknown or other
  misc_feature (437)..(437): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagccgtggggcctcagtgatggtctcctgcagtgcttctggttacacttctttccaccgttacgtatgtaattggtgagacgacgggcccccggaggacggggcttggaggtggagtgggagtggatcgacggcccgttacggaaactaaacgagagtagtggaagaggtaacgttcgagggcaggagtacatcatccacggcgacacactaccgagtagtacagtccaanagtaggactaggacggacgccgtagagactcgtacgaacgtaccgaccgtaccttaacttacttacgtacgaccggtacgaacgtagtaactttacgtcgtaccgacgttcgggttacccgtagggtaccgttacggtaacccgtacggttccggttgggtcgggtacccggg

SEQ ID NO: 29473 - DNA, 630 bp, Homo sapiens
  misc_feature: GYAE6OF01ET580.1.49.E05.1.454.CMB.1.raw
  modified_base (224)..(224): a, c, t, g, unknown or other
  misc_feature (224)..(224): n is a, c, g, or t
  modified_base (622)..(622): a, c, t, g, unknown or other
  misc_feature (622)..(622): n is a, c, g, or t
tcagacgagtgcgtcacgaccggtgctcgatttagagcgactagcaacacacaaaggggacccaaaaaccacacccctccttgggagaagtcccctagatcacagctcctcaccataggacgggacctggagcatcctttcttggtggcagcagcaacaggtgcccactcccaggttcacctggtgcagtctggagctgagctgcaggaacgccgtggggcctnagtgatggtctcctgcagtgtcttcgtcggttaccattcctttccaccgttacggtatgtaattcggttgacggacgacgggcccccggagggacggggtccgttggacgggttgggagtcggggtagtgggaacgtcgacgtccccgttaaacggaaactaaaacgaggtaagtagtagggagagtaacgtcgagggtacagagtcgatcatcgacgcgacaccatccgagtacgtacacgtacctagtaacgtacgggaactacgggaggtaccgcccgtagtaacgacgtcgtacgaaccgaccgaccggtacctaactttactacgacgtcgacggtagacgttattagtcgactacgtcggtctaggacgttaccgtaacgacgtcgttcggnggtaccgg

SEQ ID NO: 29474 - DNA, 799 bp, Homo sapiens
  misc_feature: GYAE6OF01DX81A.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatgggacgggacctggagcattccttttcttgggtggcagcagcaacaggtcgcccactcccaggttccaccgtggtgcagtctggagctgagctgcagaacgccgtggggcctcgagtgagtggtctccgtgcgagttcgtcctttcgttaggttacctactttcctttttacccgaaccgttaacgggtttataggttaaagttttggggttacggaacggtaccggaccggggtaccccccgggtagggaacggggggttcgtttagggtagggttagggacggtttgggggtaattggggaacttaccggaaccggttaaccccgttaaaacggggtaaaaaccttaaaaaccggtagggtaaacggttaacggtaaggggtaacggtaaacggtaaacgttaccgggaacggggaacctaggtaacggtacctacgtacgtaactaccggtacccgggacggaaccacgtaacgacccgtaacggtaacgttaccacgtaaccctaacgtagtacggtaacgtacggaacggccgtacctacgagaccgttcgacggaacgaaccgaccggttacccttaagtttacacgttcggaccggtaacgagtacgttattacggtacgcgtacgttcggtcgtcgtacgttacccgtaacgtacgtcggttggtccgggtaccgg

SEQ ID NO: 29475 - DNA, 836 bp, Homo sapiens
  misc_feature: GYAE6OF01ECHO0.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttgggtggcagcagcaacaggtcgcccactcccgaggttcacctggtgcagtctggagctgagctgcagagccgtggggcctcagtgagtggtcctccgtgcgtagtcgtcttcgtggttacctactttcctttaccaccgttacggttattagtaagtttggttaggacgaccggtaccgggcccccgggtaagggtacgggggtcgttagggacggttggtaggtggggtactgggtacgtacgtaaccggtacccgttaaacggtaaaacctaaaacgtaggtaacggtaagtagggaaggtaacggtaacggtttaccggaacggggtaacgtacggtaacggttaccaaggttaccgtaacgttaccccggaacccgggtaccggtaaccgtaaccgtaacccgtaaccgaaccgggttaacgtacccgtaaccgtacccgttaaccgaaggttaccggtaacgtacgggaacggtaccgtccctacgaacggtctacggtaacgaaccggacccgtaaccgggtaccctttaacgttaacgttaccgtacggtaacccggtaggaaccggtaaacgttaacgtttaccggccggttaaccgttaccgggttccggttacccgggttcggtaacccgttaccgggttaaacccgtcccggtttacgggttccgggtaccggggtacccggg

SEQ ID NO: 29476 - DNA, 683 bp, Homo sapiens
  misc_feature: GYAE6OF01C4LV8.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgagtggtctcctgcagtgcttcgtggttacattccttttaccaccgttacggtatagtaattggttgacgacacgggcccccggaggtacggggtcttaggaggtggtagtgggtatgggatcgacgtacccgtacggaaactaaacgagtaagtagtaggagaagtacgttccgaggcgagtagtacatcactacgaccgtcggaactacacctaccgtacgacgtaacgacgtacctaacgagttacggaacgtaggaacggaccgtacctacgaacggtattaccgacgaaccgaccggaaccgggtaccctaactttaacgttaaccgtcggaccggaccggtaaggtagttaacgttagtttaccgtaccgtacgggttacccggttacccggtacggttccgttaaaccggtaacccgtacgtttccggttaggggtccggggtaacccggg

SEQ ID NO: 29477 - DNA, 590 bp, Homo sapiens
  misc_feature: GYAE6OF01CFZY9.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcacccatggacgggacctggagcatccttttcttggtggcagcagcaacaggtgcccactccccaggttcacctggtgcagtctggagctgagctgcagaagcctggggcctcagtgatggtctcctgcagtgcttctggttacagttcttttccactacggtatgtaattggttgagacgacggcccccggaggaggggcttggaggtggacgtgggatggatcgagtcccgttaaggaactaaaacaggaacgtagtaggagaagagttccgaagggtcagacgtcagtacgactcgaccgcggaaccaccgactacccgaacgacgttaaccacggaccttaacgacgtacggaaacgtgggaacggacgtaccctacgaagactcgtagaccgacgaccggcctaacttatacgtcgacgcgagtatattgtgctacgttcgtcgtagccttacgtaccgagtcgttggcggtaccg

SEQ ID NO: 29478 - DNA, 613 bp, Homo sapiens
  misc_feature: GYAE6OF01DC3GV.1.49.E05.1.454.CMB.1.raw
  modified_base (475)..(475): a, c, t, g, unknown or other
  misc_feature (475)..(475): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgacagagccgtggggcctcagtgatggtctccgtgcgagtgtcttgtggttactattccttttccaccgttaggttattgtaattggtgaagacgtacggccccggagacggggtcttggacgtggagtgggagtggatcgacgtccttaaacgaactaaacgagtagtagtaggagtagacgttacgaggcagagtcatcatcgacgcgaacactacgaccgaagacgtacgacgtccaagacgtagggacgtaggaacggtactcccgtanaagtacgtctaggacctacggaccgggtaccttaacgttattaaccgtcggacgcgtaggacgttattacgttcgacctaggttcggttcgtaccggtcgtttaaccggaacctacggtcgtttgggccggtaccggg

SEQ ID NO: 29479 - DNA, 711 bp, Homo sapiens
  misc_feature: GYAE6OF01DREIQ.1.49.E05.1.454.CMB.1.raw
  modified_base (253)..(253): a, c, t, g, unknown or other
  misc_feature (253)..(253): n is a, c, g, or t
  modified_base (690)..(690): a, c, t, g, unknown or other
  misc_feature (690)..(690): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttgggtggcagcagacaacgaggtcgcccacctcccgaggttcaccgtgggtgcagtctggagctgagctgcaagtaacggccgtggggcctcgagtgatcggtctccgtgcngtcgtcttcgttggttactcttcctttaccaccgttacggtatagtagttggttagacggaccggaccgggtccccggagggtcggggtcgttaggacggtggacggtgggagttggactacgtaacgtacccgttaaacggaaaccgtaaaagtaggtaacggtaacgtagggtaacgtaagggtaaccgttacggaacgggacgtaaggtacgtacgagtaccgtaacgtaccgacccggtaccgggaactaaccgtaaccgtacccggaacgtaacgtaacgacccgacgtaacgaaggtacgaacgtagggacgtacgtcctagtatacgttacgagaaccgacgtaccgtacctaagttacttacgcggaccgtgaagtgtaagttctacgacgtacgtcgggttcgtacggttaccgtaacgttaacccgngttccggtgggtccgtaccgg

SEQ ID NO: 29480 - DNA, 676 bp, Homo sapiens
  misc_feature: GYAE6OF01C6CL3.1.49.E05.1.454.CMB.1.raw
  modified_base (445)..(445): a, c, t, g, unknown or other
  misc_feature (445)..(445): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctccgtgcagtgcttcgtgttactattcttttaccaccgttacggtatgtaattggttagagtacgacgggcccccggaggacggggtcttaggaggtggagtggggagtcggatcgacgtacccgttaacggaaactaaacgagtacgtagtaggagtaaggtaacgttccgaggtacaggactacactactacgtacccgaccgggacgaacctanaccgtaccgaacgtaacgtacgaccgacctaacgagtacggtaacgtggaacggcgtaccgtacgagtactcgtaacggaccgtaaccggaccgttaccctaacgtttacgttaccgtgggaaccgacggtaagtacgttaacgtttagtccgacgttacggttccgggtaccgttacggtacccgttaacggttaaccccgtacggttcgttacggggcggtaacccggg

SEQ ID NO: 29481 - DNA, 617 bp, Homo sapiens
  misc_feature: GYAE6OF01A9R8C.1.49.E05.1.454.CMB.1.raw
  modified_base (452)..(452): a, c, t, g, unknown or other
  misc_feature (452)..(452): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcctttccacctacggtatgtaagttggttgagtacgacgggtcccccgggaggacgggggtcgttggaggtggtagtgggagtggatcgacgtaccgttaacggaaactaaaacgagaagtagtaggaagagtaacgtcgaggacaggagtacatacatacgaccgacgacacactaccacgtagtacacgacctaanagtacggtaacgtggaaggtacgaccgtacgaaggtacgtcgtacggaaccgaccgaccggtaccttaacgttactacgtcgacggacggtagacgtatttacgtcgtactacgtcggtaccgtggtacttacggtaacccacggttcgttgggtcggtacccgg

SEQ ID NO: 29482 - DNA, 662 bp, Homo sapiens
  misc_feature: GYAE6OF01A3Z3P.1.49.E05.1.454.CMB.1.raw
  modified_base (248)..(248): a, c, t, g, unknown or other
  misc_feature (248)..(248): n is a, c, g, or t
tcagacgagtgcgtcacgaccggtgctcgatttagagcgactagcaacacacaaaggggacccaaaaaccacacccctccttgggagaatcccctagatcacagctccctcaccatggacgggacctggagcatccttttcttggtggcagcagcaacaggtgcccactcccaggttcacctggtgcagtctggagctgagctgcagaagccgtggggcctcagtgagtggtctcctgcagtgccttntggttacattcttttccacctacggtatgtaattggttagagtacgacgggacccccggaggaggggtcttggaggtggagtgggagtggatcgacgtaccgttacggaactaaacgagagtagtaggagagacgttcgaggacaggacgtcgatacgactcgaccggtcggacacgactaccgaacgagtaacacgaccttaacgagtaacgggaactcggaaggacgtaccctagacgtacttacgacgaaccgaaccgaccggtaccttacgtttaacttaccgtacggccgtacggtaagtacgttaagttaacgttcggacgttaccggttcgggttaccccgtacgggtaccgttaaccgggttaaccccgtacgggtttaccggttgggttccgggggtaaccccgg

SEQ ID NO: 29483 - DNA, 666 bp, Homo sapiens
  misc_feature: GYAE6OF01D3QSJ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgctttctggttactattcttttccaccgttacggtatgtaagttggttagagtacgacgggcccccggaggtacgggggtcttggaggtggtagtgggatggatcgacgtacccgttaacggaaacgttaaaacgaggtagtagtgggaaggaaggtacggttaccgagggaccaggtacgtacactcgactaccgaacccggtcgggaaccacgactaaccgacggtaacgtacgacgtacctaacgaggtacgaacgtaggacgggtaccgcctacgagaattccgaagacccggaaccgacccggtaccttaacttacgttacgtcggacggaccgtaagacgtaagtttgttacgacgttacgttcgggtaccgtcggtacgttactaacccggtacgttcggttcggggtcgggtacccggg

SEQ ID NO: 29484 - DNA, 801 bp, Homo sapiens
  misc_feature: GYAE6OF01AKE4J.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcaccgtggtgcagtcgtggagctgagctgcagaagccgtggggcctcgagtgagtggtctccgtgctagtgtcttcgtggttactactttccttttacccaccgttaccggtattacgtaagtttcggttaggaacggtaccggaccggggtaccccccgggaagggtggggggtaccgttcggtagggtagggtacggttcggggagttagggacgttaccgtaccggtaaccccggttaaacggtaaaacgttaaaaacggaggtaacggttaaggtagggtaaggtaacggtaacgttaccggaagggtacgaggtaacgtacgtacgtacgtaccgtaccgacccggaccggacctaacgtaccgtacccgtaaccggtaacggtacccgtaaccgtaaccgttaacgtaggacgggtaacgtacgggaaccggcttacccggtaagacgtcgttaccgacgggaaccggaacccgtacggtaacccttaaacggtttccttaccgaggacccgtaggaagtacggttaattaggttcctacggtaccggttccggttcccgtaggtacccgtttacccggtaacccgttccggtacggtttcggggcccgggttaccggg

SEQ ID NO: 29485 - DNA, 716 bp, Homo sapiens
  misc_feature: GYAE6OF01CFD88.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggttacattcttttccacctacggtatgaattggttagagacgacggcccccggaggaggggtccttggaggtcggagtggggatgggatcgacgacccgttaggaaacctaaaacgagtagtagtaggaagtaaggaacgttaccgagggcgaaggagtacagtcaatccgaccggtacggaaccacgtatacccgaacggagtacacgtaccctaacagtacgggaaacttggaacggacgtacccgtacgaacggtaacgttccgtaacggtaaccggaacccgtaacccggggtaccccttaaaccgttttaacgtttaacccggtacggtaaccgggccgttaaaagggtaccggtaaactttaaggtttccgaacccgttacggttccgggttacccgttcgggtacccgtttaccgggtaaaacccctcgggttaccctttcggggtcggggtaaaccccggg

SEQ ID NO: 29486 - DNA, 674 bp, Homo sapiens
  misc_feature: GYAE6OF01ASE1Z.1.49.E05.1.454.CMB.1.raw
  modified_base (221)..(221): a, c, t, g, unknown or other
  misc_feature (221)..(221): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctnagtgatggtctcctgcagtgctttcgtggttactattccttttcctaccgtacggtatagtatttggttgagaccgacgggacccccggaggacggggtcttaggaggtggaggtgggtagtggatcgacgtaccgttaacggaaactaaacgagtagtagtaggagaagtacgttcgagggacaggagtacatacgactacgaccggacggaacacgactaccgaacggacgtaccgacgtaccctacgaacgttacggaacgtaggaacgggacgtacccgtacgaacgtacgtacgtacggaaccggaccgtaaccggtaccttaacgtttaaccgttaccgtacgtaccgggacgtaaggtagttaagtttacgttcgtaccgtacggttcggtacccgtcggtaccgttacggtaacccgtaccggtcggtttgggtccgggtaccgg

SEQ ID NO: 29487 - DNA, 544 bp, Homo sapiens
  misc_feature: GYAE6OF01EN1C4.1.49.E05.1.454.CMB.1.raw
  modified_base (441)..(441): a, c, t, g, unknown or other
  misc_feature (441)..(441): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggcttgagtggatgggatgggatcgagcccttaacggactaaaacagagtaatggaagagaaacgttccagggcagagtcatcgatcgaccgcgacacatcccagacgtacacgcctacgatgaacctggacgaggccctanagactcgtcgaaccgacgaccggaccctaacttacttactgcgcgaagagtattagtgctacgtcggtccctaggcctagaacccacgtcgttgtcgggaccg

SEQ ID NO: 29488 - DNA, 706 bp, Homo sapiens
  misc_feature: GYAE6OF01B7GUC.1.49.E05.1.454.CMB.1.raw
  modified_base (385)..(385): a, c, t, g, unknown or other
  misc_feature (385)..(385): n is a, c, g, or t
tcagacgagtgcgtcacgaccggtgctcgatttagagcgactagcaacacacaaaggggacccaaaaaccacacccctccttgggagaatcccctagatcacagctccctcaccatgggacgggacctggagcattccttttcttggtggcagcagcaacaggtgcccactcccaggttcaccgtggtgcagtctggagctgagctgcagaagccgtggggcctcgagtgagtggtctccgtgctagtgtcttcgttggttacatttccttttccaccgtaggtatagtaagttggttagagacgacgggccccggaggacggggtcttggagtggagttggggatggacgtcgaacggtcccgttaaacggaaacttaaaacgnggtaagtaagtagggaagtaaggtaacggtttccggagggacaaggacgtactaagtacaacgtaccgaccgggaccggaacacctaacgtcccgaaggaacgtacgacgtaccctaacgtaagtacgggtaacgtagggacgggtaccgaccgtagacggtaactacgtacggaaacccgacggaacccggtacccttaacgtttacgttaccgaggaccgtaggtaaggtacgttaagttacgttcgaccgtacggttcggttaccgtaggtaccgttaaccggtaaccgtcggttaccggttggggtcggtacccggg

SEQ ID NO: 29489 - DNA, 627 bp, Homo sapiens
  misc_feature: GYAE6OF01E4FP1.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattccttttccaccttacggtatgaattggtgagacgacggcccccggaggaggggtcttgagtggagtgggagtggatcgacgtacccgttaacggaactaaaacgaggagtagtggagaaggtaacgttcgagggacagtagtacatcatcgaccggacgtacacactccgaacgacgtacgacgtccgtaacagtaggaactcggaggacgcctacgaacgtatacgtacggaacgaccgaccggtaccctaacgtttaacttaccgtcggaccggtacggaaggtagtaatttacgtcgtacgtaaccggttcggttccgtacggtaccgttacggtaaccccgaacggttcgtttcgggtcgggtacccgg

SEQ ID NO: 29490 - DNA, 952 bp, Homo sapiens
  misc_feature: GYAE6OF01EC2XM.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttgggtggcagcagcaacaggtcgcccactcccgaggttcaccgtggtgcagtctggagctgagctgcagacgccgtcggggcctcgaggtgagtcggtcctccgtgccgaggtcgtcgtttcgtcggttactactttccttttacccgaccgttaacggtagttacggttaagttgggtttagaacggtacccggtacccgggggaccccccgggtaaggggtacgggggttccgttagggtacggggttagggtaacggttagggggtaagttacggggtaacgttacccggtaaacccggttaacccccgggtttaaaaacccgggtaaaaaaccgttaaaaaacccggaagggttaaacggttaaacggttaaacggggaaacggttaaacgggttaaaccggtttacccgggaaaggggtaaccgtaacggtaacgtaccgtaacgttaccgtaacggtaacccggaacccgggaaccgggaacctaaaccgtaaccgttacccggaaaccgggtaaccgttaacccgtaaccggtaaccccgttaaacgacggttaacgggtaaaccggtacgggtaacgggaacccgtacccgtaacgggaacttaccgttacccggaaacggtaacccggaaccccggtaacccggttaacccgttaaacctttaaccggttaccggaccgggaaccgtaacggttaagtaccggttaattaccggttcgtaaccggttaccggttccggaacccggttggtaaccgttaaccggtaacccggttagttcgggtttcgggacggtaaccccggg

SEQ ID NO: 29491 - DNA, 606 bp, Homo sapiens
  misc_feature: GYAE6OF01ESW9G.1.49.E05.1.454.CMB.1.raw
  modified_base (406)..(406): a, c, t, g, unknown or other
  misc_feature (406)..(406): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatggtctccgtgcagtgcttcgtggttacattcttttccaccgttacggtactgtaattggttgagacgacggcccccggaggagggcgttggagtggagtgggagtggatcgacgtacccgttaacggaaactaaacgacgagtagtaggagaggtaagtccgagggacagagtcactnactcgaccggtacggacaccgactacgacgacgtacgacgactacgagtacgaacgtacgacggacgtccgacgagtactcgtacgaacgaccgacgtaccttaacttacgtacgcggcgacgtaacgtagtagtttacgtcgacgtacggttcgtaccgtgtaccgttacgaccgtacgttcggttcgggcgtaccggg

SEQ ID NO: 29492 - DNA, 672 bp, Homo sapiens
  misc_feature: GYAE6OF01A6W7O.1.49.E05.1.454.CMB.1.raw
  modified_base (274)..(274): a, c, t, g, unknown or other
  misc_feature (274)..(274): n is a, c, g, or t
  modified_base (286)..(286): a, c, t, g, unknown or other
  misc_feature (286)..(286): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctggagctgcagaagccgtggggcctcagtgatggtctctgcagtgcttctgttacattccttttaccaccttacggtntgtaattggttnagtacacggcccccgaggagggtcttggacgtggagtgggatggatcgacgtcccttaacggaaactaaacaggtagtaatgggaagaggtaacgttaccggaagggtacaggagtacagtacataccgaccggacgggaccactaccgtaccgaacggtacgtaaccacggtaccctaactacggtacggaaacgttagggaacggaccgtccgtacgaacgtacttacgtaccgaacggtaccgaaaccgggtcccttaacggtttaaccttacgtcggaccgtacggacgttaagtagtttaacgtcgactaccggttcgggttacccgtcggaccgtttaccggtaacccgtaggtccgtttacgggcggggttaaccccgg

SEQ ID NO: 29493 - DNA, 682 bp, Homo sapiens
  misc_feature: GYAE6OF01C0Q6A.1.49.E05.1.454.CMB.1.raw
  modified_base (251)..(251): a, c, t, g, unknown or other
  misc_feature (251)..(251): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagaagcctggggcctcagtgaaggtttcctgcaaggcttcaggatacncttcactaggtatgctatactagttgggtgccgaccgacgggcccccggaagaaaggcttgagtggagtgggtatggatacaacggctggacgtaagtaggtaaacgaactaaaaaacttcgaacgaagtaacgtttaccgagggaccaaggtacgttacctaacccgtttaccgaacggggacctaaccgtaacgtaccccggtacggtaacgggttaattaacgtttaaattacggttaggaacgtcgtaggacggtacctacggtcctaggaagtacgtaaccggaacggtaaccgtacggtacgtttagtaagtttagtttttcgacgtcgtaccgttacgtaggtacgggtaggttactagtttacttacgtcgttactaagtttcgacccgttcgtacggggtaccgtacgggtacccgtacggg

SEQ ID NO: 29494 - DNA, 694 bp, Homo sapiens
  misc_feature: GYAE6OF01DHT2R.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcagtgatggtctcctgcagtgtcttcgtggttacattcttttccacctacggtatgtaattggttgacgacgacggcccccggtaaggacgggggtcttggaggtggagtaggggagttggactacgacgtaccccgtttaacggaaaacttaaaacgagtaagtagtgggaagaggtaagttcggagggacagtagtcagtacacgtaccgaccggacggaacacaagttcccgaacgacggttaacaacgtaccctaacacgtaagggaacgtaggacgggacaccgttacgaagacgtactcgggaaccgtaccgtacccgtacccttaaccgtttacttaaccggttcgacccggtagtacggaagttaacgttacgttccggactacgggttccggttccggtacgggttaccgttaaccggttaaccccgtacggtttaccccgggtttgggtcggggttaaccccggg

SEQ ID NO: 29495 - DNA, 675 bp, Homo sapiens
  misc_feature: GYAE6OF01BNF7L.1.49.E05.1.454.CMB.1.raw
  modified_base (422)..(422): a, c, t, g, unknown or other
  misc_feature (422)..(422): n is a, c, g, or t
tcagacgagtgcgtcacgaccggtgctcgatttagagcgactagcaacacacaaaggggacccaaaaaccacacccctccttgggagaatcccctagatcacagctcctcaccatgggacgggacctggagcatccttttcttggtggcagcagcaacaggtgcccactcccaggttcacctggtgcagtctggagctgagctgcaggaagccgtggggcctcgaggtgatggtctcctgcagtgtcttacgtggttacattccttttccaccgttacggtatagtaattggttgacgacgacgggccccggaggacgggtctggagtggtagtgggatggactcgaacgtacccgtaaacggaaaacgtaaaacgaggtaagtaagtaggaagaaggtaacgtacgaggacagacgtcaancactacgaccggacgaacacgactccgaacgaacgtaacagacctacgagtacgaagtacggaggtacgcctaacgagtacctacgtacggaaccgtaacgaccgggtacccttaacgtttaacgtttaccgacgggtaaccgagggtaacgtaagttaaccgtttagttaccggtaccttacgggttcgtaccccggttgtaaccgtttaccgtaaacccggcgggtttaccgtggggttaccgggacccgg

SEQ ID NO: 29496 - DNA, 664 bp, Homo sapiens
  misc_feature: GYAE6OF01CHW1T.1.49.E05.1.454.CMB.1.raw
  modified_base (465)..(465): a, c, t, g, unknown or other
  misc_feature (465)..(465): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattccttttctggtggcagcagcaacaggtgcccactcccaggttcacctggtgcagtcgtggagctgagctgcagacgtccgtgggcctgagtgagtcggtctcgtgcgtagtcgtcttgtcggttactacttcctttacccgtacgttacggtagtagttaagttggttggaacgaccggaccggggtacccccgggagggtacgggtcgttaggtaggtagggtagtgggtagtacggtacgtacgtaccggtacccgttaaaacggaaacgttaaaacgaggtaagtaggtaggtaagaagtaacggtaccgaaggacgtagacgttacncgtactacgtaccgaccgtacggacaccacgtaccaacgtacgaacacgtacctaacgagtacgacgtaggacgtacgcctagacacgtacgtccgaacgacgtaccgtactacttacgtacgacgcgtagtacgtatagttagtcgacgttcgtcgtcccgtgtacgtaccgttacgacgttgtacggtggtacccgg

SEQ ID NO: 29497 - DNA, 659 bp, Homo sapiens
  misc_feature: GYAE6OF01CPIN4.1.49.E05.1.454.CMB.1.raw
tcagacgagtgcgtcacgaccggtgctcgatttagagcgactagcaacacacaaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctccgtgcagtgcttctggttacattctttaccacctacgtatgtaattggttgagacgacggccccggaggacggggtcttggagtggagtgggagtggatcgacggtacccgttaacggaaactaaacgagagtagtaggaagaggtaagtaccgagggacaggacgtcatacgactaccgaccggcgaacacgactaccgaacgtacgtaacgacgtacctaacgtacgtagggaacgtaggaacggcgtaccgtagaacgtacgtacgtacggaaccgaccgtaaccggtaccttaacgttacttacgtcggtaccgaggtaacgtacgttaagtttacgtacggtaccttacggttcggttcccggttacggtaccgtttaaccggtaaacccgtcggttaccggttgggtccggtacccgggg

SEQ ID NO: 29498 - DNA, 865 bp, Homo sapiens
  misc_feature: GYAE6OF01C4T47.1.49.E05.1.454.CMB.1.raw
  modified_base (196)..(196): a, c, t, g, unknown or other
  misc_feature (196)..(196): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtgcccactcccaggttcacctggtgcagtctgganctgagctgcagagccgtgggcctcgagtgatcggtctccgtgcctagtcgtctttcgtaggttactacttccttttacccaccgttacggttattaggttaacgtttgggttaggaacggtaccggaccggggtacccccgggtaaggggtacgggggtccgtttagggagggtttagggaggttaggggtagttacgggtaacgtaccgtaaaccggttaccccggttaaaacggtaaaaacgttaaaaaccggaaggttaaacggttaaacggttaaggggtaaacgggtaaacggttaaaccgggttacccggaaaggggtaccgaaggtaacggtaccgtaacgtacgtaaaccgttacccggaacccgggtaccggacctaaccgtaccgttacccgaacggttaacggtaacccgtaccggtaacccgttaacgtaacggttacgggtaaaccgtacgggtaacgggaccgtacccgttaacgaacgttacctaccgggtaacgaaccggacccgtaaccggtaccttaaccgtttacgtaccggttacggaccggtaacgtacgggtaaagttacgttaccgttcgtacccgttacggttccgggttaccgttcggtacccgttacggtaacccgtacggttcgttacgggcggtacccggg

SEQ ID NO: 29499 - DNA, 622 bp, Homo sapiens
  misc_feature: GYAE6OF01EMI99.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacattctttccacctacggtatgtattggttgagacgacgggcccccggaggaggggtcttggaggtggagtgggatgggatcgacgtacccgttaacggaaactaaaacgagaacgtagtggaagagtaacgttcgagggcagagtacatcatcgaccgcggacacactccacgagtacacgacctagagtaggaactggacggacgccgtacaagtagtcgacgaaccgaccgaccgggtacccttaactttacttacgtacggaccgtacggtaagtagttaagtttacgttacggacctacggttcgggtacccgttgggtacccgttacggtaaacccgtaccggttccgtttgggtcgggtacccggg

SEQ ID NO: 29500 - DNA, 815 bp, Homo sapiens
  misc_feature: GYAE6OF01DP1B0.1.49.E05.1.454.CMB.1.raw
  modified_base (234)..(234): a, c, t, g, unknown or other
  misc_feature (234)..(234): n is a, c, g, or t
  modified_base (259)..(259): a, c, t, g, unknown or other
  misc_feature (259)..(259): n is a, c, g, or t
  modified_base (305)..(305): a, c, t, g, unknown or other
  misc_feature (305)..(305): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgaaggtttccngcaaggcttcgaggactacaccttnacgtaggtatgtctatactagttgggtgcgccgacggcccccgganaaaggtcttaggacgtggagtgggactggactacgaacgcgtaggacagtaggtaacaaacgtaaaaaacttcaaactaaggtaacggttaccgaagggtacaaggtacgttaccgtaacccgttttaaccggaacgggtaacccgtaactaacgttacccggaacggtaacggggttaatttaacctttaaagtacgttagggtaacggcgtttaacgggaagtaccgtacggtacccgttaggaacggttaccgtaaccgggtaaaggaacccgtacggggtaccgtttaaggtttaccgttttaaggtttttttcggaacggttacccgttaacccggtttaccgttaacggggttacgggtaaggttacccgtttaaaccgttaaagtttttaaccggtttaacccggttaactttaaccgttttaaaccggttttacggaaccccgttttacccggggttaaccggggggtaacccgttaaaccggggggtttaaaccccccggg

SEQ ID NO: 29501 - DNA, 744 bp, Homo sapiens
  misc_feature: GYAE6OF01D8LO6.1.49.E05.1.454.CMB.1.raw
  modified_base (594)..(594): a, c, t, g, unknown or other
  misc_feature (594)..(594): n is a, c, g, or t
  modified_base (731)..(731): a, c, t, g, unknown or other
  misc_feature (731)..(731): n is a, c, g, or t
tcagacgagtgcgtcacgaccggtgctcgatttagagcgactagcaacacacaaaggggacccaaaaaccacacccctccttgggagaactcccctagatcacagctcctcaccagtgggacgggacctggagcattccttttcgtggtggcagcagcaacaggtcgcccactcccaggttcaccgtggtgcagtcgtggagctgagctgcgagaggccgtggggcctgaggtcgagttcggtctccgtagcgtagtcgtctttcgtaggttactactttccgtttaccgaccgttacggtattaggtaacgtttggggtacgacggtaccggaccggggtccccggaagggtacgggtcgttggaggtcggagttgggatcggatcgaccggtaaccgttaaacggaaactaacggagtaggttaacggaggtaacgtacggtaacgtaccggagggtacaggtaactacgtacgtacgtacgtacgacccgaggtaccacgtacctccggaacgacgtacgaaccgtacgtacgaaggttacgggaacgttcggaaacgggtcctaccgacggttaacgtctaaacccgggngtaacccggtacccggaccgggttaacccttaacgttaggttacccacgggtccgaaagtacggttagttattacggaccgttggtaccgtgggttacccgtggtaacccttacggaacttccggttacgggttcgngggtaaaccccgg

SEQ ID NO: 29502 - DNA, 652 bp, Homo sapiens
  misc_feature: GYAE6OF01B2VI9.1.49.E05.1.454.CMB.1.raw
  modified_base (253)..(253): a, c, t, g, unknown or other
  misc_feature (253)..(253): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggttacnttcctttccacctacggtatagtaattggttgagacgacggcccccggaggtaggggcttggaggtggagtgggagtggatcgacgtcccgttaacggaactaaacagagtagtaggagagaagtcgagggcagagtcatcatccgaccgacgacacactccgaacgtagtacacgacctaacaggtacggaacgtgggacggacgccctacgaggtactacgtacgaaccggaccgacccgggtacccttactttaaccgttaaccgtcgggaccggtaacggaacggtaagttaacgtttaacgtacgggtaccttaacggttcgggttccccggttagggtacccgttacgtaaaccccggttacccggttacgtttggggtccggggtacccggg

SEQ ID NO: 29503 - DNA, 888 bp, Homo sapiens
  misc_feature: GYAE6OF01CK0PK.1.49.E05.1.454.CMB.1.raw
tcagacgagtgcgtcacgaccggtgctcgatttagagcgactagcaacacacaaaggggacccaaaaccacacccctccttgggagaatcccctagatcacagctcctcaccatggacgggacctggagcatccttttctggtggcagcagcaacgaggtcgcccactcccgaggttcaccgtggtgcagtctggagctgagctgcagagccgtgggcctcgagtgagtcgtctcctgctagtgctttcgtaggttacagtttcctttaccgaccgttacggtatagtaagtttggttacgaacgaccgtaccgggcccccggaggtacgggggtctttaggagggttacgggagtaggggtagttgggacgttacggaaccgttacccggttaaacggtaaaaaccgttaaaacggaggtaaggttagtaggggaaaggtaacggtaacggttccgggaagggtacctaaggtacgtacgtaacgtaaccgtagtcccggaaccggtccgggaacctaacccggtacgtttaaacccccggaacgggttaaaccgtaacccggtaaccgtaaccctaaacgtacggttaacgggtaaacgtacgggtaaccgggtaaccgttaaccccttaggaaaccggtacgttaacccggttaaccgggaacccgtaaccccggtaacccggggtttaacccctttaaggttttaaacccgttaacgggttccggaaccgggtaaccgggttaaacgggaaacgttttaacgtttaacggttaccgggaccctttaacggggtttacccgggttcccgggtaacggttaaccccggtttaacggtaaccccgttaggtttaaccgggttccggggttaacggggtacccccggg

SEQ ID NO: 29504 - DNA, 691 bp, Homo sapiens
  misc_feature: GYAE6OF01AGBJK.1.49.E05.1.454.CMB.1.raw
  modified_base (667)..(667): a, c, t, g, unknown or other
  misc_feature (667)..(667): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctgagtgagtggtctcctgctagtcgtcttcgttggttactacttccttttccaccgttacggtatagtagtttggttagacgaccgaccgggcccccggaggacggggtcgttggaggtggaggtgggtagtggtactcgacgtacccgttaacggaaactaaaacgaggtaagtagtagggaagtaaggtaacgttaccggagggacgaaggacgtactactacgactaccgaccggacgaaccacacgtaccgaacgtacgtaaccacgtacctaacgtagtacggtaacgtaggacggacgtaccgtacgacgtactacgtaacggaacccgtaccggacccggtaccttaacgtttacgttaccgtacggaccggacggtaaggtaacggttatttacggttcgacgttacggttcggtaccgtggttaccgtaccgtaacccgngttcggttcgggtcggtacccggg

SEQ ID NO: 29505 - DNA, 588 bp, Homo sapiens
  misc_feature: GYAE6OF01BX1AK.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggtgagacacggcccccggagaggggcttggagtggagtgggatggatcagcccttaggaactaaaacgagagtatggagagaagttcgaggcagagtcatcatcacgcgacacataccgacgacgtacacgacctaacacgtaggaactagaagggacgcctacgaacgtatacgtagaaccgaacgaccgggtacctaactttacttacgtacggacgacgaagacgtaagttagttcggactaacgttcgggttaccgtcggtaccgttacggtaacccgacgttcgtttgggtcggggtaacccgg

SEQ ID NO: 29506 - DNA, 666 bp, Homo sapiens
  misc_feature: GYAE6OF01CDUNG.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggttacattcttttccacctacgtatgtaattggttgagacgacgggcccccggaggaggggcttggagtggagtggggagtggatcgacgtcccgttaacggaaactaaaacgagaagtagtaggagagaagttccgaggcagagtcatacatacgaccgcggacacactaccgaacgacgtacacgacctaacgacgtagggaacgtaggaacggacgacccgtacgaagtacgtcgtacggaacccggaaccgacccgggtaccttaacctttaacgttaccgtacggaccggtaaccggaacggtaaacggtaagttttacgttcggtacctaccgggtttcgggttaccccgttagggtacccgttaacggttaaccccgtacgggttccggtttagggtcggggtaaccccggg

SEQ ID NO: 29507 - DNA, 686 bp, Homo sapiens
  misc_feature: GYAE6OF01D83EK.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagagcctggggcctcagtgatggtctcctgcagtgcttctggtacattcttttccaccttacggtatgtaattggttgagacgacggcccccggaggaggggcttggaggtggagtgggatggactcgacgtacccgttacggaaactaaaacgagaagttacgtaggagaagtaacggttccgagggacagagtcagtcacgtaccgaaccggacgaaccacgtactaccgaacgtaacgttaaccgacgacccttaacgaacgttagggaaaccttgggaaacgggtaccgtacccgttacgaacggtaagttaccgtaacgggaacccgtaaccggaacccgggtacccttaacgtttaactttaccgtacggacggaaccggtaaggaacgtatttacgttacggaccgtaacgtcgggttccgttacgggtccgttaacggtaacccctagggtaccgtttggggtcgggtacccggg

SEQ ID NO: 29508 - DNA, 703 bp, Homo sapiens
  misc_feature: GYAE6OF01CGWF8.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtcgcccactcccaggttccacctggtgcagtctggagctgagctgcagagccgtggggcctcgagtgagtggtcctccgtgcgtagtcgtcttcgtggttactacttccttttaccaccgttacggttatagttaagtttgggtttggaacgtaccggacccggggtaccccccgggagggtaacgggggtcctttagggtacggtgggtaagtcgggggtatacgggataccgaacgtaccccgttaaaggaaactaaaacgagtagtagtaggagaggaacgttcgaggacagagtactatcgactacaccggtacgaacactacgacgtacgaacgtaacacgtaccgtaatacggtagaaccgtggaacggcgtaccgtagacgtactcgacgaaccgaccgaccggtaccttaaacgtttcgttaacgaccgcggaacgaagtacgttaagttacggtcggttacgtaccggttggtaccccggtaggtccgttaaacccggaccgttaacgttcgttacgggcggggttaccccgg

SEQ ID NO: 29509 - DNA, 639 bp, Homo sapiens
  misc_feature: GYAE6OF01EHS10.1.49.E05.1.454.CMB.1.raw
  modified_base (147)..(147): a, c, t, g, unknown or other
  misc_feature (147)..(147): n is a, c, g, or t
  modified_base (365)..(365): a, c, t, g, unknown or other
  misc_feature (365)..(365): n is a, c, g, or t
  modified_base (398)..(398): a, c, t, g, unknown or other
  misc_feature (398)..(398): n is a, c, g, or t
  modified_base (456)..(456): a, c, t, g, unknown or other
  misc_feature (456)..(456): n is a, c, g, or t
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggnagcagcaacaggtgcccactcccaggttcacctggtgcagtctggagctgagctgcagagcctggggcctcgagtgatggtcctacctcgactagtgtctttcgttacggttaactaactttcctttacctaccgtacggttatacgtaggtttggtcgtaagaccgtacccgggaccccggacggggtagggtccgtaggtacggtgtaggtagggnggagtacgacgtaccgtcccggtaaaaccggtnaaaacgtaacgaagtaagtaggtaggaaggtaggtaacgtacggagagtagtacgtanactactacgaccgacgacgacacgacacgacgaacgacgtactacgaactagacgtagacgacggacgcacgagtacgtacgacgtacgaccgtactaccttacttacgtacgtacgacgtagtagtagttagttacgtacgcgttcgtcgtcgtacgtcgtacgtacgtcgttcgtggtcgg

SEQ ID NO: 29510 - DNA, 578 bp, Homo sapiens
  misc_feature: GYAE6OF01AZH9G.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacattcttttccaccttacggtatgtaattggttgagacgtacgggccccccggaggagggggccttggacggtggagtgggatgggatcgagcccttaacggaactaaacgagagtatggagagaagttcgaggcagagtacatcatcgaccgcgacacactccacgagtacagcctagagtacgaacgtggacggacgccgtacgagactcgtacgacgaaccgaccggtaccctacgtttacgtacgtacgccgtacgagacgtattagtcgactacgtggtaccgtggtaccgttacgtaaccgacgtcgttgggtcggtaaccgg

SEQ ID NO: 29511 - DNA, 586 bp, Homo sapiens
  misc_feature: GYAE6OF01AK11U.1.49.E05.1.454.CMB.1.raw
tcagacgagtgcgtcacgaccggtgctcgatttagagcgactagcaacgacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcgagtgatggtcctcctgcagtgcttctggttacattctttccacctacggtatgaattggttgagaccacgggcccccggaggagggggtcttggagtggagtgggatggatcagtcccgttacggaactaaacgagtagtagtggagagaagttacgagggtcagagtcatcatcaccggacggacacactaccacgacgtacacgcctaacgagtacgggaactggaggacgcctacagactcgtagaaccgaacgaccggtaccctaacgttacttacgtcggccggtacgacgtagtaattagttcgactacggttggtcccgtggtacgtacggtaaccacggtcgttgggtcggtaccgg

SEQ ID NO: 29512 - DNA, 689 bp, Homo sapiens
  misc_feature: GYAE6OF01D0U23.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtggcccactcccaggttcacctggtgcagtctggagctgagctgcagaagccgtggggcctcagtgagtcggtctcctgcagtgtcttcgtggttaactatttccttttacccaccgttaacggtattgtaagttggttagaacgaccgaccgggcccccgggtaggacggggtcgttaggaggttggagtgggagttgggaattcgaacgtaccccgttaaacggaaaccttaaaacgaggtaagttaagtagggaagaacggtaacgttccggagggaactaggtacgtacactacgacgtaccgaaccggcggaaccactaccgaaccgaacgtaacgtaacacgtacctaacgagtaacgggactaggacgtacgcctagacgtatcgacgacgacgaccgacttaacttacgtacgtcggacgtacggaagtagtaacttttaggtcgtaccgttacggttccggtaccgtacggtaccgttaacggtaaaccctacgggttacggttgggttcgggaacccg

SEQ ID NO: 29513 - DNA, 637 bp, Homo sapiens
  misc_feature: GYAE6OF01CSF7X.1.49.E05.1.454.CMB.1.raw
  modified_base (238)..(238): a, c, t, g, unknown or other
  misc_feature (238)..(238): n is a, c, g, or t
  modified_base (428)..(428): a, c, t, g, unknown or other
  misc_feature (428)..(428): n is a, c, g, or t
  modified_base (468)..(468): a, c, t, g, unknown or other
  misc_feature (468)..(468): n is a, c, g, or t
  modified_base (511)..(511): a, c, t, g, unknown or other
  misc_feature (511)..(511): n is a, c, g, or t
  modified_base (560)..(560): a, c, t, g, unknown or other
  misc_feature (560)..(560): n is a, c, g, or t
  modified_base (596)..(596): a, c, t, g, unknown or other
  misc_feature (596)..(596): n is a, c, g, or t
  modified_base (629)..(629): a, c, t, g, unknown or other
  misc_feature (629)..(629): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttccacctggtgcagtctggagctgagctgcagagccgtgggcctgagtgatcggtctcctgacngtgtcttacgtggttactacttaccttttaccacgttacggttatgtaaagttgggttacgaacgaccggacgggacccccggaaggcggggtaccttaggacggttggagtgggagtggaatccgaacgtaccgttaaacggaaactaaaacgaggtagtaacgtgggaacgagtaacgtcggaagggngaagtagtacagtacgatacgaccgacggaacacgtaacnccgaagtacacgacgtactaacgagaggaactggaacggtacnccgtaagagtaactcgaacgacgaccgacgtaccctaagttacttacgngaacgtcgatagtaacttgtcgattaccgtgtaccncggttactaacgggtaacccaggtccgttgggnggtaaccg

SEQ ID NO: 29514 - DNA, 603 bp, Homo sapiens
  misc_feature: GYAE6OF01CU2MR.1.49.E05.1.454.CMB.1.raw
  modified_base (406)..(406): a, c, t, g, unknown or other
  misc_feature (406)..(406): n is a, c, g, or t
  modified_base (429)..(429): a, c, t, g, unknown or other
  misc_feature (429)..(429): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcagtgatcggtctcctgctagtgtcttcgtggttactacgttcctttccaccgttacggtatagtaattggttagacgacgacgggcccccggaggacggggtcttggagtggagtgggagtggatcgacgtacccgtaacggaaactaaagagagtagtaggagaagtacgtcgaggcagtagcancactaccgacggcgaacactacnccgaacgacgtacacgacctacagtacgaacgtggaacgcgtacccgtagacgtatcgtagaaccgacgtaccgaccttacttacttacgcgacggacgagtacgttacgttagtcgacgtacggtcggtcctaggtaccgttacgtaacccgtacgttcgtgggtcggtacgg

SEQ ID NO: 29515 - DNA, 753 bp, Homo sapiens
  misc_feature: GYAE6OF01BNQJ1.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgagtggtctcctgcagtgcttcgtggttacattcctttcaccttacgtatgtaagttggtgagacgacggcccccggaggacggggtcttggagtggagttgggatggatcgaacgtcccgttaacggaaactaaaacgaggtaaggttaacgtagggaaagtaacggtaacggttaccggaagggaccgaaggtaacggtactaacgttacgaacgtacccggaacccgggacggaaccgaaccgtaaccgtacccggaaaccggtaaacggttaccgaacggtaaccccgttaaaccgtaacggtacggggtaaaacccgttggggaaacgggtaaccgtacccgtaacgaacggtaacttccgggtaacggaacccggtaacccggaaccgggtaacccttaaaccgtttacgttaacgtaccggtccggtaacgaacggtacgtaatttacgtacggtacgtaccggttcggtacccgtggtaccgttacggaacccgttacggtcgttcgggtcggtaacccgg

SEQ ID NO: 29516 - DNA, 716 bp, Homo sapiens
  misc_feature: GYAE6OF01EXBVJ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcgagtgagtggtctcctgcagtgtcttcgtgttacattcttttaccacctacggtatagtattggtgacgacgtacgggacccccggaggaggggtcgttggaggtcggaggtggggatgggatccgacggtaccccgttaaggaaacctaaaacgaggtaagtagtagggaagaagtaacggttccgagggacgaggtagtacatacgataccgacgggacggtacacgtacgtaccaacggtactacgaaccgtacctaacgtaacggtacgggaaccgttagggaacgggctacccgtactaacggtcgtacggacgtaaccggaacccgaccgggtaaccctaacgtttaacgttacctacgggaccggtaacggacggttaaacgtaacgttttacgtaccgggtacccttacgggttcccggttaccgtacgggttccttaaccggtaacccgttaccgggttccgtttcggggtacggggtaaccccggg

SEQ ID NO: 29517 - DNA, 676 bp, Homo sapiens
  misc_feature: GYAE6OF01BRKJG.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggttacattccttttaccaccttacggtatgtaattggttgagacgtacggccccccggaggaggggtcttggaggtggagtgggatggtatcgacgtcccgttaacggaaactaaaacgagtagtagtaggaagtaggaagttccgagggacaggacgtactatacataccgaccggacgggtaccaactaccgtaccgaaccggaacgtacgaacgtacctaacaacgtacgggaaacgttggaacggacgtcccaccgtagactacgtagtaacccggaccgtaacccggtaccttaccgttttaattaccggtgaccggtacgtaacggtaacgttaacgtttagtccggtactacggttcggttacccggttaggtaccgttaaccggttaaccctacgggttctttcggggtcgggtacccggg

SEQ ID NO: 29518 - DNA, 707 bp, Homo sapiens
  misc_feature: GYAE6OF01EQ47Y.1.49.E05.1.454.CMB.1.raw
  modified_base (502)..(502): a, c, t, g, unknown or other
  misc_feature (502)..(502): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcgagaagccgtggggcctcgagtgatcggtctccgtgcagtgtcttcgtggttactattccttttccaccgttacggtatacgtaagtttgggtagtacgacgtaccgggacccccgggtaggacgggggtctttggacgggtggtaggttagggagttgggactcgtacggtacccgttaacggaaaactaaaacgtaggaggtaacgtgggaaggagtaacggtaccgaggggacctaggtacgtcatcgacgtccgaccggacggacactacgaccgacggagtacacgtacctanacgtacggtaacgtcggacggtacgtccgtagtaacgtcgtacgacgggtaaccgaccggtaacccggtacccgttaacgttaacgttaaccgtcggtaacccgaggtaacggtacgtaacgtttacgtaccgacgttaccggtcggttcccgtacggtacgttacccggtaacccgtacggttggttacggccgggtaacccgg

SEQ ID NO: 29519 - DNA, 572 bp, Homo sapiens
  misc_feature: GYAE6OF01EWZE2.1.49.E05.1.454.CMB.1.raw
  modified_base (402)..(402): a, c, t, g, unknown or other
  misc_feature (402)..(402): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
  modified_base (470)..(470): a, c, t, g, unknown or other
  misc_feature (470)..(470): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgctttctggttacattcttttccacctacggtatgtaattggttgagacgacggaccccccggaggagggggcttggaggtgggagttggggatgggatcgacggtcccttaacggaaactaaaacgagagtagtaggagagtaaggttccggggcaggagtnatcatcgaccgnggacanactaccacgagtacacgcctaacgatacggaactggaaggtacgccgtanagtactcagaccgacgaccggcctaattacttacgcgacgcgaagtagtacttatcgctagtcggtctggcttacgtaaccgcgtagtggtggcgtaccggg

SEQ ID NO: 29520 - DNA, 724 bp, Homo sapiens
  misc_feature: GYAE6OF01BKPTH.1.49.E05.1.454.CMB.1.raw
  modified_base (170)..(170): a, c, t, g, unknown or other
  misc_feature (170)..(170): n is a, c, g, or t
  modified_base (198)..(198): a, c, t, g, unknown or other
  misc_feature (198)..(198): n is a, c, g, or t
tcagacgagtgcgtcacgaccggtgctcgatttagagcgactagcaacacgacaaaggggacccaaaaaccacacccctccttgggagaactccccctagactccacagcctccctcaccatggacgggaccctggacgcacttccttttcttggtggccagcagcaacnggtcgcccactcccaggttcacctggtncagtctggagctgagctgcagaacgccgtgggctcagtgatcggtctccgtgctagtcgtacttcgttagttacctagtttccctttaccaaccgttacggtaatacgtaacgttggtacgaacggaccgtaccgggtacccccggagggtacggggttcttgggaggttggaggttaggagtcggagtccgacgtacccgttaacggaacctaaacgagtagtagtacggaagacggtaacgtcgtaggaccagacgtcgtactacgtactacggaccggtccggaactcctaaccgtaccgtaacggtaatacccggaaacgtaccgttaaacgacggttaacggttaacgacgggtaacgggacctacccggtaaagacgttacgaccgtaacggaacctaacccggaccgtaccttacgttaacgtccgcggtaccgacggttatacgtagttaatccgtacgtaccggttcgaccggtccgtaacgttacctaaccgtaggtcttcgggcccgtaaccggg

SEQ ID NO: 29521 - DNA, 791 bp, Homo sapiens
  misc_feature: GYAE6OF01EUO5U.1.49.E05.1.454.CMB.1.raw
  modified_base (216)..(216): a, c, t, g, unknown or other
  misc_feature (216)..(216): n is a, c, g, or t
  modified_base (399)..(399): a, c, t, g, unknown or other
  misc_feature (399)..(399): n is a, c, g, or t
tcagacgagtgcgtcacgaccggtgctcgattttagagcgactagcaacgacacaaaggggacccaaaaaccacacccctccttgggagaatcccctagatcacagctcctcaccatggacgggacctggagcatccttttcttggtggcagcagcaacaggtgcccactcccaggttcacctggtgcagttctggagcgtgagctgcagagccgnggggcctcaggtgagtggtctctgcagtgctttcaggttacattcctttaccaccgtacggtatcgtaacttggttagacgtacgaccggcccccggaggaggggtccttagggacggttgggaagttggggaacgtcgggtaactcgtaccggtaccgtttaaaccggaaaacttaaaacgngggtaacttaaggtcggggaacgtaaggtaaacggttccgaaagggtaccaaggtacgtacgacgttacgaactaccggacccggtacgggaacctaacgtacgttaacccgacgtaacgttaacgacggtacccttaagacgtaacgggtacgttacgggaacggtccggaccttacgtaaggacctttcggaaccggaacgggtacccggtaaccggggtacccttaaacgttttacgttaccggacggttaaccggacggttaacgtaaaggttaaccttttaaaggttccgggtactttacccgggtacgggtttacccgtaacgggttacccttaacggggtaaaccccttacggttaaccggtttcgggtaccgggttaacccggg

SEQ ID NO: 29522 - DNA, 664 bp, Homo sapiens
  misc_feature: GYAE6OF01AF7W8.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcagtgatggtctcctgctagtgtctttcgttaggttactattccttttccctaccgttacggtatagtaagtttggttagacgacgacgggcccccggaggacgggggtcttggaggtaggaggtggggagtaggatcgacgtacccgttaacggaaactaaaacgagagtagtaggaagaggtaacgtacggagggcagtagtacactcactccgaccgacgacacactaccacgacgtacacgacctaagtagaggaacgtaggacggacgtcctacgagtaccgtacgacgaaccgaccgtaccggtaccttacgtttacgttaccgtacggtacggacgtaggtaacgttaagtttacgttacgaccgttacggtcggttacccggtacggtaccgttaaccggttaacccgtacggttcggttgggtacgggtacccggg

SEQ ID NO: 29523 - DNA, 640 bp, Homo sapiens
  misc_feature: GYAE6OF01CD876.1.49.E05.1.454.CMB.1.raw
  modified_base (505)..(505): a, c, t, g, unknown or other
  misc_feature (505)..(505): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtgcccactcccgaggttccacctggtgcagtctggagctgagctgcagacgccgtggggcctcgagtgagtggtctccgtgcagtgtcttcgtgttactattccgtttcccaccgttacggtatagtaagttggttgacgacgaccggccccggaggacgggtcgttggaggtggagtggggagtggatcgacgtacccgttaaggtaaacttaaaacgagtagtagtaggaagtaaggtagttaccgagggcaaggtacgtcatacgacgtaccgaccggtacgaaccacgtactaccgaacgacgtaacgacgacctaacgagtacggaacgtggaacgacnccgtagagtactcgtacgaaccgaccgtaccggtaccttaacgttactaccgtcgacgacgagtacgttattacgtcgacctacggttcggtaccgtcggcgttaacgtaccgtcgtcggttggtcggtaccggg

SEQ ID NO: 29524 - DNA, 671 bp, Homo sapiens
  misc_feature: GYAE6OF01CGVKQ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatgggacgggacctggagcatccttttcttggtggcagcagcaacaggtgcccactcccaggttcacctggtgcagtctggagctgagctgcagaagccgtggggcctcgaggtcgagtggtctcctgctagtgtcttcgtggttacacttcttttaccacgttacggtatgtaagttggttagagtaccgacgggccccgggaggacggggtcgttggaggtggagtgggagtggatcgacggtaccgtaacggaaactaaacgagagtagtaggaagagtagtcgaggcagacgtcatcatcgacgcgacacataccaggactacgacgtactaacgagtaggaacgtggaacggtacgacctaggaactacgtcgaacggtaacccggaacgtaacccggtaccgttaactttaaccgttaccgacgaccgggtaaacgtaacggtaaaggttattttacggtacggtaccttaaccgggttccggtacccgttaggggtaaccctttaaccgggtaaccttaacgggttccgtttgggggaccgggtacccggg

SEQ ID NO: 29525 - DNA, 624 bp, Homo sapiens
  misc_feature: GYAE6OF01EQ4EZ.1.49.E05.1.454.CMB.1.raw
  modified_base (220)..(220): a, c, t, g, unknown or other
  misc_feature (220)..(220): n is a, c, g, or t
  modified_base (345)..(345): a, c, t, g, unknown or other
  misc_feature (345)..(345): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctnagtgatggtctcctgcagtgcttcgtggttactattcctttccaccgttaggtatgtaagttgttgagaccgtacggcccccggaggtacgggtcgttgaggtcggagttcgggagtggatacgnacgtaccgtaacgtaacgtaaacgagtaagtagtaggagtagtagtacgaggacgagtacgtacgtactacgacgtacgaccgaccacggacgtaccgacgtacgacgaacgtacgtagacgtacgaacgtagacgtacgacggagacgactacgaacgtacgtacgacggtaccgtaaccgtaccgtaccgtacgtacgtacgtacgtacgtacgtagtacgttagttacgtcgtacgttacggtaccgtacgtacgtacgtacgtacggtcggtacg

SEQ ID NO: 29526 - DNA, 747 bp, Homo sapiens
  misc_feature: GYAE6OF01DDDE5.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtggggcctcgagtgagtggtctccgtgcagtgtcttctggttactattccttttccacgtacggtatgtaattggttgagtacgacggccccggaggaggggtcttggaggtggaggtggatggatcgacgtaccgttaacgaaactaaacgagagtacgtggagtaaggtacgttacggaggcaggacgtacatcactccgaccggtacgacgaacctactacccgaacgacgtaaccgacgtaaccgtaacgtacgtaacgggtaacgtagggaacggtaccgtaccgtaccgaggtacgtaccgttaacggaaccccgtaaccggaacccggttaaccgttaaccgttttaacgtttaacccggtacgggtacccggaaacggttaaaggtaaacggtttaacgttaaccggtttacgtaacccggttaccggtttaccgggttccccggttaccggggttaccgtttaacccgggttaaaccccgtcgggtttacccgggtttggggttacccggggttaaccccggggg

SEQ ID NO: 29527 - DNA, 768 bp, Homo sapiens
  misc_feature: GYAE6OF01C1JVG.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtgcccactcccaggttccacctggtgcagtctggagctgagctgcagaacgccgtggggcctcgagtgatggtctcgtgcagtgtcttcgttggtactactttccttttaccaccgttacggttatagttaagttggttagacgtacgaccgggcccccggagggtacgggggtcgttaggacggtagggtagtaggggagtagggtactacgaaccggtacccgttaaaccggaaaacgtaaaacgacggtaagttaacggtagggtaaggtaacggtaacggttaccggagggacgaaggtacgtacgtaataccgaacgtacccgaaccggtaccgggaacctaaccgtaccgttaacccgaaccggtaacgtaaccgaaccgtacccgtaacgacgttacggaacgtacggtaacggacgtcccgtacgacgtacgtcgtaaccggaacgtaccggaaccggtaccttaacgtttaccgttacggtcggaccgaccggtaaggtacgttacgtttaaggttcgtaccggtaccgttccgggttacccgtagggtcccgttaaccgtaacccgtacggtttaccggtgggttcgggtacccggg

SEQ ID NO: 29528 - DNA, 653 bp, Homo sapiens
  misc_feature: GYAE6OF01EH2GU.1.49.E05.1.454.CMB.1.raw
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctnagtgatggtctcctgcngtgtcttctggttacattcttttccaccgtacgtatgtaattggttgagacgcggcccccggaggagggcttgaggtggagtgggatggatcacgtccctaacggactaaaacgagagtagtaggagtacgagttccgaggcagagtacatcgatcaccggacggaaccaacgtactccgaacgtacgttaaccaacgtcctaactaacggtacggaaaccgtaggaacgggtacgaccccgttagaacgtacgtacgtcggaaccgtaaaccgtaccgggtaacccttacgttaaacgttccgtacggacgacggtaagtaacggtatttaacgttcgacttaacccggttcggttacccggtaggttacccgttaggtaaacccgaccggttcgtttcgggtggggtaacccgg

SEQ ID NO: 29529 - DNA, 849 bp, Homo sapiens
  misc_feature: GYAE6OF01DFQUF.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtggggcctcgagtgagtggtcctcctgcaggtgtcttcgttggttactacttccgttttaccaccgtacggttatagtaacgtttggttagacgacgtaccgggcccccggtaggacgggggtcttggaggtggagtgggactggactcgacggtacccgttaacgaaacgtaaacgacgagtagtaggacgaagtacgttccgaagggtacaggtagtactagtacacgtaccgacccggtacggaacccaccgtaacgtaaccccgtaacggaacggttaacaaccgtaccctttaaacgacgggtaaccgggtaaacgtttacgggaacggggaacccgttaccccttacgggaaacgtaccgtttaccggaacgggttaaacccggtaacccccgggtaaccggttaacccccctttaacgggtttttaactttaacccggtaccgggggtaaccggtaaaccccgggtaaagttaaaacgggttttaacgttttaccggggtttaaagacccccgttttaaaccgggttcccgggtttacccccggttaggggtttaacccccgttaacggttaaacccccgggttaccggtttacgggtttttccggggaacccgggggggttaaccccgg

SEQ ID NO: 29530 - DNA, 636 bp, Homo sapiens
  misc_feature: GYAE6OF01CCPNM.1.49.E05.1.454.CMB.1.raw
  modified_base (197)..(197): a, c, t, g, unknown or other
  misc_feature (197)..(197): n is a, c, g, or t
tcagacgagtgcgtcacgaccggtgctcgatttagagcgactagcaacgacacaaagggggacccaaaaaccgacacccctccttgggagaatcccctagatcacagctcctcaccatggacgggacctggagcatccttttctggtggcagcagcaacaggtgcccactcccaggttcacctggtgcagtctgganctgagctgcagaacgccgtggggcctcagtgtagtggtctcctgcagtgcttctggttactattctttaccaccgttacggtatgtagtttggttagacgacgacgggccccccggaggacggggtcttaggtacggtgggtagttaggggagtggactcgacggtacccgttaacggaaactaaacgagaaggtagtaggagagtacgtcgacggcgagacgtcactcgactccgaccgacggaaccactacgtaccgacgtaacgaccacgtacctacgagtacgggactaggacggacgaccgtacagactcgacggacgacgaccggtacctacgttacgtacgtcgaccggacgtaagtaggtatttacgtcgagtaccggttcgggtccgtaggtcctacggtaacccgcgttacggttgggccgggtaccgg

SEQ ID NO: 29531 - DNA, 737 bp, Homo sapiens
  misc_feature: GYAE6OF01BN5RD.1.49.E05.1.454.CMB.1.raw
  modified_base (312)..(312): a, c, t, g, unknown or other
  misc_feature (312)..(312): n is a, c, g, or t
  modified_base (365)..(365): a, c, t, g, unknown or other
  misc_feature (365)..(365): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtcgtggagctgagctgcagaagccgtggggcctcgagtgatggtctcctgctagtgtcttgtcggttactattccttttaccacgttacggtatgtaattggtgagacgacggccccgggaggngggtcttggaggtggagtgggagtggatcgacgtaccgtaaggaaactaaagngtaagtagtaggaagtaaggtaacgttcggagggtacaggtacgtactagtacgacgtccgaccggtcggaaccacgtactacccgaacgtagtaaccacggaccctaagtacggtacgggtaaaccggtgggaacggtaccggacctacgtaaggtaccttaccggaacggtaaccgacccggttaacccgtaccttaaaccggtttacgtaacccgtgggaccccggtaaagtaagggttaacgtttaaccgtttacggtaccggtaacccgttccgggttcgggttacccgttaccgggttaaccgtaacccgttaaccccgggttagggtttaaccccggttgggggtaccccggggttaaccccggg

SEQ ID NO: 29532 - DNA, 532 bp, Homo sapiens
  misc_feature: GYAE6OF01AWT61.1.49.E05.1.454.CMB.1.raw
  modified_base (221)..(221): a, c, t, g, unknown or other
  misc_feature (221)..(221): n is a, c, g, or t
  modified_base (486)..(486): a, c, t, g, unknown or other
  misc_feature (486)..(486): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctnagtgatggtctcctgcagtgcttctggttacatctttccactacggtatgattggttgagacaggcccccggagaggggcttgagtggagtgggatggatcgagcccttaacggaactaaaacagagtataggagagaagttccagggcagagtcatcatcacgcggacacgactccgacgagtacagcctaacatggaactgagacgcctacagatcgtgacgacacggtccacgttactactgcgcgtagagtattagttcgntacgttggtacctggactacgtaccacggtcgttggtgggtaccgg

SEQ ID NO: 29533 - DNA, 867 bp, Homo sapiens
  misc_feature: GYAE6OF01EPTZH.1.49.E05.1.454.CMB.1.raw
  modified_base (199)..(199): a, c, t, g, unknown or other
  misc_feature (199)..(199): n is a, c, g, or t
tcagacgagtgcgtcacgaccggtgctcgatttagagcgactagcaacacacaaaggggacccaaaaaccacaccctccttgggagaatcccctagatcacagctcctcaccatggacgggacctggagcatcctttcttggtggcagcagcaacaggtgcccactcccaggttcacctggtgcagtctggagctgganctgccagaacggccgtggggcctcgaggtgagttgggtcctcctaggcctaggtcgtcttcgttcggttactacttccttttcctaccgttacggtatcgtaagttggttagaacgtaccgtaaccggggaccccccggggtaggacggggggtacctttagggtaagggttcgggaggttacggggaggttacgggacgttaccgaaccggttaccccggtttaaaccgggtaaaaaccgttaaaaaccgaaggtaaaggtacggttaaggggaaacggtaacgggtaaacggttaccggacgggtaaggaacgtacgggtactacgttacaacgttaccggaaccggtacccggaaacgtacccgtaaccgtaccgaaccggtaaacggttaccgtaaaccggtccgttaaaccgtaacggtacggtaaaccggtacgggtaacgggaccgtacccgttaacggaacgtaccgttaacggtaccgtaacccggaaccggaaccccgtacccgtttaaaccgttttaaccgttacgttaccgggccggtaacggtaacggttacgttaacgttacggtttaccgacccgttaaccggttcgggtaccgttccgggtaccgtttaaccgaacccggttacgtccggttgggtacccggggtaacccgg

SEQ ID NO: 29534 - DNA, 619 bp, Homo sapiens
  misc_feature: GYAE6OF01BVR5R.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggtcttggagtggagtgggatggatcagccccgttaacggaaactaaaacgaggagtagtaggagagaagttcgagggcagagtcatcatccgaccgcggaacacactaccaacgacgtaacacgacctacagtacggaactggaaggacgcccgtacaaggtatcgtacggaccgaaccgaccgggtaccctaactttaacgttactcggaccggacggaaggacgtaatttacgttacgtaccgtacgttcgggttcccgttcgggtaccgttacggtaaaccccgtacggttccgtttggggtcgggtaacccgg

SEQ ID NO: 29535 - DNA, 812 bp, Homo sapiens
  misc_feature: GYAE6OF01C691H.1.49.E05.1.454.CMB.1.raw
  modified_base (186)..(186): a, c, t, g, unknown or other
  misc_feature (186)..(186): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcacctggtncagtctggagctgagctgcagaacgccgtggggcctcgaggtcgagtggtcctcctgcgtagtcgtctttcgtaggttactactttccttttacccaccgttacggttattacggtaagtttgggttagaacggacgtaccgggcccccgggagggtacgggggtcgttaggaggtagggtaggtacggggtagttgggacttaccgtacggtaaccccgttaacggaaaaacctaaaacgaaggtaagttacggtagggtaaacggtaacggtaacggtttacccggaaggggtaccgaaggtacgtacgtactacgaacgtacccggtaccggaccgggaaacctaaccacgtaacccgaacggtaacgtaaccgacggtaacccctaagtacggtaaccgggtaacgtacgggaacgggacccgttccgtaacgtaacggtacgttaccggtaaccgaacccggaaccggtacccggttaccttaaaccggtttagttacccgtgggaacccggtaacggtaagtaacgtttactttaggttccgaccgttacggttccgttacccggtggtaaccgttacgttaaccccgaggtttaccggttgggttccgggtaacccggg

SEQ ID NO: 29536 - DNA, 715 bp, Homo sapiens
  misc_feature: GYAE6OF01DQR8A.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttgggtggcagcagcaacaggtcgcccactcccaggttcaccgtggtgcagtcgtggagctgagctgcaggagccgtggggcctcgagtgagttcggtctccgtagctggtcgtccgtttcgtcggttaccacttttccttttaccgaccgttacggttagtgttaagttgggttagacggtaccgaccgggaccccgggagggtacggggtcttagggtaggtgggagtagggtagtggactcgacgtacccgttaacggaaacgtaaacgaggtacgtaagtaggaagtaggtaacgttccggagggtacagtagtacacgttacgaccggtaccgaccggacggaacctaaccgtacgtacccgtaaggtaaccgtaacgtaccgaacccgttaagaacggttaacgggaacgttacgggaacggtaccgtaccgttagaacgtcgtaaccggacgtaaccggacccgtacgtacctaacttacgtacgtcgaacggtcgagtacgtattacgtcgacttacggtcggtcgtacgggtcctacgaccgtacggttcgtgggtcggtaccggg

SEQ ID NO: 29537 - DNA, 597 bp, Homo sapiens
  misc_feature: GYAE6OF01BWPOU.1.49.E05.1.454.CMB.1.raw
  modified_base (458)..(458): a, c, t, g, unknown or other
  misc_feature (458)..(458): n is a, c, g, or t
tcagacgagtgcgtcacgaccggtgctcgatttagagcgactagcaacacacaaaggggacccaaaaccacacccctccttgggagaatccctagatcacagctcctcaccatggacgggacctggagcatcctttcttggtggcagcagcaacaggtgcccactcccaggttcacctggtgcagtctggagctgagctgcagagcctggggcctcgagtgatggtctcctgcagtgcttcgtggttacattcttttccacctacggtatgaatttcggttgacgtacgacggcccccggagtacgggggtcttggacggtggagtggggatgggatcgacgtacccgttaacggaaactaaaacgagtaagtacgtggaagtagaacgttcgagggacaggacgtacagtcactcgaccgacggaacacactccgaacgtacgtacacgtacctaanacgtacggaacgtggagacgtcctacgatacgtctagacgacgacgtcctaagttacttacgtgacgcggagagtacgttagtcgtactacggttcggtccgtggtacgtaccgtaactagtcgttggtcgggtaccgg

SEQ ID NO: 29538 - DNA, 537 bp, Homo sapiens
  misc_feature: GYAE6OF01A0LZX.1.49.E05.1.454.CMB.1.raw
  modified_base (464)..(464): a, c, t, g, unknown or other
  misc_feature (464)..(464): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggccccccggagagggggcttgagtggatgggatggatcagcccttacggaactaaaacagagtatggagagaagttccagggcagagtcatcatcaccgcggacacatccagatacgagcctacatggaacctggacgagcctcagatctgacgacacggccattacttactcgcgngacgagattagttgcctaacgtcggtaccctgggtaccgttcgtaaacccgacgtactttgggtcggggtccg

SEQ ID NO: 29539 - DNA, 655 bp, Homo sapiens
  misc_feature: GYAE6OF01A0FGK.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatcggtctcctgcagtgcttcgtggttactattccttttccaccgtacggtatgtaattggttgagtacgacgggccccggaggaggggtcttggaggtggagtgggatggatcgagtacccgttaacggaaactaaaacgaggtaagtaggaggaaggaagtaacggttaccgagggacgaaggtacgtactacgtacgaagtccgaccggacggaaccacgactaccgaacggacttaacgacgtacctaacgaagtacgggtaaactgggaacgtacgccgtagaagtacttacgcgaacgaccgtaccggtacctacgtttactacgtcgacggacgaagtacgtagtttagtcggacctacgttcgggtaccgttcgggtaccgttaacgtaacccggacggttcgttgggccggtaacccggg

SEQ ID NO: 29540 - DNA, 657 bp, Homo sapiens
  misc_feature: GYAE6OF01C2UM4.1.49.E05.1.454.CMB.1.raw
  modified_base (353)..(353): a, c, t, g, unknown or other
  misc_feature (353)..(353): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacgaggccccggagacgggggtcttggagtggagtgggatggatcgagtacccttaacggaactaaaacgngaagtagtaggagaaggaacgttcgaagggtcagagtcgatcgaatcgaccgcggacaacgataccaagacgtacacgacgtaacgagtaggaaactggaacggacggacccttagaacggtaacttacgttacggaaccggaacgtaacccggggtaccctaacgtttaacgttaaccgttcggaccggtacggtaacggtaagtaccgtttaagttcggtaccgtaacggttccgggttacccgttagggaccgtttaaccggtaaaccctaggtaaccgtttgggttaccggggtacccgg

SEQ ID NO: 29541 - DNA, 842 bp, Homo sapiens
  misc_feature: GYAE6OF01D3PGC.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatgggacgggacctggagcatccttttcttgggtggcagcagcaacaggtcgcccactcccagattcacctggtgcagtcgtggagctgagctgcaggagccgtggggcctcgagtgatcggtctcctgcagtgtcttcgtggttactactttcccttttaccaaccgttaccggttattacgttaagtttcgggtttaggaacgtaccggaccgggggccccccgggtaagggacgggggtaccgtttagggagggttaggggtaggttgggggtagtagggtacttaccgacggttaaccccgttaaacgggtaaaaccgtaaaaacggaggttaaggtaaggtagggtaacgaaggtaacggtttaccggaagggtaccgaagggtaaccgtacgaacgttacctaagttaccccggaaccggacccgggaacctaaccgtaaccgttaccgaaaccggtagtaacccgacgtaccccgtaacgtaacgggtaacgggtaacgtacgggaacggtaccgtaccgtacgaacggtaacgtcgtaacggacccgtaacccggtaaccgtacccgttaacgtttaacctaccggttacggacccggtaacggacgtaaaacgggttacttttacgttaacggacggttaccgttaccgggttaccggttcggggtaaccctttaaccgggtaaccccgttacgggttacccggtttgggtaccccgggg

SEQ ID NO: 29542 - DNA, 776 bp, Homo sapiens
  misc_feature: GYAE6OF01A3RSZ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttaccaccgtacggtatgtaagtttggttgagacacgggcccccggaggaggggcttggaggtggagtgggatggatcgacgtaccccttaacggaaacctaaaacgaggtaacggtaagtaggggaagtaaggtaacggttaccgaaggggtaccaaggtaagtacgacgtacctaacgtcccgaacccggacgggtaacccaacgtaaccgttaccccgaaacggtaacggtaaaccctacggtaaccctaacgtaacgttaacggggaaaccttacggggaacggtaccggtaccccttaggaacgtaaccttaccggtaacggaacccggaacccgtacccgggtacccgttaaaccgttttaacgttaaccggtcgacccgggtaaccggaaggtaaagttacgtttaacgtttacggacccgttaaacggtttcccgggttacccgttagggtacccgttaaccggtaaacccggtaccggtttcccggtttggggttcggggtaaccccggg

SEQ ID NO: 29543 - DNA, 714 bp, Homo sapiens
  misc_feature: GYAE6OF01B8CTP.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtgggcctcagtgatggtctccgtgcagtcgcttctcggttacattcttttaccaccgtacggtatgtaagttggttagagacgacgggccccggaggacggggtcttggagtggagtgggagtaggatacgtacgtacccgttaacggaaactaaacgagtaagtagtagggaagaaggtaacgttccggagggacaggacgtactaatcaacgtccgaaccggacgaaccacgtacgtaccgaacggacgtaacgaacgtaccgttaaacgagttaacggaacgtacggaacggtacgtcccgtaaccgagtaccgtacggttaccggaacccggtaaccgaacccggtacccttaaacgtttactttaaccggacggtccggtaacgggtagacggtttaaacgttacgttcggaaccgttccggttacgggttccccgtagggttaccgttaacccggtaaccgtaccggttaccgttcggggtccggttaaccccgggg

SEQ ID NO: 29544 - DNA, 825 bp, Homo sapiens
  misc_feature: GYAE6OF01AZE9R.1.49.E05.1.454.CMB.1.raw
  modified_base (156)..(156): a, c, t, g, unknown or other
  misc_feature (156)..(156): n is a, c, g, or t
  modified_base (223)..(223): a, c, t, g, unknown or other
  misc_feature (223)..(223): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaanaggtgcccactcccaggttcacctggtgcagtctggagctgagctgcgagagccgtgggctgagtgntgtctcgtgcagtgtcttcgtgttactacgtttccttttacctaccgttacggtagttaggttaacgtttggttagacggtaccgaccggggacccccgggtagggtacgggggtccgttagggtaggtacgggtaggtaggggtagtacgggtacttaccgaacgggttacccggtttaaaccggaaaaccgttaaaaaccgaggtaacggtaaggtacgggaaggtaaacggttaacggttaccgggaacgggtaccggagtaacggtaccgtaacgtaccgtaacgttacccggaacccggtaccgggaacctaccgtaacccgtaccggaaccggtaacgtaacccgaacggtacccgtaacgtaaccggtacgggtaaacgtcgggaacggacgtacccgtacgtaaccggtaagttccgaacgggtaacccggtaacccggaaccgttaaccgttacccgttttaaccgtacggtaccgggtaacggacgtaacggtagttaacggtttacttaccggaccgttacggtaccgggttacccgtgttacccggttaaactaccccggtagtttccggttcgggtcggggtaacccgg

SEQ ID NO: 29545 - DNA, 591 bp, Homo sapiens
  misc_feature: GYAE6OF01EWJJM.1.49.E05.1.454.CMB.1.raw
  modified_base (443)..(443): a, c, t, g, unknown or other
  misc_feature (443)..(443): n is a, c, g, or t
  modified_base (468)..(468): a, c, t, g, unknown or other
  misc_feature (468)..(468): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgctttctggttacattcttttccaccttacggtatgtaattggttgagacgacggccccccggaggaggggtcgttggaggtggagtgggagtgggatcgagtcccttaacggaaactaaaacgaggagtagtggaagagaacgttacgagggcagagtacatcatacacgcggaacacactaccgacgacgtacacgcctaanagtaggaacgtggacgacgccgtanacgatcgagaaccggtacgaccggtacctactttacttacgtacgcgacggaagaagtagtttagtcgtactacgttcggtacctggccttacgtaaccgaccgtcggttcggtgggtacccg

SEQ ID NO: 29546 - DNA, 709 bp, Homo sapiens
  misc_feature: GYAE6OF01ELJ5Z.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgagtggtctccgtgccagtgtctttcgtggttactattcctttccaccgttacggtatagtaagttggtagacgacgaccggcccccgggtaggtacggggtcgttaggtaggtagggaggtagggagtaggtactcgacggtacccgttaaacggaaacctaaaacgaggtagtaacggtaggaacgtagggtaacgttacgacgggacgaggtacgtacgactacgagtaccgacggacggaaccacgtaacgtaccgaacggtaacgtaccgacgtaccctaagacgtacggtacgtaggacggtacaccgtacgagtacgtcgtacgaccggtacgaccggtacctaacgtttacgtacgtacgaccggtaggtacgtagtaacgttacgttcggtacctaacgggttccggtaccgttacccgggtacgttaaccggttaacccgtacgggttcccggtttccggggtcgggtaaccccggg

SEQ ID NO: 29547 - DNA, 722 bp, Homo sapiens
  misc_feature: GYAE6OF01C37AT.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtgcagcagcaacaggtcgcccactcccaggttccacctggtgcagtctggagctgagctgcagacgccgtgggcctcgaggtgagtggtcctccgtgcgtagtcgtcttcgttggttactacgtttccttttaccaccgttacggtactaggtaagtttggttgacgtaccgaccgggtcccccggagggacggggttcttggtacggtaggaggtagggagttggactaccgacgtaaccccgttaacggaaaacctaaaacgaggtaacgtaggtagggaacgtaaggtaacgttacggaggtacgaggtacgtctaagtcacgttccgaaccggacgaaccacgtaccgtacccgaacggtacgaacccgtacgtaaccgtaacgaacggttacggtaaacgtaggacggtacctcccgtaagaccgtacgtacgtaaccgaaccgacccgtaaccggtaccttacgtttaacgaccggtcggaccgtacggaaggtacgtttaagttcgtacgaccgttacggtccggttaccgtgtaccgtaaccgtaacgtcgttcgtggtcggtacccggg

SEQ ID NO: 29548 - DNA, 667 bp, Homo sapiens
  misc_feature: GYAE6OF01BF8DV.1.49.E05.1.454.CMB.1.raw
  modified_base (221)..(221): a, c, t, g, unknown or other
  misc_feature (221)..(221): n is a, c, g, or t
  modified_base (234)..(234): a, c, t, g, unknown or other
  misc_feature (234)..(234): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtgcccactcccaggtccagcttgtgcagtcgtggggctgaggtgaagagcctggggcctnagtgaggtttccngcaaggcttcaggatacaccttcaactaggtatgctatactagttgggtagcgccacgggcccccggaacaaacggcttaggacggtggagtggggatggatccgaacgcgtggactaagtcggtaaacaactaaaaattcgaacgaagtaacggttaccgaggggacagtacgttacctacccgtttacgaacggtaccactacgtccggacgtaggtaactttaaccttatacgtggaagtcgtaggacgacaggccgtagacgacgtacgaagaccgacggcctttagtactttagttttggacgtacggaccttcgtagggtcgggtaggttacctagtttaacgtcgttactacgtaaacgttttcgaccgtttccgggtacggggtacccgaaggggttaaccccgttcggtaacccgttaccccgg

SEQ ID NO: 29549 - DNA, 657 bp, Homo sapiens
  misc_feature: GYAE6OF01D7P5E.1.49.E05.1.454.CMB.1.raw
  modified_base (323)..(323): a, c, t, g, unknown or other
  misc_feature (323)..(323): n is a, c, g, or t
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
tcagacgagtgcgtcacgaccggtgctcgatttagagcgactagcaacacacaaaggggacccaaaaaccacacccctccttgggagaatcccctagatcacagctcctcaccatgggacgggacctggagcattccttttcttgggtggcagcagcaacgaggtcgcccactcccgaggttccacctggtgctagtcgtggagctgagctgcaggacgccgtggggcctgaggtgtagttcggtctccgtgctaggtcgtcttcgttggttacctctttccgtttccacgtaggtatgtagttggtgagcgaccggtccggngggaggtgtaggnggtggngtggagtggtactcgacgtacgtaaacgaacgtaaacgaggtagtaggaggtaagagtacgtcgagganagtancagtacacgtcgacggacgacactagaccagaccgtcacgtaccagacgtaacggacgtagggaacgtcctaccgagtaagtctcgggaaccggaccgttaaccgaccgggtaccttaacgtttacggcgtaacggcggtaacggattaaagttgttaaccggttcgacgttacgggttccggtaccggttcgtaacgttaaccgtacggtaccgggtttagtcgggtaaccggggtaccg

SEQ ID NO: 29550 - DNA, 762 bp, Homo sapiens
  misc_feature: GYAE6OF01C1A5V.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcgagtgatggtctcctgcagtgcttcgtggttacattctttccaccgtacggtatgtaattggttgagacgacgggcccccggaggacggggtcttggaggtggtagtggggagtgggataccgacggtaccccgttaacggtaaactaaaacgaggtaacggttagtagggaagtaacggtaacggtttccggaaggggtacgaaggtaggtactaagtaccgtagttacccgaaccgggaccgggaacctaaccgtaccgtaacccgaacggtaacgtaacccgtaaccggtacccgtaacgacgtaacgggtaacgttacgggaacggtacggtaccctacgaacggtactaccgtacggaacccggtaaccgacccgggtacccttaacgtttaacgttaaccgttcggaccggtacggaacggtaacgttacgtttacggttacgtaccgttaaccggttcgggttacccggttagggtacccgttaaccgggttaaacccgtaccgggtttcggttcggggtccggggtaacccggg

SEQ ID NO: 29551 - DNA, 701 bp, Homo sapiens
  misc_feature: GYAE6OF01CVVOM.1.49.E05.1.454.CMB.1.raw
  modified_base (216)..(216): a, c, t, g, unknown or other
  misc_feature (216)..(216): n is a, c, g, or t
  modified_base (691)..(691): a, c, t, g, unknown or other
  misc_feature (691)..(691): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatcctttctggtggcagcagcaacaggtgcccactcccaggttcacctggtgcagtctggagctgagctgcagagccgtgggcctnagtgatggtctccgtgcagtgtcttcgtggttactattccttttaccaccgttacggtatagtaagtttcggttagacgaccggacgggtaccccggaggacggggtcttaggagtggagtcgggattgggatcgaacgtacccgttaacggaaacgttaaaacaggtaagtaagtgggaaagtaacggtaaacggttaccggaagggtacaaggtacggtactacgtacgtactaccggaccggacggaaccaacgtacgtaacccggaagtaacgtaacccgtaacggtacccgtaactaggtaacgggtaacgagggaacggacgaccgtacgtaagtacgtacgtacgaaccgaccggaacccggtacctaagtttaacgttaccggacggtaacggacgtaacgggaattacgttagttcgaccgttacgttcggtaccgtggaccttaacggacctaggtcgttacggnggtacccggg

SEQ ID NO: 29552 - DNA, 585 bp, Homo sapiens
  misc_feature: GYAE6OF01A5G34.1.49.E05.1.454.CMB.1.raw
  modified_base (449)..(449): a, c, t, g, unknown or other
  misc_feature (449)..(449): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgtagtctggagctgagctgcagaagcctgggcctcagtgatggtctcctgcagtgcttctggttacattcttttccacctacggtatgtaattggttgagacgaggccccccggaggtacggggctttggacggtgggagtgggatggatcgagtacccttaacggaaactaaacgaggagtagtaggagagaagttcgagggcgagagtcatcactcaccgcggacacgactaccagtacgacacgacctaacagtaggaacgngaacggcgacctacgagatacgtcgacgaccgaccggacctacgttagttacctcgacgcggaagtagtacgttacgttgaccgtatcggtcctcggtctacgtaaccgtacgtcgtttggcgggtcgtaccgggg

SEQ ID NO: 29553 - DNA, 652 bp, Homo sapiens
  misc_feature: GYAE6OF01ALE62.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagagccgtggggcctcgagtgagtggtctcctgcagtgtcttcgtaggttactattcctttcctaccgtacggtatagtagtttggtgacgaccgaccgggcccccggtaggacggggtccttggaggtcggtaggtgggtaagtggatcgacggtacccgttaacggaaactaaacgagtaggtaagtagggagaacggtacggtacgaggacgaggtacgtacatacgacgtaccgaccggacggacacgtacacccgtaggacgtaaccacgtacctaacgtagtacggtaacgtagggacgtacgtaccgtagacgtacgtacgacggaccgaccgacccggtactacgttacgtaccgtagaccggacgtaggtacgtagttacggtcgtacgtacgtcggtcgtcgtacgtaacgtaccgacggttcgtcgggtcggtaccgg

SEQ ID NO: 29554 - DNA, 675 bp, Homo sapiens
  misc_feature: GYAE6OF01ET8VN.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctgagtgatggtctcctgcagtgctttcgtggttacattctttccacgtacggtatgtaattggttgagacgacggcccccggaggacggggtcttggaggtggagtggggagtgggatcgacggtacccgttaaacggtaaactaaaacgaggtaagtaacgtaggaggaagtaacggttccgaagggacgtaggagtacgagtactactccgaccggacgacaacgtacaccgacgacgtacgacgaccgtaagagtacggaacgtaggaacgtacgacctacgaacgtactacgtacggaaccggaccgaaccgggtacccttaacgtttaacgttaccgtacgacggaccggaagtaggttaactttagttacggtaccgtacgttccgggttaccgttgggtaccgttaacgtaacccgtacggttacggtttcgggtccggggtaacccggg

SEQ ID NO: 29555 - DNA, 780 bp, Homo sapiens
  misc_feature: GYAE6OF01BDSSY.1.49.E05.1.454.CMB.1.raw
  modified_base (255)..(255): a, c, t, g, unknown or other
  misc_feature (255)..(255): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagccgtgggcctcagtgagtggtcctccgtgcagtgcttcgtggttacnttcctttccaccttacggtatgtaattggttagacgacgtacgggcccccggtaggacggggtcttaggaggtgggagtggggtatggactcgacggtacccgttaacggaaactaaaacgaggtaacgtaagtacgggaaagtaacggtaacggtttaccggaacgggtactaaggtaacgtactaacgtacgtaacgtacccgaacccgggacggtaaccctaacgaccgttaccgaaccgtaagtaacccaacgggtaccctaaacgtaggtaacggtaacgtaggaacgggtacctacccgtagaacggttacgtaccggtcaaacccggtaccgtaaccgggtacccttaaactttaccggttaaccgtcggacccggtaacggttaaggaacgtttaacgtttaccggtacggaacccgttacggtttccggggtaccccccgttaggggttaaaccccccgttaaccgtacccgggttacgggttcgggttacccgggggcccttaaaccccgggggg

SEQ ID NO: 29556 - DNA, 731 bp, Homo sapiens
  misc_feature: GYAE6OF01C4BYA.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggttacattctttcaccgtagtatgaattggttagagtaccacggcccccggaggacggggcttaggaggtaggagttgggagttcggatacgacggacccgttaacggaaaacttaaaacgaggtaagttagtagggaagtaacggtaaacggttccggaaagggtaccgaaggtaaggtacctaagtacctaacgttaccgaacccggaccgggaactaacccgaattacccgaacggtaacgtaacgaacgtacccgaaacgtacgtaacgggaaccggttagggaacggtacgaacccgttacaacgggttataccgttaacggaaccggtaaccgaaccgggtacccctaaacgtttacgtttaaccgtcggaccggtaacggtaacggagttaattacgttcggtaaccgacggttcggttacccgttagggtccgttaacgtaaacccgtaggttcgttcgggtagggtaaccccggg

SEQ ID NO: 29557 - DNA, 912 bp, Homo sapiens
  misc_feature: GYAE6OF01CLPZN.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccagtggacgggacctggagcattccttttcttgggtggcagcagcaacaggtcgcccactcccgaggttccaccgtggtgctagtctgggagctggagctgcagacggccgtggggcctgagtgtagttcggtcctcctggcgtagtcgtcttcgttacgtactacttttcctttaccgtaaccgttacggttaattaggttaacgtttcggtagtaaccggtaccggacccggggtaccccggggtagggtacggggttcgttagggagggttagggtaggtagggtaacggtacgggtactaccgtaaccggttacccgttaaaacggtaaaaacgtaaaacggaaggtaacggttaggtacgggtaaggtaacggtaaccggttaaccgggacgggtaacgtaacgtacggtactaacgttaccgtacgacccggtaccggtacccggaactaaccgtaccgtaacccgaacggtaaccgtaacccgaacgtaaccctttaaacgggacggttaaccgggtaaggaacgggtaaccgggtacccgtaccgttaaacgaacggttaaccctcgggtaaaacccggaaccgggttaaaccccgtacccgggttaaaccttaaaccggttttacggtacccgtaggggaaacccggtcgggttaaaggtaaccgttttaaccggttacggttaccggaacccgttacggggtttaccccgggtacgtacccgggttaaccgtttacccggtaaacccgttccgggtttacgttacggggggtacccggtaaccccggggg

SEQ ID NO: 29558 - DNA, 802 bp, Homo sapiens
  misc_feature: GYAE6OF01BBGBH.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgagtcggtctcctgcagtcgcttcgtggttacattctttccaccgttacggtattagtaagtttggttgacgtacgaccgggcccccgggaggacggggtcgttaggaggttcgggaggttggggagttacgggactccgtacggtaaccccgttaacgggaaaacctaaaacggtagtaacggttaagtacggggaagtaacgggtaacggttacccggaagggtaccgtaaaggtaaccggtaccgtaaacgttccgtaaccgttacccggaacccggaccgggtaacctaacccggtaaaccttaccccggaaacggtaacccggtaacctaaaccggtaccccgttaaacggtacgtaaccggggtaaaacgtacgggaacgggtaaccgtcccgtaaccgtaacggtacgttcccgaacgggaaccgtacccgaaccgggttacccttaagtttaacgttacgtacggccggtaacgaagtacgtaagttacgttcgaccgttacggtcggttaccggtacggtaccgttaaccgtaacccgtaccgggttcgtttgggtccggtacccggg

SEQ ID NO: 29559 - DNA, 662 bp, Homo sapiens
  misc_feature: GYAE6OF01C5XQ0.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagaacgccgtggggcctcagtgatggtcctctgctagtgcttcgtggttactacttcttttccaccgtacggtattacgtaagttggttagacgtaacgaccgggaccccccggaggagggggtcttaggaggtgggaggtacgggagtagggactacgtacggtaccccgttaacggaaaactaaaccgaggtaagtagtaggaagtaaggtacgttacgaggacgagacgtcatacgactacgaccgcggaactaccacttaccgaacgaataccgtacgacctaacagtacgggaacgtcggaaggcgtacctacgatactcgtaagaccgtaaccgacggtacctacgtttacgtacctggccgacggaacgtaggttattacgttcgtaccgtcgttacgggtaccctggttaccgtaacggtaaaccctcggttcgttgggtcggtacccggg

SEQ ID NO: 29560 - DNA, 747 bp, Homo sapiens
  misc_feature: GYAE6OF01CGF3W.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttgggtggcagcagcaacaggtcgcccactcccaggttccacctggtgcagtctggagctgagctgcagacgtccgtggggcctcgagtgagtcggtcctactgctagtcgtcttcgtggtactacgtttcctttaccacgtacgtatgtacgttggttagacgacgaccggaccccgggaggtacggggtcttaggaggtcggtaggtcgggtagtaggtactacgaccgttaccgtaaacggtaaaacgtaaaacgtaggaagttacggtaggaaggtaacgtaacggttaccggaagggtaacctaaggtaccggtacaacgtacgaacgtacccgacggaaccggaactactactaccggaacggtacttaaccgacgtaccgttaaacgcgttaacgggaacttagggaacggtaccgtaccctaagtacggtaacgttcgtaaccgaaccggtaccgtaccggtaccttaacgtttacgtacggcgtaacggacgtaagtacgttaagttccgtacgaaccgttcggttccggtaccgttggttaacccgtaacggttaacccgttcgggttaacggtttcgggtccgggtaaacccgggg

SEQ ID NO: 29561 - DNA, 735 bp, Homo sapiens
  misc_feature: GYAE6OF01AYBIZ.1.49.E05.1.454.CMB.1.raw
tcagacgagtgcgtcacgaccggtgctcgatttagagcgactagcaacgacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaacgcctggggcctcagtgatggtctcctgcagtgcttcgtggttacattctttccacgttacggtatgtaacttggttcgagaccgtaacggcccccggaaggtagggggtccgttggaggtggagtgggatggactcgacgtacccgttaacggaactaaaacgagacgtagtaggaagtaggaacgtaccggaggccgaaggtagtactactccgaacgtaccgaccggtacgggaacctaccgaacttcccggaacgtaaacggtaaccctacgtaacccgtaactaacggttagggtaaacccgtggaaaccgggaccggtaacccttcgaacgtaaccgtttacggacgtaaccggaacccggtacccgggtaacccttaaacggtttaactttaaccgggtcggaaccggtaccggaaggttaaccggtaagttttaccgttacgacccggtacgttccgggtaccgtagggttaccgttaacgtaaacccgtaggttcccggttgggtccgggtaacccgg

SEQ ID NO: 29562 - DNA, 836 bp, Homo sapiens
  misc_feature: GYAE6OF01DOZ1R.1.49.E05.1.454.CMB.1.raw
  modified_base (139)..(139): a, c, t, g, unknown or other
  misc_feature (139)..(139): n is a, c, g, or t
  modified_base (825)..(825): a, c, t, g, unknown or other
  misc_feature (825)..(825): n is a, c, g, or t
tcagacgagtgcgtcacgaccggtgctcgatttagagcgactagcaacacacaaaggggacccaaaaaccacacccctccttgggagaatccctagatcacagctcctcaccatggacgggacctggagcatccttttnttggtgcagcagcaacaggtcgcccactcccaggttcacctggtgcacgtctggagctgagctgcaagaacgccgtggggccttacgaggttgtacgtgggttcctccgtgaccgtaggtcgttactttcgttacggttaccttacgtttccttttaccaaccgttaacggtatagttaacgtttggtacgacgtaacgaccgggccccggtagggaggggttcttgggaggttacggaggttacgggtagtagggtactacgtaaccggttaaccccgtaaacggtaaaacctaaaacgacggtaacgtaggtacgggaaagtaaacgggtaacggtttacggaacgggacgtaaacggtaacgtacgtaacgttaccgtaaccgttaaccccgggaaccggtaccgggaaacctaaccgtaaccgtaacccggtaaccgaaaccgtttaacccgaaccgttacccgttaaacgaacgggttaacggtaacggttaaccgggaacgggttacccgtacccttaaacgggacttaacgtacggttaaacccgtaaccgggaaccctacccgggttaacccttaacgttttaacgttacggtaccgggtaacggtaaccggaagttactaacgtttggaccgttagtaccggttcgtacgtcggtaacttacggaactccggttagnggtcggaacgg

SEQ ID NO: 29563 - DNA, 746 bp, Homo sapiens
  misc_feature: GYAE6OF01B0NB5.1.49.E05.1.454.CMB.1.raw
  modified_base (288)..(288): a, c, t, g, unknown or other
  misc_feature (288)..(288): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctctgcagtgcttctggttacattcttttccaccgtacggtatgtaattggtgagacncggcccccggaggacggggtcttggaggtcggagtggggatggatcgacgtaccccgttaacggaaactaaaacgagaacgtagtagggaagtaaggtaacgttaccggagggtacgaaggtagtacgtaagtacgtaacgttacccgaacccggtaccgggaaccgaaccgtaacttaccccgaaccggtaacgtaacccgaacgacccttaaaccgaaggttaacggggtaaccttacgggaacgggtaccgaccccgttaacgtaacggactttaccggtaacgggaacccggtaacccgtaacccgggtacccgttaacctttaacgttaaccgtcggaacccggtacgggtagtaaagttacgttagttccggaccgtacggtttcggtcccgttagggtacccgttaacggtaacccgtaccggttccgtttaggggtccgggtaacccggg

SEQ ID NO: 29564 - DNA, 881 bp, Homo sapiens
  misc_feature: GYAE6OF01CKADO.1.49.E05.1.454.CMB.1.raw
  modified_base (142)..(142): a, c, t, g, unknown or other
  misc_feature (142)..(142): n is a, c, g, or t
tcagacgagtgcgtcacgaccggtgctcgatttagagcgactagcaacacacaaaggggacccaaaaaccaccacccctccttgggagaatcccctagatcacagctccctcaccatggacgggacctggagcatccttttnttggtggcagcagcaacgaggtcgcccacctcccaggttcacctggtgcagtcgtggagctgagctgcagagccgtgggccctgagtgagttggtctcctgcgtaggtcgtccgtttcgtaggttaactactttccgttttaccgaaccgttaacggttattaaggttaagtttgggttacgaacggtaccggtaccccggggacccccggtaaggggtacgggggttaccgttagggtaaggttaggtaaggttaggggtacggttacggtaaccgttaccgtaaccgggtaacccccggttttaaaacgggaaaaaacgtttaaaaacccggaagggttaacgtttaaagggaacggttaaagggaaggtttaaacccgggtaccggaacgggttacggaaggtaccggtagtaaccgtacgaacgtacccggaaccggaccggtaaacgccgtaaaccgaccggttaacgacggtaacccgtacaccgtaacggaagtacggaaagtacggacggtaccgacgtaaccgtagtaacgttcggaaccggacccggaaccgttaacccgggaactttaaaccgtttacgtaacccgggtaggtaacccggaagtaaacggttacgttaactttagggtacccgtaacccggttacggtcccggttaccggtcggttaaccgtaacccggggtaccccttaacgggttcgggtttaaccgggtcggggtaaaccccggg

SEQ ID NO: 29565 - DNA, 533 bp, Homo sapiens
  misc_feature: GYAE6OF01A51XK.1.49.E05.1.454.CMB.1.raw
  modified_base (244)..(244): a, c, t, g, unknown or other
  misc_feature (244)..(244): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (402)..(402): a, c, t, g, unknown or other
  misc_feature (402)..(402): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (431)..(431): a, c, t, g, unknown or other
  misc_feature (431)..(431): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
  modified_base (516)..(516): a, c, t, g, unknown or other
  misc_feature (516)..(516): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttntggttacatcttttccacctacggtatgaattggttgagacgacggcccccggaggacgggggtccttggagtggagtggggtatgggatcagtccgttacggaaactaaacagagtanggagagagtcgaggcagntcatnatcgacgcggacacanccacgagacagcctananggaactgacgngcctacgagatcacgacgacgacggcctaattcgtacgngcgngagagtattatcgtcacgtcggtactggacgtcgtaacccgngtcgttggtcggtaccg

SEQ ID NO: 29566 - DNA, 823 bp, Homo sapiens
  misc_feature: GYAE6OF01C6NRG.1.49.E05.1.454.CMB.1.raw
  modified_base (184)..(184): a, c, t, g, unknown or other
  misc_feature (184)..(184): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtncactctggagctgagctgcagaacgccgtggggcctcagtgagttggtcctccgtgctaggttcgtcctttcgtacggttactacgtttccttttccaacccgttaacggttacttaggtaaagtttggggttacgaacggtaccggacccggggtaccccccggtaggggtaacgggggttacctttagggtacgggttaggggtaggttagggggtaacgttacgggtacgtacccgtaacggttaacccccggtttaaacggtaaaaaccgttaaaaaccgtagggtaaacggttacggttaacggggaaagtaacgggtaaaccggttacgggtaagggaccgtaaggtacgtacgtaacgtaccgaaccttaccggaacccggtacggaacctaaccgtactaccccggaagtaacggtaaccacggtaccctaagtagtacgggaacgtagggaaccgtacggtcccttaacggaacgtacgtcgtaccggaaccgaccgaaccgtacttacgttaactacgtcggacggtaccgaagtacgttaacgttagtccgaccgttaccggttacggtacccgttacggtaccgttaaccgtaacccggtcgttaccggttggtccgggtaaccggg

SEQ ID NO: 29567 - DNA, 638 bp, Homo sapiens
  misc_feature: GYAE6OF01E0YY1.1.49.E05.1.454.CMB.1.raw
  modified_base (195)..(195): a, c, t, g, unknown or other
  misc_feature (195)..(195): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctgganctgagctgcagagcctgggcctcagtgatggtctcctgcagtgcttctggttacatcttttccaccttacggtatgtaattggttgagtacgacggcccccggtagagggggtcttggaggtgggacgtggggagtggagtcacgtcccttaacggaaactaaacgagacgtagtacggagagtaacgttacagggtcaaggtagtacatcatccgaccgacggacaacgactcccaaggtacgttaaccgacgtacctacgaacgtacgggtaaactacggaacggacggtccttaacgacgtactaccgttacgaaccgtaaccgaaccggtacctaacgtttacttaaccgtacgaccgacgaaggtacgtattaacgttcgatacggttcggtcctgggtaccttcggttaaccaccggttcgtttcggtgggtacccg

SEQ ID NO: 29568 - DNA, 767 bp, Homo sapiens
  misc_feature: GYAE6OF01CWGLF.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagaagcctggggcctcagtgatggtctccgtgctagtgcttcgttggttactactttcctttacctaccgtacggttatacggtaagttggttagacgacgacgggacccccggaggtacgggggtcttaggacggtggtagtagggtagtaggtagtaccgtacggtaaccccgttaacggaaaacctaaaacgacggtaagttacggtaagggaacgtaaggtaacggttacgaagggtaccgaaggacggtactagtacctacgtaccgaccggtaccgaacgacctacgaccgtacgaacgtacacgtaccgtaacgtacgtaacggaacgtacgggaacgacgtacccgttagacgtacgtacgtaaccggaccggtaacccgtaccgggtaccttaaccgtttaaccgttaacggtccggtaccggtaaccggtacggtaacgtttaagtttaacgttaccgtaacccggttaccggttccgggtacccggttacgggtaccgttaacccggtaacccggtaccggttaccgggttccgggtacggggtaaccccggg

SEQ ID NO: 29569 - DNA, 152 bp, Homo sapiens
  misc_feature: GYAE6OF01DRVO5.1.49.E05.1.454.CMB.1.raw
  modified_base (149)..(152): a, c, t, g, unknown or other
  misc_feature (149)..(152): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttgggtggnnnn

SEQ ID NO: 29570 - DNA, 617 bp, Homo sapiens
  misc_feature: GYAE6OF01DD9HZ.1.49.E05.1.454.CMB.1.raw
  modified_base (609)..(609): a, c, t, g, unknown or other
  misc_feature (609)..(609): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatccttttctggtggcagcagcaacaggtgcccactcccaggttcacctggtgcagtctggagctgagctgcagaagcctggggcctcagtgatggtctcctgcagtgtcttctggttactacttcttttaccaccgtacgtatgtaattggttgacgtacgacgggcccccggtaggacggggtcttggaggtggagtgggagtggatacgacgtacccgttaacggaaactaaaacgagtaacgtagtaggagaacgtaacgttcgaagggcaggtactactatcatcgaccgtcgacacactaccgacgtaatacgacgacctaagtagtacggaacgttaggaacggactccttacgaacgtactacgtacgtaaccgaacgaccggtacctagtttacgtaactcgacggtacgaagtacgtattacgtcgacgtacgtcggtcgtcgtacgtacgtaacctcggtcgttgggnggtaccgg

SEQ ID NO: 29571 - DNA, 774 bp, Homo sapiens
  misc_feature: GYAE6OF01C1U41.1.49.E05.1.454.CMB.1.raw
tcagacgagtgcgtcacgaccggtgctcgatttagagcgactagcaacacacaaaggggacccaaaaaccacacccctccttgggagaatcccctagatcacagctccctcaccatgggacgggacctggagcattcctttttcttggtggcagcagcaacaggtcgcccactcccaggttcaccgtggtgcagtctgggagctgagctgcaggacgccgtcggggcctcgagtgagttcggtctccgtgcgtagtgtcttgtgtactactttcctttaccacgttacggttatagtaagttggttagacgtacggaccgggccccgggtaagggacggggttcttagggacggttgggaggtggggtagtcggactacgtaccggtacccggttaaacgaaaacgtaaacgaggtacgtagtaggaaggtaacgtagtaccggaaggtacgaaggttacgacgtactacgtacgtaccgacccggaacggtaacctaccgaacgttaccggaaacggtacgtaacccgtaaccggtacctaaacggtagaaccgggttacgaagggtacgaccgtcctaaggtacgacttaacgggacgaacccgtacccggttaccgtaccttaacgtttaccgtacggtccggacgaggtaaccgttaaagtttaccgtaacggttccgtaaccgttacggtttcccgggtaccggttagtaccccgtttaacggtaacccgtacgggtttccgggtttcgggcccggggttaaaccgggg

SEQ ID NO: 29572 - DNA, 727 bp, Homo sapiens
  misc_feature: GYAE6OF01C1LHN.1.49.E05.1.454.CMB.1.raw
  modified_base (241)..(241): a, c, t, g, unknown or other
  misc_feature (241)..(241): n is a, c, g, or t
tcagacgagtgcgtcacgaccggtgctcgatttagagcgactagcaacacacaaaggggacccaaaaaccacacccctccttgggagaatcccctagatcacagctcctcaccatgggacgggacctggagcattccttttcttggtggcagcagcaacaggtcgcccactccccaggttcaccgttggtgcagtctggagctgagctgcagacgccgtgggcctgagtgatcggtctcgngctagtcgtcttgtggttactacttcctttaccaccgttagtatgtagttggtagagtaccgccggcccggaggacgggtcttaggaggtggaggtcgggataggacgtccgtaacggtacccgtaacggtaaacgtaaacgagtaagtaacgtaggaagtaaggtaccggttacgaagggtctaggaacgtctaactgaaccgtaccgaccggtacgaacaaccgtacgtaacccgaacggtaacgtaccgtaacgaacctacgtaacgtacggaaccgtaggtaacggaccgtcctacggtaatacccgtcggtaacgaaccgtacgtaacccgggtaccttaaccgttacttacccggacggtaaccgtaccggtaaggtacgtttaacgtacgttaccggtccggtaacgttccgggttaccggtaccggtaccgttacccggtaaccgtacggtttcggtcgggttacgggtaccccgggg

SEQ ID NO: 29573 - DNA, 721 bp, Homo sapiens
  misc_feature: GYAE6OF01A02S9.1.49.E05.1.454.CMB.1.raw
  modified_base (235)..(235): a, c, t, g, unknown or other
  misc_feature (235)..(235): n is a, c, g, or t
  modified_base (265)..(265): a, c, t, g, unknown or other
  misc_feature (265)..(265): n is a, c, g, or t
  modified_base (308)..(308): a, c, t, g, unknown or other
  misc_feature (308)..(308): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatgtctctgcngtgcttctgtactattctttccactacgtntgtattggtagagacgtacggccccggagtagggtcgttaggnggtcggagtgggtataggactacgacgtacccgttaacggtaaactaaacgagtaggtagtaggaagtagtaagttccggaggtacgaaggtacgtacgaacgtacgacgtaccgtacccggacggaaccaactacgtaacccgtaacgtaacgttaccaacgtaccgtaaccgagttaacgggaacgttagggaacggtaccaccgtacgtaacgtacgttccggtagaaccggtaaccgaccggtaccccgttaacgttaacgtttaacggaccgtaccggtaacggtacgttaaaggttaaccgtttaacgttaccggccgttaaccggtttccgggtacccgttcggttaacccgttacggtaacccccggttaggtttacccggttacgggtaccgggttaccccggg

SEQ ID NO: 29574 - DNA, 927 bp, Homo sapiens
  misc_feature: GYAE6OF01ECAJ8.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcaccgtggtgcagtctggagctgagctgcagagccgtggggcctcgagtgagttggtcctccgtgctaggtcgtccgtttcgttggttacctactttccgttttacccgaccgttacgggttattggtaagtttgggttacgaacggtaccgaccggggaccccccgggtagggacgggggttccgttagggacggttgggacggttaggggagttcgggtaacttaccggtaacccggtaccccgtttaaaaccggtaaaaccgttaaaacgtaaggtaacggttaaggtaggggtaaacggtaaacgggtaacggtttaccggaaggggtacctaacggtacggttaaccgtacgtaaccgtaacgtacccgaaccccgggtaaccgggtaacctaaccgtacccgttaaccggaacccggtaaacggttaacccgaaccgttacccgtaacggtaacggtaccggtaaacggttacgggacgggtaccgtacccgttacgaacggttacgtaccggtaacggaaacccggaccccggtaaacccggggttacccttaaaccgttttaacccgtttaaccgggtaccgtaaccccggggtaagtaacccgggttaaagtttaacgtttacggtacccgttacggttaacccgggtttccgggttacccggttcgggttaaccccggtttaaccgtaaccccgggtaccggtttccgggtttaacgggggtcccgggttaaaccccgggg

SEQ ID NO: 29575 - DNA, 737 bp, Homo sapiens
  misc_feature: GYAE6OF01COR88.1.49.E05.1.454.CMB.1.raw
  modified_base (395)..(395): a, c, t, g, unknown or other
  misc_feature (395)..(395): n is a, c, g, or t
tcagacgagtgcgtcacgaccggtgctcgatttagagcgactagcaacaccaaggtggaacccaaaaaccacacccctccttgggagaatccctagatcacagctcctcaccagtggacgggacctggagcactccttttcgtggtggcagcagcaacgaggtcgcccactcccgaggttcacctggtgcagtctggacgtctggacgtctgcgaggaacgtcgtacgggtctcgagtgtacgtcgtctcctgctagtcgtacttcgtacgttactcttcgtttacccacgtacgttatcgtaagttggtagaggaccggtccggaccggagggcgggtcttagggcgtaggagtcgggagtggacacgtaccgtaccgtaacggaactaaacgngtagtacgaggaacgtacggtacgtacgagggtacagtaacgtacgtatacgtacgacccgacgtacgaacctacgtacgaaccgtaagggtacctaacggtaccacccggtttaaagccggttaaggaaacccgtaggggtcccgaaaccggtcctaaacggtacggtcgtttaacggaccaacgttaccggtaaccgttaccttaacgggttaattacccgggaacggttcccaaggttaacgctttaaaggttcggtaactcccggacgtttccggggtacaccgggtttaacgtacccggtaaagttccgggtttaccggtgggtcccgtaaccgggg

SEQ ID NO: 29576 - DNA, 667 bp, Homo sapiens
  misc_feature: GYAE6OF01C53T2.1.49.E05.1.454.CMB.1.raw
  modified_base (287)..(287): a, c, t, g, unknown or other
  misc_feature (287)..(287): n is a, c, g, or t
  modified_base (360)..(360): a, c, t, g, unknown or other
  misc_feature (360)..(360): n is a, c, g, or t
tcagacgagtgcgtcacgaccggtgctcgatttagagcgactagcaacacacaaaggggacccaaaaaccacacccctccttgggagaatcccctagatcacagctcctcaccatgggacgggacctggagcatccttttcttggtggcagcagcaacaggtcgcccactccccaggttcacctggtgcagtctggagctgagctgcagagcctgggcctcgagtgatggtctcctgctagtgtcttctggtactacttctttccacctacggtatgtaattggttnagacgacggccccggagacggggtcttaggagtggacgtgggatggatcgacgtccgttaacgaacctaaagngaagtagtaggagtaagacgttaccgagggaccaggtacgtactagtcacgtccgaaccggtcggaacctaaccgaccgtaacccgaacgtaacgtaacccacggtcccttaaacgacgttacggaacttaggggaacggaccgtaccccgttagaacgtacgttacgtacgaaccggtaaccgacggtaccttacgttacttaccgtggaccgtagaaggtccgttaattacgtcggacttaggttccgggtacctacggggtaccttacggtaaccgaccggtttcgtacgggttcgggtacccg

SEQ ID NO: 29577 - DNA, 698 bp, Homo sapiens
  misc_feature: GYAE6OF01CV46W.1.49.E05.1.454.CMB.1.raw
  modified_base (555)..(555): a, c, t, g, unknown or other
  misc_feature (555)..(555): n is a, c, g, or t
tcagacgagtgcgtcacgaccggtgctcgatttagagcgactagcaacacacaaagggacccaaaaccacacccctccttgggagaatcccctagatcacagctcctcaccatggacgggacctggagcattccttttcttggtggcagcagcaacaggtcgccccactcccgaggttccaccgtggtgcagtctggagctgagctgcagacgccgtcgggcctcgagtgtagtcggtctccgtgcgtagtgtctttcgtcggttactacgttcctttaccgtaccgttacggttatagtaggttggtaggacgtaccggaccgggtcccccgggaagggtcgggtcgttaggtaggtgggtacgtgggtagtgggacgtacgtaaccgtacccgttaacggaaaacgtaaaacgagtaaggtaacgtagggaagtaacggtaacgttaccggaaggcgtaagtacgtacaacgtacacgtaccgaccgacgacgacacgtaccgaagtacgacacgtactagtagtacggaagtgaacggtactacgtacgtanacgtacgtacgaaccgaccgacccgtaccttacgttacttaccgaggccgtaacgtagggacttaagttcgtcggtaccacgggttcgtaccgttacgtacccgtaaccgttacccgaggttcgttagggtccggtacccggg

SEQ ID NO: 29578 - DNA, 846 bp, Homo sapiens
  misc_feature: GYAE6OF01CMETK.1.49.E05.1.454.CMB.1.raw
tcagacgagtgcgtcacgaccggtgctcgatttagagcgactagcaacacacaaaggggacccaaaaccacacccctctgggagaatcccctagatcacagctcctcaccatggacgggacctggagcactccttttcttgggtggcagcagcaacgaggtcgccctactccccgaggttccaccgtggtgacgagtctagggagcgtagagctggcaagacgccgtgggacctgaggtgagtgtcctccgtgcgtaggtcgtcttacgttacggttactacgtttcccttttacccgtaccggttaacggttagttaggttaagtttaggttacgaacggaccggtaccggggaccccgggagggtacggggtcgtttagggacggtagggtaggtacgggtagtcggtacgtaccgtacggtaaccccgtttaaacggaaaacgtaaacgtaggtaacggttaggtaacgggaaggtaaccggtaacggttaacggacgggtaacgaacggtaacggtaactaacgttacgaacgtacccggaaccgggtaacgtaacccgtaacgtaccctaaccggaaaccgtacgtaaaccccgacggtaacctaaaaccgtacggtaaggaacggtagggtaaaccgtaccgttaaccctacggtaagtaccgttaacgaaacgggaccccgtaacggaacccgggtaccttaaacgttacgtttaccgaccggaggtacccggtaagtaacgtttagtaaaccggttcggtaacccgtacggttaccggtcccggtagttaaccccgtacggttaacccgtcgggttcgttacgggcggttaacccggg

SEQ ID NO: 29579 - DNA, 716 bp, Homo sapiens
  misc_feature: GYAE6OF01EZVTH.1.49.E05.1.454.CMB.1.raw
  modified_base (554)..(554): a, c, t, g, unknown or other
  misc_feature (554)..(554): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcaccgtggtgcagtctggagctgagctgcagaagccgtggggcctcagtgatcggtctccgtgcagtgcgtttctgggttactattccttttaccaccttacggtattgtaatttggtgtagaccgacgggacccccgggaggacggggtcgttaggaggtggaggtgggattgggatcgaagtcccgttaacggaaactaaaacgtagtagtaagtggaaggaaggtaacggttaccggagggacaaggtacgtacgaacgttcaacgtaccggaacccggaccgggaaccaactaaccgttcccgaacgggtaccgtaaccgtaaacggaccctaacgaaggtacgggtaaacgtaggaacgggtactcccggtanaacggtctacgtacgaacggacgtaacccggtacccgtaagtttactacgtcggacggaccggaagtacgtaaatttggtacgtacccgttacggtcgggtccggttaggtacccgttacggtacccgtaacgggtttcgttaacggggcgggtaacccggg

SEQ ID NO: 29580 - DNA, 868 bp, Homo sapiens
  misc_feature: GYAE6OF01DXBIY.1.49.E05.1.454.CMB.1.raw
  modified_base (191)..(191): a, c, t, g, unknown or other
  misc_feature (191)..(191): n is a, c, g, or t
tcagacgagtgcgtcacgaccggtgctcgatttagagcgactagcaacacacaaaggggacccaaaaaccacaccctctgggagaatccctagatcacagctcctcaccatggacgggacctggagcatccttttcttggtggcagcagcaacaggtcgccactcccaggttcacctggtgcagtctgganctgagctgcacgaagccgtgggcctcgagtgatggtctcctgcagtcgtctttctggttaactgttcctttaccaccgtacggttatagtaacgttggtacgacgtaccgaccggggtccccggaaggtacggggtcttacggtacggttgggtacgtagggtacgttaggacttaccgaacgttaccccgttaaacggtaaacctaaaaccggagtaacggtaacggttacggaacggttaaacgtaaccgggtttacgaacggggtaccgtaaggtaaccgtacgtaaccgttaccggtaaacttaccccggaaacccggggtttaccgaaaccggttaacccgtaaccgtttaaacccccgggaaccgggtttaaaccggtaaccccgtaaccggggaacccccttttaaagaaaccgggtttaaccggggtaaaccggttaaccggggaaacggttaaccccgggtacccttaacgggtaaaccggtaacgttaaccccggtacgggtaacccgaaccccgggttaacccgggtaactttaacccgttttaagttacccggtcggaccggttaacgaacggttaggttactttaaggtcccgaaacgttcggtacgggtcccgtgggtacccttaccggtaacccctggtaccggttcggtgggtaaacccgg

SEQ ID NO: 29581 - DNA, 700 bp, Homo sapiens
  misc_feature: GYAE6OF01CVBCS.1.49.E05.1.454.CMB.1.raw
  modified_base (343)..(343): a, c, t, g, unknown or other
  misc_feature (343)..(343): n is a, c, g, or t
  modified_base (398)..(398): a, c, t, g, unknown or other
  misc_feature (398)..(398): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgattggtctcctgcgtagtgcttgtggttactatttcctttcctaccgttacggttactagtaagttggttgagacgacggcccccggaggaggggtcttggagtggagtgggagtggntcgacggtcccgtaaggaaactaaacgagagtagtaggaggaagaacgtcgaggnagtagtcatcagtacaccgacgacacactaccgacgtacgtacgacgtacctaacagttaggaaccttggaacggtacgacccgtacgaacgaccgttacgtaacggaaccggaccgtaacccgggtacccttaaaccttttaacgttaacccgtacggacccggtaaccgggtaaggtaacgttaacgttttaacgttccggtaccttacccggttcggggtttacccgttaacggggttcccgttaaacgggttaaccccgacgggtttaccgggttcggggttccggggtaacccgggg

SEQ ID NO: 29582 - DNA, 842 bp, Homo sapiens
  misc_feature: GYAE6OF01DFGDC.1.49.E05.1.454.CMB.1.raw
tcagacgagtgcgtcacgaccggtgctcgatttagagcgactagcaacacacgaaaggggacccaaaaaccacacccctccttgggagaactcccctagatcacagctcctcaccagtgggacggacctggagcattccttttcgttgggtggcagcagcaacaggtcgcccactcccgaggttccaccgtggtcgcgtagtcgtggagctggagtctgacaaggacgccggtggggcctgagtgattggtcctccgtgacgtacggtcgtcctttcggttacgttaccttcgtttcccttttaacccgaccggttaaggttacgttaggttaaggttcgggttaacggaaccggtacccggaccccggggtaccccgggggtaaggggtacgggggtcgttagggtaggttgggtaaggtgggtaaggtacggtacgtaccgtaaccggttaacccgttaaaacggaaaacgtaaaacgtaggtaggttaaggtaacgggaaggtaaacggtaacggttaccgggaacgggtacgtaggtaagttaccaacgtaccgtaaccgtaaccggacccgggtacgaaccaccgtacgtacccggaacggtaacgtaacccggacgtaaccctaacggtaaggtaaccggtaaggtacgggaccggtacgacccgtagtaacgtacgttacccgaacgtacccggaacccgtaccggttaaccttacgtttaaccggtacgcgggaaccggtaacggtaagtacgtttaacgttacgtcgtacgttacggttccggtacgtacgtaccgtaccggtaaccttcgggtccgttgggcccggtaccgg

SEQ ID NO: 29583 - DNA, 667 bp, Homo sapiens
  misc_feature: GYAE6OF01EFYNJ.1.49.E05.1.454.CMB.1.raw
  modified_base (237)..(237): a, c, t, g, unknown or other
  misc_feature (237)..(237): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcagtgatggtctcctgcngtgctttcgtgttactattccttttccacgtacggtatagtaattggttgagacgacggtcccccggaggaggggcttgaggtggagtgggatgggactcgacgtcccgttaaacgacgtaaaaacagtaagtagtaggagaaggtaacgttccggaaggtcaagtacgtacatcgaactaccgaccgacgggacaacgaacgttccccaaggtacgtaacgaacggtaccctagtaacgttacgggaaacgttaggaacggacgaccctagaacggtactacgtacggaacccggtacgaaccgtaccttaaacgtttaacgttaccgacggaccggtacggaacgttaaagtatttaaggttccgacgttacggttcggttccgtagtaccgtacgttaacccgagttcgttgggtcggtaacccggg

SEQ ID NO: 29584 - DNA, 679 bp, Homo sapiens
  misc_feature: GYAE6OF01CZRTO.1.49.E05.1.454.CMB.1.raw
  modified_base (130)..(130): a, c, t, g, unknown or other
  misc_feature (130)..(130): n is a, c, g, or t
  modified_base (140)..(140): a, c, t, g, unknown or other
  misc_feature (140)..(140): n is a, c, g, or t
  modified_base (186)..(186): a, c, t, g, unknown or other
  misc_feature (186)..(186): n is a, c, g, or t
  modified_base (414)..(414): a, c, t, g, unknown or other
  misc_feature (414)..(414): n is a, c, g, or t
  modified_base (524)..(524): a, c, t, g, unknown or other
  misc_feature (524)..(524): n is a, c, g, or t
  modified_base (533)..(533): a, c, t, g, unknown or other
  misc_feature (533)..(533): n is a, c, g, or t
tcagacgagtgcgtcacgaccggtgctcgatttagagcgactagcaacacacaaaggggacccaaaaaccaccacccctccttgggagaatcccctagatcacagctcctcaccatggacggacctggancatccttttntggtggcagcagcaacaggtcgcccactcccaggttcacctggtcncagtctggagctgagctgacagaacgccgtgggcctcgaggttgagttcggtcctccgtgcctagtcgtctttcgttggttactactttccttttacccaaccgttacggttattgtaatttggttagacgacgtaccgggacccccgggagggacgggtcttaggaggtagggtagtaggggagtgggactccgtaacgtacccgttaaacggaaaccgtaaaacgngtaagtagtaggaagaaggtaacgttccgagggacaggactcaatacgactaccgaacccggcggtaacaactactaccgaacgtacgtacacgacctacgagtacgtanacggagacncacgagtactacgtacgaacctacgaaccgtcccgtaacttaacgttccagggaccgtacgaagacgtagtttacgtacgtaccgtacgttccggtaccgttcggacgttaaccgtaacgtccggttcgttggtccggtacccggg

SEQ ID NO: 29585 - DNA, 751 bp, Homo sapiens
  misc_feature: GYAE6OF01C7AGN.1.49.E05.1.454.CMB.1.raw
  modified_base (234)..(234): a, c, t, g, unknown or other
  misc_feature (234)..(234): n is a, c, g, or t
tcagacgagtgcgtcacgaccggtgctcgatttagagcgactagcaacacacaaaggggacccaaaaaccacacccctccttgggagaatccctagatcacagctcctcaccatgggacgggacctggagcatccttttctggtggcagcagcaacaggtgcccactcccaggttcacctggtgcagtctggagctgagctgcagagccgtggggcctcagtgatggtctccgngcagtcgcttcgtggttacacttccttttccacgtacggtatgtaagttgggttgagtaccgacgggccccggaggacggggtcttggaagttggagtggggactggtaatcgtaaccggtacccgtttaaacggaaacgttaaaaccgaggtacggttaagagggaaggtaaggtaacggttaccggaagggtaccaaggtaacggtacaacgttacgaacgtaccgaaccgacgggtaaccaaccgaacgttacccgaacggtaacgttaaccgacgtaccctaagtaacgtacgggtaaacctggggtaacgacgtaccgtacgtaacggtacgttaccgacggaacccggaccgtaacccgggtacccttaaacgttttaacgttaaccgtcgggtaacccgaacggtaaggtaacttacgtttacggttaccgacggttaaccggttccgggttaccgttacgtacccgttacggtaacccgtaggttccggtttagggcgggtaacccggg

SEQ ID NO: 29586 - DNA, 739 bp, Homo sapiens
  misc_feature: GYAE6OF01DNB0T.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttctggtggcagcagcaacaggtgcccactcccaggttccacctggtgcagtctggagctgagctgcagagccgtgggcctgagtgatcggtctccgtgcaggtcgtcttcgtggttactacttcctttacctaccgtacggtatagtaagttggttacgacggtacgaccgggcccccgggagggacggggtcgttgggaggttcgggaggtgggagtgggactacgtaccgtaccccgttaaacggaaaacctaaaacgaggtaacgtaggtaggaacgtaaggtaaccggttacggacgggtacgaagtacgtactaacgtccgaacgtccgaacccgggtaccggaacctaacgacccgttaaccgaacggtaacgtacaacgtacctaagtacgtagggaacgtaggacgtaccgacctacgaacgtacgtacgtacggaacccgtaaccggaccggtacccttaacgttacttaaccggtcggtaccggaacggtagtaagttacgttagtaccgtacgttaccggttcggtaccgttacgggtaaccttaccgggtaaaccccgttagggttccggttgggtcgggtaaccccggg

SEQ ID NO: 29587 - DNA, 707 bp, Homo sapiens
  misc_feature: GYAE6OF01B2XDT.1.49.E05.1.454.CMB.1.raw
  modified_base (157)..(157): a, c, t, g, unknown or other
  misc_feature (157)..(157): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaanaggtgcccactcccaggttcacctggtgcagtctggagctgagctgcagaagccgtggggcctcgagtgagtggtctccgtgcgagtgtcttcgtggttactactttctttccgaccgttaacgtattgtaagttggttacgagtacgaccgggccccggaggacgggtcgttggaggtggacgtagggagtggactcgaacgtacccgttaacggaaacgttaaaacgagtacgtaagtacgggaagtaagggtaacgttaccggaagggtcgaacggtacgtacgaacgttacgaaccgttaccggaacccggaccgtaacgtaccgaacgttacccgaacggtaacttaaccgacggtaacctaacgacgtaacgggaactggaacggtacctccgtacgacgtagtacgtacggaaccgaccgaccggtaaccttacgttaacgtacgcgtacggaacggaactaagtaactttaggtcgaacttcggttccggtaccgtaggtaccgtaacgttaacccgtacggttcgttgggcccggtacggg

SEQ ID NO: 29588 - DNA, 753 bp, Homo sapiens
  misc_feature: GYAE6OF01D17JH.1.49.E05.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtcgcccactcccaggttcacctggtgcagtctgganctgagctgcagacgcgtgggcctcagtgngtgtctcgtnacgtgtgtcttcgtggttactagttcctttccacgttagtactagttaagttggtagtacgaccggtaccggggaccccggtaggacggggtcgttagggtaggtacgggtaggtagggtagttacggacgttaccgaacggttacccgttaaccggtaaaaacgtaaaccggtaggtaacggtaacgtagggaacggtacggtaaacgttacggacgggacaggtacgtacagttacgactacgtaccgacgaacacgaactaccgaacgaacgtaccacgtacctaagtggtaacgacgtacgggacgttacgccgttagacgtaactcccggtaacgaacccggtacggtacccgttaaccttacgtttaacggtaccgtcgggtaacgacggtaacgtttacggaacgttttaggtcccgaagttcccgggtttacccgggttaccctcgggtttaacttaaaccccggttacgaacccgggttttacgttcggggtacggtaacccccgggg

SEQ ID NO: 29589 - DNA, 795 bp, Homo sapiens
  misc_feature: GYAE6OF01E13QY.1.49.E05.1.454.CMB.1.raw
tcagacgagtgcgtcacgaccggtgctcgatttagagcgactagcaacacacaaaggggacccaaaaaccacacccctcttgggagaatcccctagatcacagctcctcaccatggacgggacctggagcatcctttcttggtggcagcagcaacaggtcgcccactccccaggttccaccgtggtgctacgtcgtggagcgtgagctgcagacgccgtgggccctgagtgagtggtcctcctgcgtagtcgtcgtttcgtcggttactactttccttttacccgaaccgttacggttatacgttaagttggttacgacgtaccggaccggacccccgggagggtacgggtcgttaggacggtagggaggtaggggagttacggacgtaccgtaccggtacccgttaaaacggaaaccgttaaaacgaggtaacgtacggtagggaacgtaaggtaaccggtaccgtaaggggacctaaggtagttacccgaagttacccgaacgtacccgaacccgggaccgtaaccgacccgtaaccctacccggtaaaccggtacgttaaacccgaccggtaaccctaacgtaaacggtacggtaaccggtaggaacggtaccgtaccgtaacgtaagtcccgtaacgacgtaaccggaaccgtccgggtaaaccttcgttaacgttaccggtcgtaacggtacgaaaggtttgtaaaccgtttcggtacgtacccgttacggtccggtaccgtagtacccggttaacgaccgttcggttacggttacgggcggtaaccggg

SEQ ID NO: 29590 - DNA, 813 bp, Homo sapiens
  misc_feature: GYAE6OF01EMK4S.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccatggacgggacctggagcatcctttctggtgcagcagcaacaggtcgcccactcccaggttccacctggtgcagtctggagctgagctgcagacgccgtggggcctcgagtgagttcggtcctccgtgcgtagttcgtcctttacgttacggttactactttcccttttaccaaccgttacggtacgttaggttaagtttgggttacggaacgaccggtacccgggacccccgggtaggggtacgggggttcgttgggtacggtggggtaggttaggggagttgggtacgtacgtaccggtaccccgttaaacggtaaaaccgtaaaccgtaaggtaaggttaacgtaggggtaaacgtaacggttaaccggttacggaagggtaccgtaacggtaacgtactacgtaccgtaccgtaccggacccggtacgggaacctaaccgtaccgtacccgaacggtaaccgtacgaccgtaacctaacgtaacggtaacggtaacgtacgggaaccggtacgtacccgtaagaccggtagtaccggtaaccgaaccggtaaccgtacccggtaactttaaccggttaccgttaccgacggtaccggtaacgtaaggttaaccttaggttacgtaccggacgttcggttaccggtcgtacgttaccggtaccgtaaccgtcggttacggttgggccggtaacccggg

SEQ ID NO: 29591 - DNA, 663 bp, Homo sapiens
  misc_feature: GYAE6OF01CNRG8.1.49.E05.1.454.CMB.1.raw
tcagacgagtgcgtcacgaccggtgctcgatttagagcgactagcaacacacaaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtggggcctcgagtgatggtctcctgcagtgcttctggttactattccttttccaccttacgtatgtaagttggtgacgacgaccgggcccccggaggacggggtcttaggaggtagggagtgggagtggagtccgacggtacccgttaacggaaactaaaacgagtaagtagtaggaagtaggtaacgttccgaagggacaggtagtcaatacactacgaccggacgacaactacgtaccgaagacgtaacacgacctaagagtacggaacgtcggaggacgaccgtagagtacgtcgtacggaaccgaccgaccggtacccttaatttaacgttacgtacggaccggacgaaggtaacgttagtttagtacgtaccgtacggttccggtccgttacggtaccgttaaccggtaacccgtacggttccggttcgggtcggtaacccggg

SEQ ID NO: 29592 - DNA, 674 bp, Homo sapiens
  misc_feature: GYAE6OF01A7TX1.1.49.E05.1.454.CMB.1.raw
  modified_base (350)..(350): a, c, t, g, unknown or other
  misc_feature (350)..(350): n is a, c, g, or t
  modified_base (502)..(502): a, c, t, g, unknown or other
  misc_feature (502)..(502): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttgggtggcagcagcaacaggtgcccactcccaggttcacctggtgcagtctggagctgagctgcaggagccgtgggcctgagtgatcggtctccgtgcgaggtgtcgttcgtaggttacattccgttttacccacgttacggtatgtaagttggttgaagaccgtacgggacccccgggaggtacggggtctgggacggtgagtggagngtaggacgtcacgtccgtaacgaactaaacgagtagtagtacggagtagtacgtaccgaggacaggagtactaatcgacgtacgacgacgacacactacgacgtacgtacgacgtaccaacgagtacggaactacggacggtactaccgtanaagtacgtaccgtacggtaccggaacggtaccgtaaccgttaacttaacggtttaccgacggtaccggtaacgtaggaacggtttaacgttagttaccggtacgttacggttacccggtcggttacgtaaccggttcgtaaacccggccggttcggttcgggtaacccgggg

SEQ ID NO: 29593 - DNA, 724 bp, Homo sapiens
  misc_feature: GYAE6OF01ELLN1.1.49.E05.1.454.CMB.1.raw
  modified_base (594)..(594): a, c, t, g, unknown or other
  misc_feature (594)..(594): n is a, c, g, or t
  modified_base (600)..(600): a, c, t, g, unknown or other
  misc_feature (600)..(600): n is a, c, g, or t
  modified_base (631)..(631): a, c, t, g, unknown or other
  misc_feature (631)..(631): n is a, c, g, or t
tcagacgagtgcgtcacgaccggtgctcgatttagagcgactagcaacacacaaaggggacccaaaaaccacacccctccttgggagaatcccctagatcacagctcctcaccatgggacgggacctggagcatccttttcttggtggcagcagcaacaggtcgcccactcccgaggttcaccgtggtgcagtcgtggacgctgacgctcgcgaggtaacggccgtggggcctcgaggtgagtcggtctccgtgctgtcgtctttcgtaggttactacgttcctttaccctaccgttacggtattagttaacgtttggttacgaacgtaccggacccggggtcccccggggtagggtaccggggtacgttgggtacggtgggtacggtgggtacgttgggaacgttaccgtaaccggtacccgttaaacggaaaacgtaaaacggtaggtaacggttacgtagggaagtacgggtaaacgttaccggaagggacgtagtacggtactaacgactaacgtccggaaccggacggaacaactacgaccgtaacggtactaccgacgtactaacgaggtacggaacgtggacgtacnccgtanagtacgtctacggaacgaccgccgtaacctntttacgacgcggtacgacgtagacttagttgccggtatccggttcgtcgtacggtcccttaacgtaacccgtgttcggtcggtcggtaaccgg

SEQ ID NO: 29594 - DNA, 758 bp, Homo sapiens
  misc_feature: GYAE6OF01ENIWQ.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccagtgggacgggacctggagcattccttttcgttgggtggcagcagcaacgaggtcgcccactcccgaggttccaccgtggtgctagtcgtggagctgagctgacaggacgccgtggggcctcgagtgagtggtcctcgtgctaggtcgtcttcgtaggttactacgtttccctttaccgaccgttaggttataggttaagttggttagacggaccgaccgggaccccggtagggtacgggtcgttagggtaggtacggtaggtacgggagtacggtacgtaccgtaacggtaacccgtttaaacggaaaaccgtaaggaagtaggttaaggtaggaacgtaaggttacgtaccggaggtaccgtagacgttacacgttacgaccgtaccgacgggaccgaactaccgtacgtaccgagtaactaccgtaacgacctacgaaggttaccggaagtacgggaactacgaccgtagaagttacccgtagaaccggtaaccgaacccgtacggtacccttaagttaccgttacgacggtaccggtaggtaagttacgttagttaacggttcgaaccgttaccggttcgggtcccgttaggtacccttaaacggttacccgaccggtttagttcggggccggttaaccggg

SEQ ID NO: 29595 - DNA, 695 bp, Homo sapiens
  misc_feature: GYAE6OF01B4ZOQ.1.49.E05.1.454.CMB.1.raw
  modified_base (245)..(245): a, c, t, g, unknown or other
  misc_feature (245)..(245): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgtcttntggttacagttcctttccacgtacgtatgtaattggttgagacacggccccggaggagggtctggagtggagtgggatggatcgacggtaccgttaacggaactaaaacgagaagtataggagagtaagtccgagggacagacgtcatcagtcgaccgcgacacactaccgacgacgtaccgagtacctaacgaagtaacgggaacgtaggaacggtacgtcccgtaacgtacgtacgttacgaacggaaccccggtaaccggaaacccggggttacccttaaccgggttttaaactttacccggttaacggccgtacgggttaaacggtacgggtttaaattaacggttacggtaccccgttaacgggttaccggttcccgttacgggtacccgttaacgggtaaaccccttaccgggtttcggtttaccggggtcgggtaaccccggg

SEQ ID NO: 29596 - DNA, 900 bp, Homo sapiens
  misc_feature: GYAE6OF01CMEQC.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatgggacgggacctggagcattcctttttcgttgggtggcagcagcaacgaggtcgcccactcccgaggttccaccgtggtcgctagtctggagcgtgagctgcagacgccgtcgggcctgagtgtagttcggtctcctgcgtacgtcgtctttcgtgttactactttcctttaccacgttagtagtagtaagttggtacgacggaccgaccgggaccccggtaggtacggggtcttagggaggtaggtaggtagggtacgtaggtactaccgtaaccggtaaccgttaaaacggaaaacttaaaacgagggtaacgttaaggtaggtaacggtaacggttaacggtacgagggtaacgaaggtaacgtacgtacgtaacgacgtacccgaaccgggactaaccgaacgtacgtaacccgaacggacttaaaccgaccgtaaccttaacggacggttaacgggtaaccggtagggtaaacccggtccggttaacctacggtaaacggttcccgtttaacggaaaccccgggtaacccgtacccgggtaaaccccgttaaccgttttaaacccggttttaaccgtttaacccgggtaacccgggacggtaaaccgggtttaaacggttacgttttaaaaacgtttcccggtaccggtttaaacccggtttaaccccggggtttcggggtttaccccgttaaccggggtttaaccggtttaaccccgggtaaaaccgtttccccggggtttaacgggttccggggggtaaacccgggtttaaccccggg

SEQ ID NO: 29597 - DNA, 638 bp, Homo sapiens
  misc_feature: GYAE6OF01BLBVR.1.49.E05.1.454.CMB.1.raw
  modified_base (422)..(422): a, c, t, g, unknown or other
  misc_feature (422)..(422): n is a, c, g, or t
  modified_base (442)..(442): a, c, t, g, unknown or other
  misc_feature (442)..(442): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatggtctcctgcagtgcttcgtggttacattcttttccaccgttacggtatgtaattggttgagacgacggcccccggaggaggggtcttggaggtggagtgggatggatcgacgtacccgttaacggaaactaaacagagtagtaggagaggtaagttcgagggcagagtcatcagtccgaccgacgacacgacnccgagactacgacgacctanacgtacgaacgtggacggacgccgtacgacgtattcgacgaaccgaaccgaccgggtacccttaactttaacgttacgtacggacccgtacggaacggtagttaacgtttagttaccggtaccacgggtttccggttcccgtacgggtaccgttaaccgtaaaccggtaccgttcggttcgggtcgggtacccggg

SEQ ID NO: 29598 - DNA, 734 bp, Homo sapiens
  misc_feature: GYAE6OF01BHJ7Y.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgctagtgcttcgtggttacattctttccacctacggtatgaattggtgagacgacggcccccggaggaggggtcttgagtggagtgggagtggatcgacggtacccgttaacggaaactaaaacgaagaggttaagtagggaaggaaggtaaacggtttaccgaaggggtacgaggtaacgtacacgtacgtaactccgacccggacgggtaacaacgtaacctacccgaaccggtaaggtaacccaacggtacccttaaccgaagtaccgggaaacgttagggaacgggtaccgacccgtacgtaagtacgttacgtacgaaccgtaaccgaacccggtaacccttaactttaaccgttaaccgtacgggaccgtacggaaacgtaacggttacgtttaaagttacggtaccgtaacggtttcccgggttacccggttcggtaaccgttaccggtaaaccccgttaccggttacgtttacgggtggggtaaccccggg

SEQ ID NO: 29599 - DNA, 780 bp, Homo sapiens
  misc_feature: GYAE6OF01DMFQK.1.49.E05.1.454.CMB.1.raw
  modified_base (162)..(162): a, c, t, g, unknown or other
  misc_feature (162)..(162): n is a, c, g, or t
  modified_base (258)..(258): a, c, t, g, unknown or other
  misc_feature (258)..(258): n is a, c, g, or t
  modified_base (341)..(341): a, c, t, g, unknown or other
  misc_feature (341)..(341): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtncccactcccaggttcacctggtgcagtctggagctgagctgcagacgccgtggggcctcgagtgagttggtcctcctgcagtgtcttcgtgttacnttcctttaccaccgtacgttatagtagttgtagacgacgacggccccggagggacgggtcgttaggacggtggtaggtagggngttagggactaccgtaccgtacccgttaaacggaaaaccgttaaaacgaggtagtaagtacgggaaggtaaacggtaacggttaccgggaagggtacgtaaggacggtactaagtacctaacgtaccgaaccccgggacggaaccaaccggtaacctacccgggtaaacgtaacggtacccgtaaaccgaccttaaacgaacgtttacgggaacgttacgggaacggaccgtacccgtagtaacgtaccttacggtaacgaccgaacccggtaacgggttacccttaagtttaaccgttacgttcggaaccgtaccgtaaggtaagttaacgtttacgttcggaaccgttaccgggtttcggtaccccggttacgggttaaccttaacggttaacccgtaaccggttttcggttaccgggtccggggtaaaccccgggg

SEQ ID NO: 29600 - DNA, 906 bp, Homo sapiens
  misc_feature: GYAE6OF01DRC3E.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttcgtgtacattctttccacctacgtatgtaattggttgagacgacggcccccggaggaggggtcttggagtggagtgggagtgggatcacgtaccgttaacggaaactaaacgagaggtagtacggaaggtaaggtaaggttacccgaaggggtaccgaaggtaacggttcctaagttaccgaacgttacccgaacccgggtaccggggtaaaccgtaacccgtaaccgttaaccccgtaaacccgggtaaacggttaaacccgaaccgggtaaccccttaaacgtaacggtttaacggggtaaacccgtttacggggaacggggtaacggtacccccggtttacgaaccgggttaacgtttaacccggtttaaccggggaaacccggtaaacccgggtaaaccccgggggtaacccctttaaaccgtttttaaacccgtttttaaaccccggttcggaacccgggttaacccggtaaaaccgggttaaacggttttaaacgttttaaaccgggttttaccgggtaaccggttaacccggtttttaccgggggttacccccgtttaacgggggttaaccccggttttacccgggtttaaaaaccccggtacccgggttttaccgggttttaaccgggggttcccgggggttaaaccccggggg

SEQ ID NO: 29601 - DNA, 693 bp, Homo sapiens
  misc_feature: GYAE6OF01COXZ5.1.49.E05.1.454.CMB.1.raw
tcagacgagtgcgtcacgaccggtgctcgatttagagcgactagcaacacacaaaggggacccaaaaccacacccctcttgggagaatcccctagatcacagctcctcaccagtggacgggacctggagcattccttttctggtggcagcagcaacaggtcgcccactcccaggttccaccgtggtcgcagtcgtggagctgagctgcagacgtccgtgggcctgaggtgtagtcggtcctccgtgacgtgttcgtcgtttcgttacggttactacgtttccttttaccaccgttaggtattagttaagttggtagaacggtaccgaccgggtacccccggagggtacgggtcgttaggaggtaggtagtagggtagttgggactacggaaccgtaccgttaaacggaaaaccgtaaaagtaggtaagtaaggtagggtaaacggaacggtaacgttacggaacgggtacgaaggtacgtttacgaacgttacgacgaccgacggacgacactacgacacggatactacgacctatacgacgtacgtaggacgactaccgtagaactacgtacgaaccgaaccgccgtaaccggtactacgtttactaccgtacgacgtagagtacgtagttacgtcgtagaccgttgttccgtagtccgtaaccgtcgtacgttcgtgggtacgtacccggg

SEQ ID NO: 29602 - DNA, 1030 bp, Homo sapiens
  misc_feature: GYAE6OF01E0YQD.1.49.E05.1.454.CMB.1.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (1015)..(1015): a, c, t, g, unknown or other
  misc_feature (1015)..(1015): n is a, c, g, or t
tcagacgagtgcgtcacgaccggtgctcgatttagagcgactagcaacaccaaggtggaacccaaaaaccaccacccctcttgggagaactcccctagatcacagctcctcaccatgggacgggacctggagctattccttttgttgggtgcagcaggacaacgaggtcgcccactccgaggttccaccgttgggtcncgtaggtcgtggacgtctggacgtctcggacgaaggaaccggtccggttggggcccttagagttggtacgttcgggttccttccgnggctaggttcgttccgttttacggtacgtttaccttactttccccgtttaccgtaaccggtttacggttaagttacggtttaaggtttcgggtacggaaccggtacccgggtacccggggtaccccgggggtaaggggttacgggggttacggtttagggtaacggggttacgggtagggtacggggtacgttacgggtaacgttaccgtaaccgggttaaaccccggttaaaacgggtaaaaaacgttaaacggtaaggtaacggttaagggttaaacggggaaacggttaaacgggttaacccggtacgggtaacgggtaaggtaacggtaacgtttacgaaccgtttaccgaaccggttcccgggaaacccggacggtaacctaaccgtaacccgtaaccggtaacggtacctaacgtaccgtacggtaaacctagggtaaccgggtacggtaacgggtaccgtaaccggttccgtaacggtaacggttcccggtaacgtaccgggtaaaaccccgggtacccggtaacccgggttttaacctttaaaccggttttacggttaacccgggggaccgttaaccgggtaaggttaaccgggttaaatttaccgggtttaaacggtcgggtttaccccgtaagggttcccgggtttaacccgggttcggtaaaacccggttttacccgggtaacgtttacccgggtttcccggggtttaaacccggggggngtaaacccccggggg

SEQ ID NO: 29603 - DNA, 632 bp, Homo sapiens
  misc_feature: GYAE6OF01EQM9V.1.49.E05.1.454.CMB.1.raw
  modified_base (535)..(535): a, c, t, g, unknown or other
  misc_feature (535)..(535): n is a, c, g, or t
tcagacgagtgcgtcacgaccggtgctcgatttagagcgactagcaacacacaaaggggacccaaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgagtggtctctgcagtgcttcgtggttacattctttccaccttacggtatgtaagtttggttgagtacgacggcccccggaggacggggtcttggaggtggagtgggagtggatcgacgtacccgttaacggaaactaaaacgaggtagtagtggaagagtaacggttaccgagggaccagtagtacatcactaccgacgacggacacacgtaccgacgtaacgtacacgacctaagacgtacggaactaggaagcgaccgtacgagtactacgtgaaccgaccgacccgtacttaccttaacgttacnggttacgacgtaagtagtatttaacgttcgtacgtacgttcgggttaccgttggacttaacggtaacccgtagtcccggttggtccgggtacccggg

SEQ ID NO: 29604 - DNA, 779 bp, Homo sapiens
  misc_feature: GYAE6OF01BUQV3.1.49.E05.1.454.CMB.1.raw
  modified_base (182)..(182): a, c, t, g, unknown or other
  misc_feature (182)..(182): n is a, c, g, or t
  modified_base (256)..(256): a, c, t, g, unknown or other
  misc_feature (256)..(256): n is a, c, g, or t
  modified_base (745)..(745): a, c, t, g, unknown or other
  misc_feature (745)..(745): n is a, c, g, or t
tcagacgagtgcgtcacgaccggtgctcgatttagagcgactagcaacacacaaaggggacccaaaaaccacaccctctgggagaatccctagatcacagctcctcaccatggacgggacctggagcattccttttcttgggtgcagcagcaacaggtgcccactcccaggttcacctggtnctagtctggagctgagctgcagagcctggggcctcagtgatcggtctccgtgctaggtgtcttcgtggttactntttcctttaccgacgttacggtatggtaacgttcggttagacggtacgccgggaccccggaggtacggggtcttgggaggtggtaggttagggacgtggacgtacgtaccgtaccgttaaacggaaacttaaaacggacgtaagtagtagggaagaacggtaacggtacggaggtacgaaggtacgtacacgtaccgttacgaccgaaccggcgtaactaaccgtacggacccgtaacgtaacgttaacccgacggtaaccttaaccggtaaaggtacgggtaaccgtacgggaaccgggtaccgcccggtaacgtacggtaacttaccggaccggttaacgggacccgtaaaccgggttacccctttaaagttaaccctttacggaccggtaccgggtaacgacgggttaaacttaggtttaccggttaccggtacgtttaccgggtacggtttcccgggtacggttaccttaaccgggttaaacccngggtttaccgggtttgggccgttaaacccggggg

SEQ ID NO: 29605 - DNA, 886 bp, Homo sapiens
  misc_feature: GYAE6OF01DGJ9C.1.49.E05.1.454.CMB.1.raw
  modified_base (358)..(358): a, c, t, g, unknown or other
  misc_feature (358)..(358): n is a, c, g, or t
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtcgcccactcccaggttcacctggtgcagtctggagctgagctgcagaacgccgtggggcctcgagtgatggtcctcgtgctagtcgtcttcgtcggttactattcctttaccaccgtacggttatagtagttgttgacgacgaccggccccggaggtacgggtcttaggacggtaggtgtacgggcgtaggtactacncggtaaccgtaacggtaaaacaaaacgtagaaggtaagtacggaaggtaacgtaacggttccggaacgggacgaagtacggtctaacgacgtaaccgtaccggaccccggtaggaaccgaacctaaccgtaacccgtaacggtaaccggtaacccgtaacgggtaaccccttaaacggaagtaaccggggtaacgtacggggtaaccggtaccgtaacccgtttacgggaaacgttaccgtttcggtaaaccgtaacccggtaaaccccggtaaccccggggttacccttaaaccggtttttaacccgtttaaccgggtaccgggtaacccgggtaacccggggttaaaagggtaaaccccgggttttaaagtttaacccggtttaacgggtaccccgtttaaacccggggtttcccgggggttttaaccgtaccccggggttaaccggtttaaaacggtttaaaccccccggttcgggttttaacccggggttacgggggttttacccgggggtaaaccccccgggg

SEQ ID NO: 29606 - DNA, 807 bp, Homo sapiens
  misc_feature: GYAE6OF01CZRT1.1.49.E05.1.454.CMB.1.raw
  modified_base (183)..(183): a, c, t, g, unknown or other
  misc_feature (183)..(183): n is a, c, g, or t
  modified_base (379)..(379): a, c, t, g, unknown or other
  misc_feature (379)..(379): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatcctttctggtggcagcagcaacaggtgcccactcccaggttccacctggtnctagtctggacgctgagctgcagagccgtggggcctcagtgatcggtctcctgcagtgcttcgtggtactatttcctttaccgtacctaggtactagtaacgttggttagacgtacgacggtccccggaggacggggtcttggacggtggagtcggagtaggactccgacgtaccgtaaacggtaacctaaaacgngtaggtagtaggacgtaaggacgttaccgaaggtcaaggtacgtacacgtacgtaactccgaacccggtacggaacctaactaccgtaaccgaaccgtacgggtaaacctaccggtaaccgtaaccgtaaggttaaccggaacggttaccgggaacggtaccggtacccgtaacgtaacgggtaacgttaccggttaacggaacccgtaaccgggtaacccggtaccttaaacgttacgttacccggttaggggaaccttaacggggtaacgtaaccgggtttaactttaaccggttaaccgggtaccctttaaaccggggtttccgtaccccggggtttaaggaccccggtttttaaaccccggttaaaaccccgggttaccggggtttaaccgtttagggggaacccgggtttaaacccccggggg

SEQ ID NO: 29607 - DNA, 756 bp, Homo sapiens
  misc_feature: GYAE6OF01EBDU0.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagacgccgtggggcctcgagtgatggtctcctgcagtgcttcgtggttacattcttttccaccgtacggtattcgtaagttggttagtagaccgtacgggccccccgggaggtacgggggtccttgggtacggttggggagtggggacgttgggactcgacggtaccccgttaacgggaaacctaaaacgacggtaagttagacgggaaggtaacggtaacggtttacccggaagggaccgaaggtaacggtacctaagttaccgaacttcccgaacccgggaccggtaaccaaccgtaccgtaaccccgaacgggtaacgtaaccgaacggtaccccgtaaacgacggtacgggtaaccgttaggaacggaccgtaccgttacgaacgacgttacggtacgaaccggtaacgacccggtaccttaaccgtttaacgttacgtcggtaccggacggtaacgacgttaacgtttacgttacggtactacggttcgttaccggtcggttaccttacggtaaaccctaccggttcgttcgggtcgggtaacccggg

SEQ ID NO: 29608 - DNA, 798 bp, Homo sapiens
  misc_feature: GYAE6OF01C2A41.1.49.E05.1.454.CMB.1.raw
  modified_base (469)..(469): a, c, t, g, unknown or other
  misc_feature (469)..(469): n is a, c, g, or t
tcagacgagtgcgtcacgaccggtgctcgatttagagcgactagcaacacacaaaggggacccaaaaaccaccacccctccttgggagaactcccctagatcacagctcctcaccagtgggacgggacctggagctattcctttttcttgggtggcagcagccaacgaggtcacccactcccgaggtttccaccgttggtcgcaggttcgtgggacgtcgtaggacgtcgtaggacgaaggaacggtcccggttcgggggcccttacggtaaggttcggtaacgttcggttcccgtccgttggacgtaggttcgttccgttttcgttacggtttacctacgttttccttttacccgtacgttacgttagtagttagttggtagaccggacgtaccgggcccggagggtcggtctagggtacgtggtagtagggagtaggactacgaccgtaccgttaaggaacgtaagngtaagtaggagaaggaaggttacgtacggaggtacgaggtactacgactacgtaccgtccgaaccgaccgaccgtacgaaccgtaccgaacgtaacgtacacgtaccgttaagacgggtaacgtaccgtacggacgtaccgtaccgtaagaccgggttactcgggtaacccgacgtaacccggtaccgtaacccttaaggtttacctaccgggtaccgtacggtaaacggtacgttaggttaacgttcggtacccgtacgttcgggttacgtccggttaacgtccggtttaaccacccggttaggtttcccggtggtcggggtacccgg

SEQ ID NO: 29609 - DNA, 1001 bp, Homo sapiens
  misc_feature: GYAE6OF01B8TU6.1.49.E05.1.454.CMB.1.raw
  modified_base (196)..(196): a, c, t, g, unknown or other
  misc_feature (196)..(196): n is a, c, g, or t
tcagacgagtgcgtcacgaccggtgctcgatttagagcgactagcaacacacaaaggggacccaaaaaccacacccctccttgggagaatcccctagatcacagctcctcaccatgggacgggacctggagcatccttttcttggtggcagcagcaacaggtgcccactcccaggttcacctggtgcagtctgganctgagctgcagaagccgtgggcctcgagtgatcgggtctccgtgccgtagttgtcctttcgtacgggttactacgttaccttttacccgaaccgttaccggttaattacggtaaagttttcggggtttaggaacggtaaccggtaccgggtacccccccggggtaagggtaacgggggggtccgttttagggacggggtttacgggtaacggttgggggtaacgtacgggtacgtacccggtaaacggtaccccggtttaaaccggggaaaaccttaaaaacgaaggtaacggtacggtagggaacgtaagggtaacgtttaaccgggaaggggtaaccgtaaggtacgtacgtaaacgttaccgaacgttacccggtaaacccgggtaccgggtaaccgtaacccgtaaccgtttaaccccggaaaccggttaaaccggtaaccggtaaacccggttaaccccttaaaccggaaacgggtttaaccgggtaaaccggttaaccggggtaaaccggggtaacccgttaccccgttaaacgtaaccgggttaaacgttcccgggtaaacggtaaaccccgggaaccgtaccccgggttaaacccgtttaaaccgttttaccgtttaaaccggtccgggtaaccgggtaacccggtaaagggtaaacccgtttaaggttaaccgtttaccggtaacccgggtttaccgttacgggggtttaccccggtacggggttaaccctttaaacccgggtaaccccggtaaccgggtttacggtttaacgggggtcccgggttaaacccgggg

SEQ ID NO: 29610 - DNA, 682 bp, Homo sapiens
  misc_feature: GYAE6OF01B7UI5.1.49.E05.1.454.CMB.1.raw
  modified_base (403)..(403): a, c, t, g, unknown or other
  misc_feature (403)..(403): n is a, c, g, or t
  modified_base (517)..(517): a, c, t, g, unknown or other
  misc_feature (517)..(517): n is a, c, g, or t
tcagacgagtgcgtcacgaccggtgctcgatttagagcgactagcaacacacaaaggggacccaaaaaccacacccctccttgggagaatcccctagatcaacagctcctcaccatggacgggacctggagcatccttttctggtggcagcagcaacaggtcgcccactcccaggttcacctggtgcgagtctggagctggagctgacagtaagccgtggggcctcgagtcgatcggtctccgtgacaggtcgtcttcgtgttacagttcctttaccacgttacggtatacgtaagttggtacgacgacgaccgggccccgggaaggtacggggtcttggaggtacgggagtacggggtatagggactaccgaacgtacccgttaaacggaaaactaaaacgngtaagtaggtaggaacgaaggtaacgttaccggagggacgtaaggtacgttacatacgtactaccgaccggacgtacaacacgtaccgaacgtagaccgacgtaccgtaaacgngtaacggaactaggaaccgtcgtacctacgagtaatcggtacgaaccgtaccgacggtacctaagttactacggtgaccggtagtacgtactagtttaccgttcggaccttacgttcggtccgtacggtcgtaaccggtaacgttacgcggttggccggtaacgg

SEQ ID NO: 29611 - DNA, 784 bp, Homo sapiens
  misc_feature: GYAE6OF01CZSXA.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagaagccgtggggcctcgagtgagtggtcctccgtgctagtcgtcttcgtggttactactttccttttaccctaaccgttacggttataggttaacgtttgggttaggacggtaccggaccggggtaccccccgggagggtacgggggtccgttagggacgggttggggaaggtggggtagttacgggacgtaccgtaaccgggtaccccggttaaccgggtaaaaaccgttaaaaacggaaggtaacggttaaggtaacgggggtaaaggtaaacgggtaaaccggttaccggacggggtacggtaaggtaacggtacgtaacgtaccgtaacgttaccccggaacccgggaccgggaacctaacccgtaccgttaacccgaacggtaacgtaacccgtaccgtaacccgtaacgtacggttacgggaacgtaggaacggcgtaccgtacgaacgtactcgtacggaacccgtaccggacccgtaactacgtttacgtacgtcggacggtacgtagagttacgttagtcgactacggtcggtccgtagtccgtacgtaccgtgttcgtggtcgggtaccg

SEQ ID NO: 29612 - DNA, 856 bp, Homo sapiens
  misc_feature: GYAE6OF01BOCDU.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttgggtggcagcagcaacaggtcgcccactcccgaggttccaccgtggtgcagtcgtggagctgagcgtgacgagacgccgtggggcctagagtgagtcggtcctccgtagcgtagtcgtcgtttcgtggttactacgtttccttttacccgaaccgttacggtattaggttaacgtttagggttacggaacggtaccggtacccggggaccccccgggtagggtacgggggttcgttagggacgggttgggtaaggtaggggtagtagggtacttaccggtaacggtaaccccggttaaaaggtaaaacctaaaaggtacggtaaggttaggtaacgggtaaaggaaacggttaacggttacggaacgggtacgtaacggtaacggtactaacgtaacgtaaccgtcccggtaacccggacggtaacctaaccgtaccgtaacccgtaaggtaaaccgttaccgaaccgttaaccgtaaaccgaaggttacgggtaaaccggtaggtaaaccggtaccgaccgtacgaacgttaccgtaccggtaaccgacccggtaacgtacccgggtaccttaacgttacgttacgaccggtaccgtaggtaacgtagtttaacgttacggtcgtaccgttaccgggtttccggtacccgttacggtaccgttaaacccgtaccggtaccggtttaccgggttaggggccgggtaacccggg

SEQ ID NO: 29613 - DNA, 808 bp, Homo sapiens
  misc_feature: GYAE6OF01B2JOI.1.49.E05.1.454.CMB.1.raw
  modified_base (710)..(710): a, c, t, g, unknown or other
  misc_feature (710)..(710): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcacctggtgcagtctggagctgagctgcagagccgtgggcctcgagtgagtggtctccgtgctagtgtcttcgtgttactacttcctttccaccgttaggtattagtaagtttggttagacgaccggaccgggtacccccgggtagggtacggggtcgttaggacggtagggtacggttagggagttacgggtacgttaccgtaccgggtaacccccgtttaaacgggaaaaaccttaaaaccggtaggttaacggtaaggttacggggaaacgggtaaacggttaaaccgggtttaccgggaaggggtaccgtaaacgggtaacgtaccgtaacgtacgtaacgtaccccggaacccggtaacccgtacccaaaccgtaccgtaccccgaagggtaaacgtaaccctaaccgtaacccgttaagaccggttaaacgggaccgtttaaggggaacgtaccgacccgttcgaacggtttaccgacgtaacggaaccccgaccggtaaccgtaccctttaactttaacgtaccgngtacggaacggtagttaagtccgtttagtccgaacgttcggtcgttaccggtcggtacccttacggaacccgtgttccgggttggacgggtacccggg

SEQ ID NO: 29614 - DNA, 904 bp, Homo sapiens
  misc_feature: GYAE6OF01ESFYN.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcacttccttttcttgggtggcagcagacaacgaggtcgcccacctcccgtacggttcaccgtggtagctacgtcgtgggagcgtgagctgcaaggaacggtccgtcggggtcctcgtaggtgtacgttcggttccttccgtggacgtacggttcgttccgtttacggttacggtttaccttaccttttcccgttttacccgtaaccgtttaaccgggtttagttaaggtttaacggtttcgggttagtaaaccgggtacccggtaccccggggtacccccggggtaggggtacgggggtccggtttagggtacggggttacgggtagggttagggtacgttacgggtacgttaccggtaacccggtaacccggtttaaaaccggtaaaaccgttaaaaaccggaggttaacgtaaggtaacgggtaaaggtaacgggttaaccggtaacggtaacgggtaaccggtaacggtacgtacgtaaccgtaccgtacggtaacccggaacccggtaccgggaacctaaacccggtaccgtaacccgaaaggtacccgtaacgtaacccgttacgtaacggtaacgttacgggaaacggtcggtaacggaccggtaccgtacggtaacgtaccgtaacggtacccgaaccgggtaacccgaccgggttaaccttaacgtttacgtacgtaccggacgtacgtagtacgttagttacggtccgacgttacgtcggttacgtaccgtcgtaactcgtacggtttcgtagggcccggtacgg

SEQ ID NO: 29615 - DNA, 644 bp, Homo sapiens
  misc_feature: GYAE6OF01BPFLX.1.49.E05.1.454.CMB.1.raw
  modified_base (221)..(221): a, c, t, g, unknown or other
  misc_feature (221)..(221): n is a, c, g, or t
  modified_base (372)..(372): a, c, t, g, unknown or other
  misc_feature (372)..(372): n is a, c, g, or t
  modified_base (401)..(401): a, c, t, g, unknown or other
  misc_feature (401)..(401): n is a, c, g, or t
  modified_base (451)..(451): a, c, t, g, unknown or other
  misc_feature (451)..(451): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctnagtgatggtcctcctgctagtgtcttcgtggttacattccttttcccacctacggtatgtaacttggttgacgacgacgggcccccggaggaggggtcgttggaggtggaggtgggagtggatcgacgtaccgttaacggaaactaaacgngagtagtggagagtaagtcgagggcaggntacatcatcgacgacggacacactaccgaacgtacgtacaagtccctaanacgttaacggaactaggaacgggactccctagaacgtactcgtaacggacgaaccgaccggtacccttacgttaacttaccggtagtaccggacgtaacgtagttaacgtttacgttacggtactacccggttggttcccgttaggtaccgttacgtaacccgacccgttcggtttcggtcgggtaacccggg

SEQ ID NO: 29616 - DNA, 647 bp, Homo sapiens
  misc_feature: GYAE6OF01CXXZQ.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttactattccttttccacctacggtatgtaattggttgagacacgggcccccggaggaggggcttggagtggagtgggatggatcgagtacccttacggaaactaaacgagagtagtaggagagaagttccgaggcagtagtcatcatacgaccgacgacacactccacgacgtacacgacctaacgagtacggaacgtaggtacggacgtaccctacgagattccgtagtaaccgaaccgtaccggtaccctaactttaacgttaccgtcggaccggtaacggtaacgtaaggtactttaacggttacggtaccttaccggttacgggttccccggttacggtacgttaaccggttaaacccgtaccggtttaccggtttcggggtcgggttaacccggg

SEQ ID NO: 29617 - DNA, 1112 bp, Homo sapiens
  misc_feature: GYAE6OF01B2UWR.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagccaacaggtcgccctactcccgaggttccaccgtggtgcagtctggagctgagctgcagacgccgtgggcctcgagtgatcggtctccgtgcagtgtcctttcgtaggttactacgtttccttttccctaaccgttacggttaattaggtaagtttgggttagacggtaccgaccggggaccccccgggtagggacgggggtccgtttagggacgggttacgggtaggttagggggtacgttaggggtactaccggtaaccggttaacccccggtttaaaaccgggaaaaaccttaaaaaccgggtaaggtaaagggtttaacggtaacgggggtaaacgtaaaccggggttaaaccggtttacccggaaacgggggtaaccgtaaggtaaccggttacgtaaacgttaccggtaaaccgttaccccggaacccgggtaccggtaaacccgtaacccgtaacccggtttaaccccggaaaccggttaaacggttaaaccccgaaccggtaacccgttaaacgtacggtttaaaccgggtaaccggttaaggggtaaacccgggtaaccgtaacccccggttaacccggtaacgggttaaacccgtttaccggttaaaccgggaacccccggggttaaacccggtaacccccggggttaaacccgttttaaacccggttttaacccgtttaacccggggttaacgggtaccccggggtaaaccggttaagggtaaaacccgggtttttaacgtttttaaaccgggtttacccgggttaaacccggttttaacccccggggggtttacccggggttttttaaccccccggggtaggggtttttaaaccccccggtttaaacccggggggtttaaaacccccccgggttaaacccggggtttttttcccggggggtttttaaaccccggggggttcccgggggggttaaacccccccggggg

SEQ ID NO: 29618 - DNA, 1020 bp, Homo sapiens
  misc_feature: GYAE6OF01BAZQP.1.49.E05.1.454.CMB.1.raw
  modified_base (214)..(214): a, c, t, g, unknown or other
  misc_feature (214)..(214): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtgcagcagcaacaggtcgcccactcccgaggttcacctggtgcagtctggagctgagctgcagaagccgnggggcctcgagtgagtggtcctccgtgctagtcgtcttcgttggttacacgtttccttttacccgaaccgttacggttagttacggttaaagtttggttacggtaacggtaccggtaaccggggtacccccccggggtaagggtaccggggggttccttttagggtaacgggttacgggtagggttaggggtacggttacgggtaaccgttaccggtaaccggttaaccccggtttaaaaccgggtaaaaaacccgtttaaaaaaccggtaaaccggttaaaggggtttaaacggtttaaacgggggaaaggggtaaaacggggttaaaccgggttttaaacccggggaagggggtaaaaccccggtaagggttaaaccggttaaccggtaaaccgtttaaccggtaaacccggtacccgtttaaaccccgggggtaaccccggaacccgggtaaacccttaaacccggtaacccccggggttaaaccgggtaaacccggttttaaaaaccccggaccggttaaaccccgttaaaaccgtaaacggggtttaaaccgggaaaccccgggttaaggggaaacgggtaaccggttaaccccgttaacggtaggtaaacccgttacgtaacccgggaaacccggtaccggtaaacccggggtaaccctttaaccgttttaaacgttacccggtacggccggtaaccgggtaaacggtagttaactttacgtacggtacctacggttcggttaccgtacggttccggttaacgaacccgttagggtaaccttggggtccggtaacccggg

SEQ ID NO: 29619 - DNA, 678 bp, Homo sapiens
  misc_feature: GYAE6OF01EUXS6.1.49.E05.1.454.CMB.1.raw
  modified_base (239)..(239): a, c, t, g, unknown or other
  misc_feature (239)..(239): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagcgtgcagaacgccgtggggcctcagtgatggtctctgcngtgtcttctggttactattcttttccacttacgtatagtaagttggttagacgtaacgaccgggcccccgggaggtacggggtcgttgggaggtgggtaggttcggggagtaggacgtacgaccggtacccgttaacggaaaactaaaacgagaagtagaggaagaggtaacgtaccgaggacgagtacgtcatcgactccgaccgacggtaccaactacgtaacccgacgaagtaaccgacgtacctacgtacgtacgggaactaagggacggaccgtccgtacgaagtacgttcgtaaggacccgaacccggtaaccggtacccgttaaccgtttagttaccgtcggtaccgacggtacgtaggttaactttacgttcgactcggtcggttccgtacggtcgttacgtacccgtacggttcgtcggtgggtacccgg

SEQ ID NO: 29620 - DNA, 690 bp, Homo sapiens
  misc_feature: GYAE6OF01CRUF2.1.49.E05.1.454.CMB.1.raw
tcagacgagtgcgtcacgaccggtgctcgatttagagcgactagcaacacacaaagggacccaaaaaccacacccctctgggagaatccctagatcacagctcctcaccatggacgggacctggagcatcctttctggtggcagcagcaacaggtgcccactcccaggttcacctggtgcagtctggagctgagctgcagaagccgtggggcctcgagtgagttggtctccgtgcctagtcgtcttcgtggttacactttccgttttaccacgtacggtatcgttaagttggtacgacgaccgaccgggtccccggtaggcgggtcgttgtacggtggtaggtagggagtaggcgtacgtaaccgtaccggttaacggaaacgttaaaacgaggtagtaaggtagggaagtaaggtaacgtcgaagggtacagtacgtacagtacgaactcgaccggacgaactacgacgtaccacgtaacgtacaccgtactaagtacgacggtacgaggacggacgtacgtacgacgtactcgaaccgagacccgtacggtaccttaacgttacgtaccggtactacggacgttaacgagttaacgttaacgtcggtaccgtacgttttaccgggtcccgttaggtaaccgttaccggttaacccgtagggtttcccggtgggtaccgggtaaccggg

SEQ ID NO: 29621 - DNA, 673 bp, Homo sapiens
  misc_feature: GYAE6OF01E1POS.1.49.E05.1.454.CMB.1.raw
  modified_base (317)..(317): a, c, t, g, unknown or other
  misc_feature (317)..(317): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcaggaacgccgtggggcctcagtgatggtctcctgcagtgtctttcgtggttacattcttttccaccgtacggtattgtaagtttggttgagaccgtacggaccccccggaggngggtcgttgaggtggagtgggatggagtcacgtacccgttaacggtaaacgtaaaacgagagtagtaggaagaggtaacgtacgaagggacgtagagtacatacacgtaccacccggtcgaacgacgtactaccgacgtaacgtaacgacgtacctacgacgtaggtacgtagaggacgacctacgaagtactacggtacgaaccgaccgtaccgggtacccttaacgttacgttaacgttacggccgacggtaacgtagtaagttttacgtcgttaccgtacggttcccgggttccgttacgggaccgtttaaccggtaacccgtacgtaccggtttggggtacggtacccgggg

SEQ ID NO: 29622 - DNA, 775 bp, Homo sapiens
  misc_feature: GYAE6OF01D1B0B.1.49.E05.1.454.CMB.1.raw
tcagacgagtgcgtcacgaccggtgctcgatttagagcgactagcaacacacaaaggggacccaaaaaccacacccctccgttgggagaatcccctagatcacagctcctcaccagtggacgggacctggagcattccttttcgttgggtgcagcagcaacgaggtcgccctactcccgtaggttccaccgtggtcgctaggtcgtggagtcgtagagtcgtggacgaaggtacggccggtgggcctacgaggttacgtacgttcggtcctcgtggactggttcgtcgtttcgttacggttacctacgttttcctttaccgtaaccgttacggttagtagttacggtttggttacgacggtaaccggtaccggggaccccgggtagggtacggggtcgttagggaaggtggtaggtgggtaggtggtaccgtacggtaccgtaaccggttaaacggaaaacgttaaaacgacgggtaagtaggtagggtaacgaacgttaacggtcggacggaacaggtcgtactacgtacacgttaccgacggtacaacgtaccgacgttaaccgaagttaaccgacgacgtacccgtaagacgtacggtagtacggaccgtacgtcgtaacgtgtaccgtggtaaccggaaccgaccggtaacgtaccgttaaccgttacggctacggtacgagtacgtagtaacgttacgtcgtacttcggggtacctccgggttaggtaccgtaaccgttacggcgtttacgggttcgggacgtacccggg

SEQ ID NO: 29623 - DNA, 653 bp, Homo sapiens
  misc_feature: GYAE6OF01CEPLD.1.49.E05.1.454.CMB.1.raw
  modified_base (420)..(420): a, c, t, g, unknown or other
  misc_feature (420)..(420): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcacctggtgcagtctggagctgagctgcagaacgccgtggggcctcagtgatggtctcctgctagtcgctttctggttactattccttttccaccgttacggtattaggtaagtttggttagagacgtacgggacccccggagggacgggggtcgttggaggtgggaggtgggtagtggtactcgacggtacccgttaacggaaactaaaacgagtagtagtggaagtagtaacgtcgaggtnaggtagctatcagtcgaccgtcggaacacactaccgaacgtagtaaccacgtacctaacgtagacgggaacgtaggacggtacgtccctagaacgtagtcgaacgaccgaacgaccggtcctaacgttacgttagtcggacggtacgtaaggagttagttacgtacgacccttacggttcggttcctcgggtacttaccggtaaccgtacggtcgttcgggtggtaacccggg

SEQ ID NO: 29624 - DNA, 708 bp, Homo sapiens
  misc_feature: GYAE6OF01EM7GZ.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccatggacgggacctggagcatcctttcttggtgcagcagcaacgaggtcgccctacctcccgtaggttccaccgtgggtgcagtcgtggagctgagctgacgagacggtccggtcgggcctagtacgtgtagttcggtcctccgtgcgtaggttcgtctttcggtacgttacctcgttccgttaccgtacgttacgtagtagttagttcggtacgacggtaccggaccgggtaccgggtagggtacggtcgtggtaggtagggtaggtaggtagtacggtacgtacgtaccgtaaccgtaaacgtaaacgtaagagtaggtaaggtaggtaacggtaacgtacggtacggaggtactacggtacgtactacgtacgacgtccggaaccggtaccgaccacgtaccgtaaccgtacgtacgtacgacgtaaccgtagtacggtacgacgtacggaccgtacgtaccgtagtacgtagtacgaacggtaccgtacgtaccgttacgtacgttacgtacgacgcgtaagtacgtacgtacgttcgtacgtcgtacggtcggtacgttacggacgtacgtacgttcgtacggtgcggtcgg

SEQ ID NO: 29625 - DNA, 865 bp, Homo sapiens
  misc_feature: GYAE6OF01CXLDK.1.49.E05.1.454.CMB.1.raw
  modified_base (234)..(234): a, c, t, g, unknown or other
  misc_feature (234)..(234): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcngcagtgcttctggttactacttctttacctaccgtacggttatgtaacttggttcgagaccgaccgggcccccgggaggtacggggtcgtttggaggttaggtagtggggtaacgtggactcgtaacggtacccgttaacgaaacgtaaaacgaggtacgtagtaggaagtaggtaacgttaccggaagggtacgtaggtaacgtcgtaagtaccgtaacgtaccacccgggtacgaacccgtaacgtacccgtaccgtaacggtaaccggttaacccaaccgggttaccctaaacgtacgggttaacggaaacccgttagggaaaccggtacggtacccgttaacggtacgttaaccgttaccgtaaacggtaaacccgggtaacccgtaacccggggtaacccgttaaccgttttaaccgttaaccccggtacgggtaccccggtaaccgggttaaaacggttaacgggttaaccgttttaacggttaaccggttaccggttaacccgggtttttcccgggtaaccccgggtttaccgggttaaccccggttaaacccggggtttaaaccccccgtaccggggttttaaacccggtttccgggggtaccggggggttaaacccccgggg

SEQ ID NO: 29626 - DNA, 823 bp, Homo sapiens
  misc_feature: GYAE6OF01EZJ3U.1.49.E05.1.454.CMB.1.raw
  modified_base (184)..(184): a, c, t, g, unknown or other
  misc_feature (184)..(184): n is a, c, g, or t
  modified_base (812)..(812): a, c, t, g, unknown or other
  misc_feature (812)..(812): n is a, c, g, or t
tcagacgagtgcgtcacgaccggtgctcgatttagagcgactagcaacacacaaaggggacccaaaaaccacacccctcttgggagaatcccctagatcacagctcctcaccatggacgggacctggagcatccttttctggtgcagcagcaacaggtcgcccactcccgaggttcacctggtncagtctggagctgagctgacgagaacgccgtcgggcctcgagtgagtcgtctccgtgcgtagtcgtactttcgtagttactactttcctttaccgaaccgttaacggttattacggttaagtttcggggttagaaccggaccgggtacccgggtaccccccgggggtaagggtacgggggttaccggtttagggtacggggttagggtaggttacgggggtacgttacgggtaaccgttaccgtaccggttaaacccccgttaaaacggtaaaaaaccgttaaacccggaaggttaaccggttaagggtaacgggtaacgtaaacgggttaaacggttaccggaacgggtaacgtaacggtaacgttaccaacggtttaccgaccgtaacccggtaccgggacgtaaccgtaaccgtaccgtaacccgaacggttaaccgacggtaccacccgttaagaaccggtacggtaacgtggaaccgtcgaccgtaacgtacgtgtactccggaaccgaccggtaccgtaacccgttaattacgttacgacgtacgacggtaggttaacctaagtttgtccgaaggttccgtaagttccggacgttaccgtaacgacccgttagtcggtcggnggtaacccggg

SEQ ID NO: 29627 - DNA, 619 bp, Homo sapiens
  misc_feature: GYAE6OF01BCP7L.1.49.E05.1.454.CMB.1.raw
  modified_base (237)..(237): a, c, t, g, unknown or other
  misc_feature (237)..(237): n is a, c, g, or t
  modified_base (537)..(537): a, c, t, g, unknown or other
  misc_feature (537)..(537): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcngtgcttctggttacacttcttttccaccttacggtatacgtaatttggttgagacgacgggcccccggaggacgggggcttggacggtggagtgggagtgggatcgacgtacccgttaacggaaactaaaacgaggtagtaagtggaagaaggtaacggttccgaagggacaggacgtacattcactaccgacgaccggacacaccgtaccgacggaacgtacacgacctaacgagtaggaacgtaggacggacgcctacgagtactcgacgaacgaccaccggaccttacttacttacncgcgacggacgtagtagttagttcgcgtacgttcggtaccgtggtaccgtacgtaaccaccggttcgttgggtcggtaccgg

SEQ ID NO: 29628 - DNA, 706 bp, Homo sapiens
  misc_feature: GYAE6OF01CIAFH.1.49.E05.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (529)..(529): a, c, t, g, unknown or other
  misc_feature (529)..(529): n is a, c, g, or t
  modified_base (610)..(610): a, c, t, g, unknown or other
  misc_feature (610)..(610): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtgggcctnagtgatggtctccgngcngtgctnttggtactcttctttccaccgttacgtatagtaagtttggttagacgtaccgaccgggacccccgggtagggacgggggtcttgggaggtgggtagtggggagtaggacgtacgtaccgtacccgttaacggtaaaacctaaaagacggaagtagtaggaaggtaaggtaacgttaccggaagggtacgaaggacgtactaacgtcgtaacgtacccgaccggaccgtaacaaccgacgttacccgaacggtacgtaaccgacgtaactaacgaagtaccgtaaggnggtaacgacgtacctacgaagtactcgaccgtaaccgaccgtaacccgtaccttaacgtttacgttaccggtggtacccgnggtaaccgtaagttacgtttagtccgacttacggttcggtaccgttccggtaaccgttaacgtaacccgtcgttacggttcgggtggtacccgggg

SEQ ID NO: 29629 - DNA, 719 bp, Homo sapiens
  misc_feature: GYAE6OF01B9H71.1.49.E05.1.454.CMB.1.raw
tcagacgagtgcgtcacgaccggtgctcgatttagagcgactagcaacacacaaaggggacccaaaaccacacccctcctgggagaatcccctagatcacagctcctcaccatggacggacctggagcatccttttcttggtggcagcagcaacgaggtgcccactcccaggttcacctggtgcagtctggagctgagctgcagaacgccgtgggcctcgagtgatggtctcctgctagtggtcctttcgtggttacacttccgttttccaccgttacggtataggtaacgttggttagacgaccgtaccgggcccccggtaggacggggtcttaggacggtaggagtcggggtagtggtactcgaacgtacccgttaacgggaaactaaaacgagtaagtacgtaggaagtaaggtacgttccgaagggtactaggtacgtacgtaactccgtaacgtaccgacccgggtacggaaccaaccgtacgtacccgtaacggactaaccgtaacggaccttaacgaaggttacggaaccgttagggaacggtaccgacccgtaacggtaggtaacccgttagtaccgaacggtacccgtaccgggtaaccttacgttacgtacgtcgacggacgtaagacgttacgttagtcgtacgtacggttccggtaccgtacggacgttaaccggtacccgagtttccggtcgggtacggacccggg

SEQ ID NO: 29630 - DNA, 673 bp, Homo sapiens
  misc_feature: GYAE6OF01BQD05.1.49.E05.1.454.CMB.1.raw
  modified_base (382)..(382): a, c, t, g, unknown or other
  misc_feature (382)..(382): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagccgtggggcctcagtgatcggtctccgtgctagtgtcttcgtcggttacattcctttccaccgtacggtatgtaagttggttagagacgtacggcccccggaggaggggtctaggaggtggaggtgggagtggactcgacggtacccgttaacggaaactaaaacgagagtagnggagaaggtaacgttccgagggacaggagtcagtacacgtaccgacggaccggaacacctacgtaaccgaacggtaacgtacaacgtaccctaagtaagtacgggtaaacgtaggaacggtaccgcctaacgaagtacgtcggtaacgaacggaaccgtaccggaccttaacgttacttacgtacggacgtacggtagtacgtaagtttagtacggaccgttacggttccgggtccgttacggtaccgtaccgttaaccgtaccggttacggttcgggtcgggtacccggg

SEQ ID NO: 29631 - DNA, 816 bp, Homo sapiens
  misc_feature: GYAE6OF01AJ6RZ.1.49.E05.1.454.CMB.1.raw
  modified_base (110)..(110): a, c, t, g, unknown or other
  misc_feature (110)..(110): n is a, c, g, or t
tcagacgagtgcgtcacgaccggtgctcgatttagagcgactagcaacacacaaaggggacccaaaaaccacacccctccttgggagaatcccctagatcacagctcctnaccatggacgggacctggagcatcctttctggtggcagcagcaacaggtgcccactcccaggttcacctggtgcagtctggagctgagctgcagacgtccgtggggcctcgagtgagtcggtctccgtgcctaggtcgtaccgtttcgtacggttacctacgtttccctttacccgtaccgttacggttagtacggttaacggtttcgggttacgacggtaccggtacccgggtacccccgggtaggggtaccggggtcgttacggtacggtcggtaggtaggggtacgtacgggtacgtaccggaccggttaacccgttaaacggtaaaccgttaaaacgtacggtacggtaacggtagggaacggtaacggtaacggttaccggaacgggacgtaacggtacgtaccgtacgtaccgtaccgtacccggacccggaccggtaacctaaccgtaccgtacccgaacggtaaccgtaaccgaacgtaaccctacgaacggtaacggtaacggtacggaaccggtaccgtacccgtacgacgtaccgtacgtaccggaacccggtaccgacccggtaccttaacgttacgtaaccgtcggtaccggtacggtaagtacttaagttacggtcgtaccgttaccgtcggttaccggtacggtaccgttaaccggtaacccgtacggttacggttcgggtccgggtaccg

SEQ ID NO: 29632 - DNA, 698 bp, Homo sapiens
  misc_feature: GYAE6OF01AOWZY.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttcgtggttacattctttccaccgtacggtatgtaattggttgagacgacggcccccggaggaggggtcttggaggtggagtgggagtggacgtcgacgtacccgttaacggaacgtaaaacgaggtagtagtggaagaagtaacgttaccgagggacgaggtagtacagtacgactaccgaccgacggaaccaccgtacgtacccgaacggtaacgtaccgaacgtaccctaacgtagtacgggaaaccgttagggaacggtacggtaccctacgaaggtactaccggtacggaaccggtaccgaacccgggtacccttaacgtttacgttaccgtacggtaccggacggtaggtacgtaacgtttacggtcgtaccgttacggttccggttcccgtacgggttaccgttaccggttaacccgtaccggttccgtttacggggtgggtaccccggg

SEQ ID NO: 29633 - DNA, 715 bp, Homo sapiens
  misc_feature: GYAE6OF01DY35L.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcattccttttctggtggcagcagcaacaggtcgcccactcccaggttcacctggtgcagtctggagctgagctgcagagccgtgggcctcgagtgagtcggtcctccgtgcgtagtcgtcgtttcgtaggttacctacttccttttacccgaaccgtttacgggtattaggttaacgtttgggttagacgaccggtaccgggcccccgggaggtaggggtcttcggaggtggtagtgggtagtaggtactacgaccggtaacccgttaacggtaaacgtaaaacgtaggtagtacggtaggaagtacggtaacgttccggaagggacgtagtacggtacacgtacacgtaccgaccggtaccgataaccgtacgaccaagtaccgtaacgacgtaccctagttaagaacgggtaagtacggaacggtacctccgtaacgaacggtacctacggtaacggacccgaacgtaccccggtaacttaccgttaacgtaccgtggaacccgtaggtaagtacgtagttcgtaacgtcgtacgtcggtcctggtacctaaccgccgtacggttcggttggacggtacccgg

SEQ ID NO: 29634 - DNA, 657 bp, Homo sapiens
  misc_feature: GYAE6OF01AQ6S2.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccctaggttccacctggtgcagtctggagctgagctgcagagccgtcgggctcgaggtgagtcggtcctccgtgcgtagtcgtcttcgtggttactcttcctttccacgttacgtatgtagttggtgacgaccgcgggccccgaggacgggtctggacgtggagtggtagtcggtatcgacgtaccgtaacgaaactaaacgagtagtagaggtaagagtacgtacgaggcagtacgtacatacgacgtacgcgacgacactacgtaccgacgtaccgtacgaccgtaacgtacgaagtacggtaacgttagggaacgtaccgccttaacgagttaccgtacgacgaacccgaccgtacccgtaccgttacgtttaccgtcgtacgcgtagtacgtagttacgttacgttcgacgttacggttccggttaccggtcgtaacccgttaccggtaaccggtacgtttcgggtcgggtcgggtaacccggg

SEQ ID NO: 29635 - DNA, 620 bp, Homo sapiens
  misc_feature: GYAE6OF01E3G7J.1.49.E05.1.454.CMB.1.raw
  modified_base (451)..(451): a, c, t, g, unknown or other
  misc_feature (451)..(451): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttttcttggtggcagcagcaacaggtgcccactcccaggttcacctggtgcagtctggagctgagctgcagaagccgtggggcctcagtgatggtctcctgcagtgcttctggttacatcttttccacgtacggtatgaattggttgaggacacgggcccccggaggagggggtcttgagtggagtggggatggatcacgtacccttaacggaaactaaaacgagagtagtgggaagaaggtaacgttcgaagggacaaggtagtacatacatccgacggacgacacactaccgacgtacgtaccacgacctaanagtacggaacgtacggaggtacgccctacgacgtagtccgtaggaaccgaacgaccgggtacctaactttaacgttacgtacggacggacgaagtaagtatttacgttgaccgtaacgtgggtcccgttggaccttacggtaacccacggttcgttgggcgggtaccgg

SEQ ID NO: 29636 - DNA, 759 bp, Homo sapiens
  misc_feature: GYAE6OF01CELSG.1.49.E05.1.454.CMB.1.raw
  modified_base (141)..(141): a, c, t, g, unknown or other
  misc_feature (141)..(141): n is a, c, g, or t
  modified_base (721)..(721): a, c, t, g, unknown or other
  misc_feature (721)..(721): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattccttttnttggtggcagcagcaacaggtgcccactcccaggttccacctggtgcagtctggagctggagtctgcgaaggaacgccgtaggggcctacgagtgtacgtcggttcctaccgtcgcgtacggttcgtcctttcggttaggttacctacgttttccctttaccctaaccggttacggttagtaggttaacgtttgggttaacgacggtaccggtaaccggggtcccccggaagggtacggggtctttagggagggtacggtaggtagggggtactttcggaagtacggtaccgtaaccccgttaaacggaaaactaaaaccggtaggaacgttaacgagggaacgtaaggtaacgtccggaaggtacgaacgtacggataaacgtccgtaacggtacccgaccgggaacgtaacccgacttacgtaccgtaacggactaacgacgtaaccgtaacaggtacgtaacgtagcgacgtaaccctgaacggtctacgacgaccgaccgaaccgggtaccttaagtttcgaccttcggagtacgtaagtaggttactaggttgaccttagggtccgtaccggttntaccggtacgaaaccctgggtttgtccgggtgtaccgg

SEQ ID NO: 29637 - DNA, 596 bp, Homo sapiens
  misc_feature: GYAE6OF01BZCVM.1.49.E05.1.454.CMB.1.raw
  modified_base (554)..(554): a, c, t, g, unknown or other
  misc_feature (554)..(554): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtcctcctgcagtgtcttctggttactattctttccacctacggtatagtaagttggttgacgacgacggcccccggaggacggggtcttggagtggagtgggagtggatcgacgtcccgttaacggaactaaacgagagtagtaggaagagtaacgttcgagggacagtagtacatacacgtaccgaccggacggaccaacactaccgaacgacgtacgacgtacctaacgacgtaggtaacgtaggaacggacgaccctgagtactcgtaggaccgacgtaccggtacctaacttacttacgcgcgacgtagagtattagtcgtanacgtcgtccgtggaccttacgtaccacgtcgttgtgggtccg

SEQ ID NO: 29638 - DNA, 747 bp, Homo sapiens
  misc_feature: GYAE6OF01DD558.1.49.E05.1.454.CMB.1.raw
  modified_base (469)..(469): a, c, t, g, unknown or other
  misc_feature (469)..(469): n is a, c, g, or t
tcagacgagtgcgtcacgaccggtgctcgatttagagcgactagcaacacacgaaaggggacccaaaaaccacacccctcctgggagaactccctagatcacagctcctcaccatggacggacctggagcatccttttctggtggcagcagcaacgaggtcgcccactcccaggttcacctggtgcagtcgtggagctagacgtcctgcaacggacgccgtcggggcctcgaggtgagtcggtctccgtgcctaggtcgtctttgtcgttaacctactttccgtttcccacgtacggttatacgtaagtttggtagacggtacgaccgggtaccccgggagggtacggggtcgttcgggaggttcgggaggtaggggtacgaggtacgtaccgtacccggtacccgttaaaacggaaaccgttaaaggaggtagtacggtagggaacgtaagtaacggtcggaacgggngaacgtgctacgtcgtactaccggccgaccgaaccacgtacccaccggtaacgtaacgtaacgtaccgtaccgtaacgtacggaacgtacgggttaaggaaccggacgttacccgtaagtaaccgggattaccgaacggtaacccgtaccggttaacccggtacttaacgtttcggttaacggcgtaacggtcggtaagttacctagttaccgttacgacgttacgtcggttccgtacgtcgtaacccggtactaggttcgtacgggtcggtaccggg

SEQ ID NO: 29639 - DNA, 721 bp, Homo sapiens
  misc_feature: GYAE6OF01BDRLX.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtgcccactcccaggttcacctggtgcagtctggagctgagctgcagagccgtgggctcagtgatggtctccgtgctagtcgtcttcgtggttactattccttttccaccgttacggtataggtaagtttgggttagaagaccggaccggggacccccggagggtacggggtcgttggaggttagggaggtagggagtggactcgaacgtacccgttaaaggaaaccttaaaagacggtaaggtagtaggggaataaggtaacggttaccggagggtacgtaaggacgttacacgttacgaacgttaccggacccggacgggaaccaacgtacctacccggaacgtaagtaaccgacgtacctaacgaacggtacgggaagtacggaaggactcgtagtaacgtacgtacgtacggaacccgtacgaccggtaccttaacgtttaacgttacgtaccggcggaaccgttaaggtagttacgtttaggtccgtacgttacgggttccggtacgtccggttacgttaccgtacccgtaggttcggttcgggtcgggtaccggg

SEQ ID NO: 29640 - DNA, 844 bp, Homo sapiens
  misc_feature: GYAE6OF01C9TTH.1.49.E05.1.454.CMB.1.raw
  modified_base (87)..(87): a, c, t, g, unknown or other
  misc_feature (87)..(87): n is a, c, g, or t
tcagacgagtgcgtcacgaccggtgctcgatttagagcgactagcaacacacaaaggggacccaaaaaccacacccctccttggganaatcccctagatcacagctcctcaccatgggacgggaccctggagctactttccttttcgttgggtcggcagcgaacgaccaaacggtcgggtccaccctacccttacccgtacggttacccaccggttgggtcaccgtagtcgtagggacgtcgtagacgtcgtggaacgaacggaccggtcccgggtcgggtccctagtaggtacggttacggtccgttcccgttccgtacggacgtagggttcgttcgtttcggttaacgttaaccttcttttcccgttaacccgtacgttagttagtacgttaggttcgggtaacgaccggacccggaccccgggtacccgggtaggggtacgggttcgtagggttcggggtaggtagggtacggtaaggttttcggaaccttaccgggtaaccccggttaaccggtaaaccgtaaaaacgttaaggacggttaagtacggaagggtaacggtaagttacccggtacgggaaggtactacggtacgtacctacgtaccgtaaccgacccggacggtaacccgaactaccgttaccgaacgacgtaccgtaactaccgtaccgtagaccggtaacggtacggacgacgtccgactagtacctgaaccgtacgacccggtacgtcgtactttaacgtcgtagacggtcgtaagcgttatacgttacgccgtagttacggttcccgagtacccgtccgttaaacggtccgttagttcggggtcgccggtaacccgg

SEQ ID NO: 29641 - DNA, 712 bp, Homo sapiens
  misc_feature: GYAE6OF01C4OG2.1.49.E05.1.454.CMB.1.raw
  modified_base (184)..(184): a, c, t, g, unknown or other
  misc_feature (184)..(184): n is a, c, g, or t
  modified_base (331)..(331): a, c, t, g, unknown or other
  misc_feature (331)..(331): n is a, c, g, or t
tcagacgagtgcgtcacgaccggtgctcgatttagagcgactagcaacacacaaagggacccaaaaaccacacccctcttgggagaatcccctagatcacagctcctcaccagtggacgggacctggagcatccttttctggtgcagcagcaacgaggtcgcccactcccaggttcacctggtnctagtctggagctgagctgacgaggaacgccgttcggggccctgagtgagttcggtctccgtggacgtaggttcgtcctttgtaggttactacgtttcctttaccacgttacgtatgtaagttgtagacgaccgcggccccggaggngggtctaggtggtaggagtggatggataccgtacggtacccgttaagaaactaaacgaggtacgtagaggaagtagtaacgtccggaggacgagtactacgtacacgacgtaccgaccgacgtaccaacactacccgaagtacgtaccgacgtacccgtaagtacgtaacgggacgtacggaacggcctaaccgttgaacgtacgttacgaccgaaccggttaccgaccgttaaccctaagtttacccttacgggacgtaccgggtaagtaacggtacttagttaaccgtcgtaacccggttcggttaccgggtccccgttaaggtacccgtttaaccgtaaccgtccgggtttacggtttcggggaaccggttacccggg

SEQ ID NO: 29642 - DNA, 698 bp, Homo sapiens
  misc_feature: GYAE6OF01AGDGY.1.49.E05.1.454.CMB.1.raw
  modified_base (236)..(236): a, c, t, g, unknown or other
  misc_feature (236)..(236): n is a, c, g, or t
  modified_base (626)..(626): a, c, t, g, unknown or other
  misc_feature (626)..(626): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacgaggtcgcccactcccgaggttcaccgtggtgcagtcgtggagctgagctgcagaggccgtcggggcctcgaggtacgngtcggtcctccgtgcgtagtgtctttcgtaggttactacttccgttaccacgttacgtagtagtacgttggtcgtagaccggacgggaccccggtagggaacggggtttcgtaggtacggtgggaagggtcgggtaattcgggaacgtacccgtaacggttaaccccggttaaaccggtaaaactaaacggttaaggaccggttaaggtacggaaagggtacgtaacgggttccggaggtacgacggtagtacagtacgacgtaccgacggtaccggaccacgtaccgacgacgtacgtacaacgtactacggacgtacggagtacggacgtactacgacgacgtagtcgaacgaccgacgacgtacctagtacgtacgcgcgagtacgngtaacgttcgtcaccgtaggtccgtacggtacgtacgttaccggaactccggttcggtcggtgggtaccggg

SEQ ID NO: 29643 - DNA, 702 bp, Homo sapiens
  misc_feature: GYAE6OF01D4UW3.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttgggtggcagcagcaacaggtcgcccactcccaggttcacctggtgcagtctggagctgagctgcagaacgccgtcggggcctcgagtgatcggtctccgtgctagtgtctttcgtggttactacttccttttcctaccgttacgtatagtaagttggttagacgacgaccgggcccccggaggtacggggtcgttgggaggtgggtaggtgggtagtagggtactacgtacggtaccccgttaaacgggtaaaacgtaaaacgaggtaacgttaggtagggaaagaacggtaacggttaccgagggacgtagtacgtactacgtacgtacgtaccgacccggacggaaccaacctaacgtacccgaacggtacgtaacccgacgtacctaacgtaccggtaggtaacgtggaacggtaccgtcctacgagtactcggtacgaaccgaccgaaccggtccttaacgtttactacgcggaccgacggtagtagtattacgtcgtcgtacgttccggtccgtggaccgtaccgtacccgtgttccggtggtcgggtacccgg

SEQ ID NO: 29644 - DNA, 829 bp, Homo sapiens
  misc_feature: GYAE6OF01DQCLE.1.49.E05.1.454.CMB.1.raw
tcagacgagtgcgtcacgaccggtgctcgatttagagcgactagcaacacacgaaaggggaacccaaaaaccacacccctccttgggagaactcccctagatcacagctcctcaccagtgggaccgggacctgggactctactttcctttttcgttgggtggcaggcacgacaacgaggtccgcccaacctcccgtaggttccaccgtgggtcgcgagttccggtgggacgtcgtaggcggtcctaggacgaaggaaccggtccggttcggggcctaggtaggtgtacgttccggtcctaccgtggacgttggttcgtccgttttggttacggttacctttacttttcccgtttaccgtaaccggttaaggttagtaagtttacggttggttacggacggtacccggaccgggaccccggtaagggcgggttcgttggtaggtacgggtaggtacggtaggtcggtaacttccggtaaccggttaaccgtaaacgggaaaacttaaaggaggtaacggtaaggtaacggtaaggtaacggtaccggtacgggacgggtacgaagttacgactacggtacacgtaccggaccggtacgactaccgtacaccgacggtaatacccgacgtactacgtagtaccggaagtcgggtaacgacctagtaaccgagttacgacggtaccgaacgtacccgttaccgggtaaccttaacggtttacgtacggacggtaccgggtaagtaccggttagtaaactttcgaccgttacgacggttcggttaaccgtcgtaaccgtacgaccgttaggtccggttggaacccggtccggg

SEQ ID NO: 29645 - DNA, 892 bp, Homo sapiens
  misc_feature: GYAE6OF01EUSHX.1.49.E05.1.454.CMB.1.raw
  modified_base (165)..(165): a, c, t, g, unknown or other
  misc_feature (165)..(165): n is a, c, g, or t
  modified_base (198)..(198): a, c, t, g, unknown or other
  misc_feature (198)..(198): n is a, c, g, or t
tcagacgagtgcgtcacgaccggtgctcgattttagagcgactagcaacacacaaaggggacccaaaaaccacacccctccttgggagaatcccctagatcacagctcctcaccatggacgggacctggagcattccttttcttggtggcagcagcaacaggtcncccactcccaggttcacctggtgcagtctgganctgagctgcaagacgccgtgggcctgagtgagttcggtcctcctggactaggtcgtccgtttcgtacggttaactatttcccgtttttaccgaacccgttaacggttacttggttaacgtttgggtttagaacggaaccggtaccgggtaccccccggggtagggtaccgggggttccgtttagggtaacgggttacggggtacggttagggggtaacgttggggtaacttaccgaacggtaccccgttttaaacgggtaaaaccttaaaacggaaggtacggttaacgtaggggtaacggaagttaaccggttacccggaagggtaccgtaaggtaccgttacgaacttacgacgttaacccgaccggaacggacctaaccgtaacgtaccgaacggtaacgtaacgtaaccgtacctaacgtacgttacgggaaccgttggaacgggtacgtaccgacggtaaacgtccgttaccggacggtaaaccggaccggtaacccgtacccgtttaacgtttaacctaccggtacggtacccggtaacgtaacggttaacggttaaacgtttaaccggttcgttaaccggtaccggttttaacccgggtaccgttacccggggtttaaacttaccccggggttaaaacccggttaccggttttcccgggttaagggttcccggggtaaaccccgggg

SEQ ID NO: 29646 - DNA, 702 bp, Homo sapiens
  misc_feature: GYAE6OF01AKMP0.1.49.E05.1.454.CMB.1.raw
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagacgccgtggggcctcagtgatggtctctgcagtncttntggttactattcctttccaccgttacggtatggtaattggtagagaccgacggcccccggaggaggggtctggagtggagtgggataggactcgacgtaccgttaacggaaactaaacgaggtagagtaggagaaggtacgtacgagggacaggactacatcgagtaccgaccgacgtacacgtaactcccgaacggtacgtaacccgacggtaccctaagtacggtacgggaaacttagggtaacggaccgtacccgtacgtaacggtacgtaccgtaacggaacccggtaccgaacccgggttacccttaaacgtttaacgtttaccgacgggtaccggtaacggtaaggaaccgtttaacgttacgttccggaccgtttaaccggtccggttaccggtaccggtacgttaacccggtaacccgtaccggttccggttgggtacggggtaccccgg

SEQ ID NO: 29647 - DNA, 790 bp, Homo sapiens
  misc_feature: GYAE6OF01B1RXZ.1.49.E05.1.454.CMB.1.raw
  modified_base (130)..(130): a, c, t, g, unknown or other
  misc_feature (130)..(130): n is a, c, g, or t
  modified_base (141)..(141): a, c, t, g, unknown or other
  misc_feature (141)..(141): n is a, c, g, or t
  modified_base (200)..(200): a, c, t, g, unknown or other
  misc_feature (200)..(200): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
  modified_base (554)..(554): a, c, t, g, unknown or other
  misc_feature (554)..(554): n is a, c, g, or t
tcagacgagtgcgtcacgaccggtgctcgatttagagcgactagcaacacacaaaggggacccaaaaaccacaccctccttgggagaatcccctagatcacagctcctcaccagtggacgggacctggancattccttttnttggtgcagcagcaacgaggtcgccctactccgaggttccacctggtgcgagtcgtggngtctgagctgacagaacgccgtgggcctagagttgagtcggtcctcagtcgagttgtctttcgttacgttactacttttccttttaaccgacggttaacgtatacgtaagttggtagaacgtaccggaccgggaccccggaggtacggggtcttaggaggtaggtagttcggagtcgtaagtcgaacggttacccgtaaaggaaactaaaaggcgtaaggtaaggtaggaacgtaaggtaacgtacggacggtaacgagtaacgtanaacgtntaaaccgtcgaccgggtacaacaccgactaaccggacgtaactacgactaccgaaagttacggaacgtaaggacggaccgngttaacccgagttaaggtaaccgttcgaaacggaacccggtaaccgtaacccgggtacctttaaacggttaccgttaacggtcccgggaacgtaaacggggtaacgttaaacgtttaacggtttacgtaccggtaaacccggttcgggttaccccggttccgtaaacgggttacccgtttaaacccggtacggggttaccctttacggggttccgggggtaaccggtaacccgggg

SEQ ID NO: 29648 - DNA, 632 bp, Homo sapiens
  misc_feature: GYAE6OF01ACSLN.1.49.E05.1.454.CMB.1.raw
  modified_base (444)..(444): a, c, t, g, unknown or other
  misc_feature (444)..(444): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagaagcctggggcctcagtgatggtctccgtgcagtgcttcgtggttacacttctttccacctacggtatgtaacgtttggttgagtacgacgggcccccggaggacgggggtcttgaggtggagtgggagtggatcgacgtcccgttaacggaactaaacgagtagtacgtagggagagaacgttcgaggtcgagtagtcatcgactcgaccgcgacacactccgacgacgtacagcctanagtggaactggaggacgccgtacagacttcgtacgaaccggtacgacccggtaccctaacgtttacgttaacccgtggaccgtacgggtacgtaacgttacttacggttcgaccgttaaccggttcgggttacccgttcggtaccgttaccggtaacccgtacggtcgtttccgggtgggtaccccgg

SEQ ID NO: 29649 - DNA, 611 bp, Homo sapiens
  misc_feature: GYAE6OF01B544X.1.49.E05.1.454.CMB.1.raw
  modified_base (400)..(400): a, c, t, g, unknown or other
  misc_feature (400)..(400): n is a, c, g, or t
  modified_base (432)..(432): a, c, t, g, unknown or other
  misc_feature (432)..(432): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcaggtgagtcggtcctaccgtgctagttcgtcctttcgtcggttactattccttttacccaccgttacggtatagtaagtttgggtagtacgaccgaccgggcccccggagggacggggtcgttaggaggtggtaggtacgggagtggtataccgacgtacccgttaacgaactaaaacgngagtagcggagacgtagtcgaggcagtagcanctacgtacgacgacgactacacgtcgagacgtaacgactactacgagtagacgtggacgcgtcagacgactcgacgaaccgtaccgacggtacctacttactacgcgcgtacgagtatattcgtgaccgtagtcggtcgtacgtacgtaacgtaccgtacgtcgttcgggtggtaccgg

SEQ ID NO: 29650 - DNA, 801 bp, Homo sapiens
  misc_feature: GYAE6OF01CXZ6N.1.49.E05.1.454.CMB.1.raw
  modified_base (170)..(170): a, c, t, g, unknown or other
  misc_feature (170)..(170): n is a, c, g, or t
  modified_base (204)..(204): a, c, t, g, unknown or other
  misc_feature (204)..(204): n is a, c, g, or t
  modified_base (518)..(518): a, c, t, g, unknown or other
  misc_feature (518)..(518): n is a, c, g, or t
tcagacgagtgcgtcacgaccggtgctcgatttagagcgactagcaacaccaaggtggaacccaaaaaccaccacccctcgttggggagaactcccctagatcacagctcctcaccagtgggacgggacctgggagcattccttttcgttgggtggcagcagacaaacgnggtcgcccacctcccgtaggttccaccgtgggtncgtaggtcgtgggatccgtggaggtctgaccgaaggaaccggtccgggtcggggtcctacgtagggtgtaggttggtccctaccgtgactggtcgtctgttacgtactactttcccgtttacacgtacggttatagttagttggtagacggtaccggaccgggtacccggaggggtacgggttgtacggagggtggtgtaggggtatcggtactaccggtaccggttaacccgtaaaacgtaaaacgtaaaggtgtaaacggtaggtaggaaacggttacggtaacgtacgggaacgggactaacggacgttanaaccgtccgaacgtaacccggaccgggttaaccggaacctaaccgtaaccggtaacccgtaaccggaacgtaaccgtaacgtaccgtaacgtaaggtacgggtaacggtaaggacccccccggagtacccggtacgacggtacgtacgtaacggaccgaccgtaccgtaaccttacgttacgtacgtcggacgtaggaacgttagtaacgttacgtacgtagtccggttccgttacggtacgtacgtaccgtaccggtacgttacgggtcgggacggtacggg

SEQ ID NO: 29651 - DNA, 839 bp, Homo sapiens
  misc_feature: GYAE6OF01BDC9C.1.49.E05.1.454.CMB.1.raw
  modified_base (158)..(158): a, c, t, g, unknown or other
  misc_feature (158)..(158): n is a, c, g, or t
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (350)..(350): a, c, t, g, unknown or other
  misc_feature (350)..(350): n is a, c, g, or t
tcagacgagtgcgtcacgaccggtgctcgatttagagcgactagcaacacacaaaggggacccaaaaaccacacccctccttgggagaatcccctagatcacagctcctcaccatcggacgggacctggagcatcctttcttggtggcagcagcaacnggtgcccactcccaggttcacctggtgcagtctggagctgagctgcagaacgccgtggggcctcgagtgatcggtctccgtgcagtcgcttntggtacncttctttccactacggtactagtagttcggtgtaagacggtaccggccccggggtaaggacgggggtccgttagacgggttggacgttagggngtaggtataccggacgtaccccgttaaaggaaacctttaaaaggaggtaagtagtacgggtaaagtaacgggtaacgttaccggacgggtacgtaaggtaacgtaccgtaagtaccgtaacgttaacccggaccggtaaccgggtaaaccctaacgtaacccgtaaccgggaacggttaaccggttaacccgtaaccggtaaccgttaaaccgggaacggtttaaccggggtaaacccgtaagggttaacccgggtacggttaccccgtaaacggtacgggtaacccttacgggaacgtaacccgggaacccgtacggtaacccgttaacgtttaaccgttaccggtcggaacccggtacgtaaccgggtaaggtttaaccttagggtacctaacccggttaccggtcggtttacccgggtaggtaacccggtttaaccggtaaaccccggttccggtacgggtttccggggttcggtaaaccccgggg

SEQ ID NO: 29652 - DNA, 1186 bp, Homo sapiens
  misc_feature: GYAE6OF01AEZ09.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacgaggtcgcccactcccaggttccacctggtgcagtctggacgctgagctgacgagaagccgtggggcctacgaggtgactcggtcctccgtgccgtagtcggtcctttacgttcggttaacctacttttacccgttttacccgtaacccgtttaacggggttaacgtttacggttaaacggtttttcggggttacggtaacgggtaaccccgggtaaccccggggggtacccccccccggggtaaagggggtacccgggggggtttaccggttttaacggggtaaccggggttacggggtaaggggtttacggggggtaaacggtttacgggggttaacgttaaccccgggtaaaccgggtttaaccccccggtttaaaaaccggggtaaaaaaccccgttaaaaaaaccgggtaacggggttaaaacgggtttaaacggttaaacggggggggtaaaacgggttaaaacggggttaaaacccggggtttttaacccccggggaaaacgggggttaaccggtaaacggggttaaaccggttaaccgtaaaccgttttaaaccccggttaaacggtacccccggttaaaccccggggacccggggtaaacccgtaacccgtaaacccggttaaccccgggtaaaccgggtaaaccgggttaaaccccgtaaacccggtaaccccgttaaaccggtaaacgggttaccggggtaaaccggttaacggggtaaaccggggtaccggtacccccggttaacggtaaggtaacccggtttacggtaaccgggtaaaccccgggtaacccgggtaacccggttaaccccgtttaaacccgttttaacggtttaaacccggtcgggtaacccgggtaacgggaaacgtttaaccggtaaacggttttaacggttaccggtaacccggttaaccgggtttccgggttaaacccggtttacgggttaccccggtttaaacggttaacccggtaacccggtttccgggtttcgggggtaaacgggtttaacccccggggg

SEQ ID NO: 29653 - DNA, 779 bp, Homo sapiens
  misc_feature: GYAE6OF01AV0Q0.1.49.E05.1.454.CMB.1.raw
  modified_base (218)..(218): a, c, t, g, unknown or other
  misc_feature (218)..(218): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctgggcctnagtgtaaggttcctgcaaggtcttcgagtactacaccttcacgtaggtatgcttatactagttggggtgcgtcccgaccgggaccccccggaagaaacgggtccgttaggacggtcggagtgggagtggactacgaacgcgtagggactaagtacggtaaacaaacgaaaaacgttaccgaacgtaacggtaacggttaccggaagggtacctaagggtaccgttacccgttaaacccctttaaccgggaaccgggtaacaaccgtaccgttacccggacgtaacgggttaactttaaccgtttaagtaaaggttacggaacgtacgtaacgggtaacgaccggtacgtcccgtaaggtaaccggtaaccgtaaccccggaaaggtccgtaaccgggtactttagtttaacgtttagttttacggtcgtacccgttaccggttcggttagggttcgggtacggtttaccttaaggttttaacgacccgttcgttaacttacggttttaccgtaccggttccgggtacggggttacccgtaacggggtaaccccgttccggg

SEQ ID NO: 29654 - DNA, 665 bp, Homo sapiens
  misc_feature: GYAE6OF01DFE82.1.49.E05.1.454.CMB.1.raw
tcagacgagtgcgtcacgaccggtgctcgatttagagcgactagcaacacacaaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgagtggtctcctgcagtgcttcgtggtactattcctttaccacctacggtatagtaagttggttagacgacgacgggcccccggaggacggggtcttggaggtggagtgggagtggatcgacgtacccgtacggaaaacctaaagacgagtacgtaggaagtaagtacgttacgaggacagtagtcgatcacgtacgaccgcgaaccacgactaccgaacgaacgtacacgtacctaacgacgtacggacgtaggaacggacgtaccgtacgacgtacgtacgtacggaacccgtaccgtaccggtacctaacgtttacgttaaccgtcgaccggtaccgtaaggtacgttatttacggtaccgtaccgtaccggtcggttcccggtacggtaccgttaccggttaaacccgcgtttacggttgggcgggtaacccggg

SEQ ID NO: 29655 - DNA, 914 bp, Homo sapiens
  misc_feature: GYAE6OF01DZB02.1.49.E05.1.454.CMB.1.raw
  modified_base (185)..(185): a, c, t, g, unknown or other
  misc_feature (185)..(185): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtncagtctggagctgagctgcaggaagccgtggggcctcagtgagtggtctctgctattgtcttcgtggttactactttccttttcccaccgttacggtatacgtaagtttggttagacgtaccgaccgggtcccccgggagggtacgggggtccgttagggacgggttaggggtaggtagggggtagttcgggtacgtaccgtaaccggttaacccccggtttaaacgggtaaaaaccgtaaaaaccggaaggtaaacgggttaaggtaacggggtaaagggtaaaacgggttaaacccggtttacccgggaaacggggtaccgtaaacgggtaacgtaccgtaaacgtaacccgtaacgttaccccgggaacccggggtaaccgtaacccggaaacctaaccgttaaccccgggaaacggtaaccggtaacccgaaccgtaaccccgtaacgtaacggttacgggaaaccgttagggaaaccgggacggtacccgttaagaaccggttacgtacggttaccggaaacccgggtaacccggtaacccggtacccgttaacgttttaccgttaaccggtccggtaaccggtaacggtaacggttaacggttaacttttacggtaccgggttacctaaccgggtttcgggttaccccgtttagggtaacccgttaaaccggttaaccccggttaccggttcgggtttccggggtcggggttaacccccgggg

SEQ ID NO: 29656 - DNA, 755 bp, Homo sapiens
  misc_feature: GYAE6OF01CUYWM.1.49.E05.1.454.CMB.1.raw
tcagacgagtgcgtcacgaccggtgctcgatttagagcgactagcaacacacaaaaggggacccaaaaaccacacccctccttgggagaatcccctagatcacagctcctcaccatggacgggacctggagcattcctttttcttggtggcagcagcaacaggtcgcccactcccaggttccaccgtggtcgcagtctggagctgacgctgcagaacgccgtggggcctcgaggtgagttcggtcctaccgtgctaggtcgtctttcgttggttactactttcctttaccgtaaccgttacggttagtagttaacgtttggttacgacggtaaccggtaccgggacccccgggagggtacgggggtccgttaggtacgggtggtaggtgggtagtaggtacgtaccgtaaccggttaaccccgttaaacggtaaaaccgttaaaaacgtaacggtaagttaaggtaagggaaggtaacggtaacggttaccggaagggacgaaggtacgtacgtacgtaccgtaacgtaccggaaccggacggaaccgtactaccgtaccggaacgtaacgtaaccgtaacgtaccgtaaacgacgtacggtaacgtaggaacggacgtaccgtacgaacgtaccgtacgaccgaaccgtaaccgaccgtacttacttaacgttaccgcgacgacgtagtagtacgttagtcgacgttacggtgtccgtcgtacgtacgtaccgtaggttcgtggtcggtaccgg

SEQ ID NO: 29657 - DNA, 672 bp, Homo sapiens
  misc_feature: GYAE6OF01APMIZ.1.49.E05.1.454.CMB.1.raw
  modified_base (522)..(522): a, c, t, g, unknown or other
  misc_feature (522)..(522): n is a, c, g, or t
  modified_base (531)..(531): a, c, t, g, unknown or other
  misc_feature (531)..(531): n is a, c, g, or t
  modified_base (544)..(544): a, c, t, g, unknown or other
  misc_feature (544)..(544): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcaccgtggtgcagtctggagctgagccgcgagacgccgtgggcctcagtgagtggtcctctgctagtgtcttcgtaggttactactttccgttttacccaccgttaacggttacgtaggttaagtttgggttagtacgtaccggaccggggtaccccccgggtaaggaccggggttcgttaggacggttagggaacggtggggtactgggacgtaccgtacgtacccgttaaacggtaaactaaacgagtagtagtaggaacgtaagtacgtaccgaggcgaagtacgtacagtacgacgtcgaccggacgaccacacgtaccgagaacgtacgactaaccgtanagtacgagngacgacgtcgacngactcgacgaccgacgtccgtactaattcgtacgacgcggtaagagtagttatacgtagccgtacgtacggccgttagtacccttaaccggtacgtcgttaccggtggtacccgggtgtaacccgggg

SEQ ID NO: 29658 - DNA, 730 bp, Homo sapiens
  misc_feature: GYAE6OF01DF34P.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggatctggagcatccttttctggtggcagcagcaacaggtgcccactcccaggttcacctggtgcagtctggagctgagctgcagaagccgtggggcctcgagtgattggtcctccgtgctaggtcgtctttcgtaggttactattcctttttacccgaccgttacggtaacttaggtaaagtttgggttagaacggtaccgaccggggaccccccgggtaagggaacggggtccgttagggtaggtgggtaagtggggtagtgggacttacgacggtaccccgtaaggaaactaaaacgagtagtagtagggaagtaagtaacggttaccggaagggtacgaaggtagtactagtacaacttaccgacccggacggaacaccgtaactaccgaagtaacgtacgacgtacctacgagtacggtaaccgtggaaccggacggtccctacgtaagtcgttaaccgacgtaaccggaccgtacccggtaacctaacgttttacgtacgtcgaccggtacgacgtaagttacgtttacgtagtaccggttacgttaccgggttacgttacggtaccgttacgttaacccgcggtccggttagggtacccgggg

SEQ ID NO: 29659 - DNA, 784 bp, Homo sapiens
  misc_feature: GYAE6OF01EBJH2.1.49.E05.1.454.CMB.1.raw
tcagacgagtgcgtcacgaccggtgctcgatttagagcgactagcaacgacacaaaggggacccaaaaaccacacccctcttgggagaatcccctagatcacagctcctcaccatggacgggacctggagcatccttttcttgggtggcaggcaggcaacaggtgcccactcccgaggttcaccgtggtgcagtctggagctgagctgcagaagcctggggcctgacgtgatggtctccgtgcgagtgtcttcgtacggttactattccttttacccaccgttacggtatagtaagttggttagagtacgaccgggcccccggtagggaggggtcgttggagggtcgggagtggggatagggacttacgacggtacccgttaacgggtaaacctaaaacgtacggtaagttaaggtagggaaggtaagggtaaccgttccggaacggggaccgtaaggtacgtacctaacgttaccgaaccgttacccggaaccccgggtaccgggaaaccctaacccgtaacccgttacccccgtaacggtaaccggttaacccgaaccggtaccccttaacgaacggtaacgggtaaccggtacgggaacggacgtccccggttaacacggtacttacgtaccggaaccgtacccggacccggtaccttaaccgtttaacgttaaccggtggaaccggtacgtaacgtagtagtttacgtacgtccgtaacggttccggtaccgttggaccgttaaccgtaaccggaccgttcgttcgggtaggtccccggg

SEQ ID NO: 29660 - DNA, 715 bp, Homo sapiens
  misc_feature: GYAE6OF01BTKMA.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaacgccgtggggcctcgagtgagttggtcctccgtgcagtgtacctttcgtggttactacttcctttaccgtaccgttaggtagtagtagttggtagacggaccggaccgggaccccgggtagggtacgggtcgttaggtaggtgggtaggtagggtagtaggtacgtaccgaccggtaacccggttaaacggtaaaacgtaaacgtaggtaaggtaggtagggaacgtaacggtaacggtacggaacggacgaaggtacgtacgtaacgtacgtaccgtaccgaccggaccgaaccgaactaccgtaccgaacgtaacgtaccaacgtaacctaacgtacgtaacggtaacgtacggacggtacgtaccgtaacgtacgtacgtacggtacgaaccggaccgtaccgtaacttaacgttacgtacgtacggacgtaaggagttagtattacgtcgacgttacggtcggtcgtacggtacctacggaaccgtagtcggttggtcggtacg

SEQ ID NO: 29661 - DNA, 931 bp, Homo sapiens
  misc_feature: GYAE6OF01DQ5AI.1.49.E05.1.454.CMB.1.raw
tcagacgagtgcgtcacgaccggtgctcgatttagagcgactagcaacacacaaaggggacccaaaaaccacaccctccttgggagaatcccctagatcacagcctcctcaccatcgggacgggacctggagctattcctttttcgttgggtcggcacgcacgacaaacgacgggttcgcccctaaccgtcccgtagggtttccacccgtgggtcgcgtaggttcgtgggacgccgtggacgtcgtgacgaaggaacggtccggtcggggcctcgtaggttgacgttcgggttccttccgtggacgtagttcggtcctttcggttacggtttactaactttcccttttaccgaaccggtttaaggttagtagtttaacggttcggttacggaacggtaccgggaaccccggggtaccccggggtaaggggtaccgggggtttcgtacgggttaggggtaggtaacgggttagggaacggttcgggtaacgttaccggtaaaccggttaccccggtaaaacggtaaaaccgtaaaaacggtagggtaaaggttaacgggtagggtaaacggtaaacggtaacggttccgggaaacgggacgtaaggtacgttacaccggtttaacgaacttaccggaccggtaaccgtaaccgaacgtaccgttacccggaaaggtaaaccggtaaaccgacgaacccggttaagtaacgggtaacggtaacggaacggtacggaaccgtacgtacaaggacgttcgaaccggtaaccgaaccgtaccgggtaaccttaacgtttaaccgtaccggtacggtacggtaaccgtagtaaacggttactttaccggtcgacccggttaccgttcggttacccggtaacggttccccttaaaacggtacgtaccgggttccggttggggtaaacccggtcccggg

SEQ ID NO: 29662 - DNA, 818 bp, Homo sapiens
  misc_feature: GYAE6OF01A4766.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttccacctggtgcagtctggagctgagctgcagaagccgtggggcctcgagtgatggtcctccgtggcagtcgtcctttcgtaggttactactttccttttacccgaccgttaacggttattaggtaagtttcgggttaggaacgtaccggaccgggtaccccccggggaaggacggggggttccgttagggtacgggtgggtaggtaggggagttcgggacgttcgacgtacccggttaaacgggtaaaaccttaaaacggaggtaacggtaggtagggaaacggtaaggtaaccggttacggaacggggtcgaaagggtacgtacgtaacttaccggaaacgttacccggaacccgggaaccgggtaacctaaccgttaacctacccggaaacggtaccgtaaacgtaaccggaacccttaaacgaggttaacgggaacgttacggaacggtaccgtaccgtacgtaacggtacttaccggtaacgaacccggtaaccgacccgggtaaccttaaccgtttacgttaccgcggtacccggaggaacggttagtaacgtttagtacggtacctagggttccgttcccggtacgttacggttaacgtaccccggtaggttccgttgggggtacgtacccgggg

SEQ ID NO: 29663 - DNA, 777 bp, Homo sapiens
  misc_feature: GYAE6OF01EWUED.1.49.E05.1.454.CMB.1.raw
  modified_base (133)..(133): a, c, t, g, unknown or other
  misc_feature (133)..(133): n is a, c, g, or t
  modified_base (163)..(163): a, c, t, g, unknown or other
  misc_feature (163)..(163): n is a, c, g, or t
  modified_base (291)..(291): a, c, t, g, unknown or other
  misc_feature (291)..(291): n is a, c, g, or t
  modified_base (765)..(765): a, c, t, g, unknown or other
  misc_feature (765)..(765): n is a, c, g, or t
tcagacgagtgcgtcacgaccggtgctcgatttagagcgactagcaacgacacaaaggggacccaaaaaccacacccctccttgggagaactcccctagatcacagctcctcaccatgggacgggacctgganctattccttttctgggtgcagcagcaacgnggtcgccctactcccgtaggttccaccgtggtcgctagtcgtggacgtctgacgtctgccgaagacggtcccgtaggggccttcgaaggttcgacttcgggtccttccgtgcgtaggttcgtcgtttnttacggtttacctactttccgtttaccgtaccgttaacggttacttacggttaagtttcgggttacgaacgtacccggtacccggggtaaccccgggtaggtacgggggtccgttagggtacgggtagggtacggttcggggtacgtacgggtacgtccgtaaccggtacccggttaaaacggaaaacgttaaacgaggtacggtagtacggaaacggtacggttaaccgtacggggaacggactaacggtacgtactaacggttccgaaccgttaccgaccggaaccggaacctacggactaccgaacgtacgtacctaaccgacgttaacgaaggtcgacggtagccgtacgtcctagaactcggtaacaccggacaacggttacgaccttaatacgtaccggtcgaacggttagacttagtacgtgtcgacgtcggttcgtacgtacggttcctaacggtctacttcgggngtccggtaccgg

SEQ ID NO: 29664 - DNA, 806 bp, Homo sapiens
  misc_feature: GYAE6OF01CJBQF.1.49.E05.1.454.CMB.1.raw
tcagacgagtgcgtcacgaccggtgctcgatttagagcgactagcaacacacaaagggacccaaaaccacacccctccttgggagaatcccctagatcacagctcctcaccatggacgggacctggagctatccttttctggtggcagcagcaacaggtgcccactcccgaaggttcacctggtcgcagtctggagtctgagctgcagagccgtgggcctgagtgagtggtcctccgtgccgtagtcgtccttgtacggttactacttcctttaccgacgttacgtagtagtaagtttgggtacgaacgaccggaccggtaccccgggagggtacggggtacttacggtaggtaggtaggtaggtacgtaggaactaccggaacggtaaccccgttaaaggtaaaaccgtaaaaagtcggtaagttagaagggaacgtaaaggtaaccggttaccgggaagggtacgtaaggtaaccgttacgtacgtaccgacggtaccgacccgggaacgtaacccggtactaaccgtacccgaacggtaacgttaacccggaccttaaccgtaaccgtaggttaaccggaaacggttacgaaaccgggtactaacccgtacgttaaagacccgtttacccgggaacggtaaaccccgtacccggtaaacggtaccccctttaagttaccttaaccgggccgtaccgggtataaccggggttaaatacgttttcggtaccgtaccgttacggttcgggtacctggttacctaaaccggtacctaccgggttccgttagggcccgggttaccggg

SEQ ID NO: 29665 - DNA, 809 bp, Homo sapiens
  misc_feature: GYAE6OF01ETSFA.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttccaccgtggtgcagtctggagctgagctgcagacgccgtgggcctcgagtgagtcggtctccgtgctaggtcgtctttcgttggttactacgtttccttttacccgtaccgttacggttacgtagttaagtttggttacgacggaaccgacccggggacccccgggtagggtacgggggtcgttacgggagggttagggaggttcggggaagtcgggtacttacggaaccgttacccggttaaacggtaaaacctaaaacggtaggtaacgttaggtagggaaggtacggtaacggttaccggagggtacgaaggtacgtactagtaccgacgtacccgaaccggccggaactaaccaccgtaccgaacggtacgtaccgacgtacctaacgacgtacgggtaacgtggaacggtaccgtacctacgagttacgtacggtacggaaccgtaccggtaccggtacccttaacgttttaacgtacggtaccggtacggtaacggtaaccggttagtttacgttacgtaccggttaaccgttaccggttcccgggttacccggttacgggttaaacccgttaccggttaaaccccggttacggttaccgggtttcgggggaccggttacccgggg

SEQ ID NO: 29666 - DNA, 685 bp, Homo sapiens
  misc_feature: GYAE6OF01DTJ2J.1.49.E05.1.454.CMB.1.raw
  modified_base (247)..(247): a, c, t, g, unknown or other
  misc_feature (247)..(247): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtggggcctcgagtgatggtctcctgcagtgcttntaggttactattccttttccacctaggtagtagtaagttggtagacgtacgacgggcccccggaggaggggtcttggaggtggagtgggagtggactcgacgtacccttaacggaaactaaacgagtagtagtggaagaagtaacgttacgagggacaagacgtacgtactacgactaccggaccggtacgaaccgtaaccaccgtacccgtaacggtaagtaacccgacggtaacctaacgacggtacggtaacgtaggaacggacgtcctacggactacgtacggtacggaaccgaaccgtaccgggtacccttaacgtttaaccgttacgtcggaccggtacgaaaggtaacttacggttagttacgtacctacgggttcgttacccgggtagaccttaccggtaaacccgtcgttacggttgggcggtaccggg

SEQ ID NO: 29667 - DNA, 750 bp, Homo sapiens
  misc_feature: GYAE6OF01CUGAZ.1.49.E05.1.454.CMB.1.raw
  modified_base (161)..(161): a, c, t, g, unknown or other
  misc_feature (161)..(161): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtncccactcccaggttcacctggtgcagtctggagctgagctgcagaagcctaggggcctcgagtgtagtgggtctccgtggcctaggtcgtcttccgtagggttaccacgtttccttttaccgtaccttaacggttagtaggttaagtttgggtttacgaggtaaccgtacgggaccccccgggtaaggaaacggggggtctttacgggaacggttacggggtaacgttacgggggaggtttagggacgttacggaaccggtaaccccgtttaaacggggaaaacctaaaaacgtaacggtaaaggtacgttacgggaagaacggtacggttaccgaagggtacgaggtaacggtactaacgtcgaacgtaccgaaccggacgggaacactaacgttaccgaacgtaacggtacacggtaccttaagagtacgtaacgacgaggacgacgtacgactacgtccgaggaactaccggaacggtactaacttactacgtcgacgtaagtacggagtacgtttagttcgaccttacggttcggtacgttacgactttaacggtaaaccctgtcggttaaggtcgggtacccgg

SEQ ID NO: 29668 - DNA, 696 bp, Homo sapiens
  misc_feature: GYAE6OF01BRF93.1.49.E05.1.454.CMB.1.raw
  modified_base (484)..(484): a, c, t, g, unknown or other
  misc_feature (484)..(484): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggttacattctttccaccgtacggtatgtaagttggttgagacgacggcccccggaggacggggtcgttggaggtgggaggtcggggaagtggactcgacggtaccccgttaacggaaactaaaacgaggtaagtaagtagggaagtaaggtaacggttacgacgggacgaaggacgtacaacgtcgactaccgaccggtacgacacacgtaccgacgtagtaaccgagtacccgtaanacgtacggaacgtagggaacggacgcccgtacgtaacgtactacgtacgaaccggtaaccgaacccggtaccttaacctttacgttaccgtcggaccggtacgtaacggtattaacgtttagttcggtaccgttacggttccggtacccgttacgggtaccgttaacggttaaccccgtacggttccggtttcgggtcggggttaacccggg

SEQ ID NO: 29669 - DNA, 818 bp, Homo sapiens
  misc_feature: GYAE6OF01ERPI5.1.49.E05.1.454.CMB.1.raw
tcagacgagtgcgtcacgaccggtgctcgatttagagcgactagcaacacacaaaggggaccaaaaaccacaccctccttgggagaatccctagatcacagctcctcaccatggacgggacctggagcattccttttcttgggtggcagcagcaacgaggtcgccctacctcccgaggttccaccgtggtcgcgacgtcgtcggagtctggagctcgacaggacgccgtcggggcctacgagtcgtacgtcggtcctccgtcgacgtaggtcgtacgttcgtacgttactacgttccgtttaccgacgttacggtagttacggttaacgttggttacgaacgtaccggtacgggccccggtagggtacgggtcgttacgggaacgggtttcggacggttaggggtacgtcggtacgtacgtaccgtaccgtaacggaaacctaaacgtgtacgtaggtaggaacgtacggtaacgtcggacggtacgtacggtacgtacgacgtaccgactaccgggaaccggaccgtaactaccgtaaaccgtacccgtaaggtaaacgtacccggtaaccgtacgtaacgttaaccgggtaacgggtaaccggtaggggtaaaccgtccggttaaccgtcgttaaacgggcctttacgggaaccggtaaaccggaaccggtaccgttaaaccgttaacggtttaaccttccgggacggtacggtaacgtacggtaaattacggttactccggtacggttcgttccgggtacggtcggtttaaccacggttaacccggtacggtcggtttaccgggtcgggaacccg

SEQ ID NO: 29670 - DNA, 824 bp, Homo sapiens
  misc_feature: GYAE6OF01EJVEB.1.49.E05.1.454.CMB.1.raw
  modified_base (201)..(201): a, c, t, g, unknown or other
  misc_feature (201)..(201): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcattccttttcttgggtggcagcagcaacaggtcgcccactcccgaggttccaccgtggtgcagtctaggancgtgagtctgcgagacgccgtgggcctagagtgagtcggtcctcgtggctagtcgtcttcgtacgttactctttccgttacctaccgttacggttactaggttaacgtttggtaggacgtaccggaccgggcccccgggtaagggtacggggtcgttaggtagggtggtaaggtaggggtacgtagggtactaccggtaccggtaacccggttaacgtaaaaccgtaaacgaaggtacggttaacggaggtaagtaacggtaacggttaccgggaacgggtacgaacgttagtaacgtacgtaccgtaacgtaccgaacccggaacggtacctaacccggtaaaccgtccccggtaaacggtaacggtaaacccaccgggtaaaccccttaacggaacgggttaaccgggtaacggtagggtaacccggacggtaacccgttaacggtagaccgttaacggtaccgaaccgtacccgtacgggtaacccttaccggtttataccgagtccggaacgtagttaacggacttttcggtaccggtacgttccggttccggggttaccgtacggttaaccgtaccggttaacccgtaccggtgggtttccgggaagggtaccccggg

SEQ ID NO: 29671 - DNA, 711 bp, Homo sapiens
  misc_feature: GYAE6OF01CO7F0.1.49.E05.1.454.CMB.1.raw
  modified_base (182)..(182): a, c, t, g, unknown or other
  misc_feature (182)..(182): n is a, c, g, or t
  modified_base (216)..(216): a, c, t, g, unknown or other
  misc_feature (216)..(216): n is a, c, g, or t
  modified_base (320)..(320): a, c, t, g, unknown or other
  misc_feature (320)..(320): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttctggtggcagcagcaacaggtgcccactccaggttcacctggtncagtctggagctgagctgcagagccgtgggcctnagtgatggtctcctgctagtgcttcgtggttacattcttttaccacgtacgtatgtaattggttgagacgtacgggcccccggtaggacgggggtcttggaggnggtagtgggtatggatcgacgtacccgttaaggaaactaaaacgaggtagtaagtagggaagtaaggtaacggttacgaagggtaccgaaggtaaggttacaacgttacgactaccggaaccggtacggacaacgacgtacccgaggtaacgtacgaaccgtacctaacgtagtacgggaaacttggaacggtacgaccgttacgaaggtacttacggtacgaacggtaacccgtaccgggtaacccttaacgttaacgttaccggtacggacccggagtaacggaacgtttaagttaccgttcggtaacccgttacggttccggggttccgtacggtaccgttaaccggtaaacccgttccgtacggtttcgggtacggggtaacccggg

SEQ ID NO: 29672 - DNA, 851 bp, Homo sapiens
  misc_feature: GYAE6OF01AGS25.1.49.E05.1.454.CMB.1.raw
  modified_base (521)..(521): a, c, t, g, unknown or other
  misc_feature (521)..(521): n is a, c, g, or t
tcagacgagtgcgtcacgaccggtgctcgatttagagcgactagcaacacacaaagggacccaaaaccacacccctccttgggagaatcccctagatcacagctcctcaccagtggacggacctggagcatccttttcttggtggcagcagacaacaggtcgcccacctacccgtaggttccaccgtggtgcgtacgtcgtaggacgcgtggagtcgtgcgaaggaacggccgtggggtccctacgtagtggtacgtcggtcctccgtagcgtagtcgtctttctggttacctctttccgtttaccaccgttacggttattagtagtttcggttacgacgacggtccggtaccccggaggtacgggtactggtaacggcggtaggacgggtagtacggtacgtaccggtacgtacccggtaaaacgtaacgtaaaacgtacggtaaggtacgtagggaaaccgtaggtaaccggttacggacggtagtacgtacgtacgtaacgtaccgtataccggtaancccgggaggtaacaccggttacgtacccggtaagtaaccggtacctaccggtaaccgttaacgacgttaaggtaacccggtaggaaaccgggtcccgttaaccggtacgttaagaacccggttacgtaaccgggacgtaaacccgggccggttaaaccgtttacgttaacggttaacccgtccgggtaaccggtacgggttaaaccgttaggtttaacgttaccggttaccttacccggggtttaacgttacccgggttacccgggtttacggtaccggtttaaaccccgaacccggggttttctccgggggttttaaccgggacccggg

SEQ ID NO: 29673 - DNA, 783 bp, Homo sapiens
  misc_feature: GYAE6OF01BKQII.1.49.E05.1.454.CMB.1.raw
tcagacgagtgcgtcacgaccggtgctcgatttagagcgactagcaacacacaaaggggacccaaaaaccacacccctcttgggagaactcccctagatcacagtctcctcaccatgggacgggacctggagctattccttttcttgggtggcagcagcaacgaggtcgcccaccgtcccgtaggttccaccgtgggtcgctacggttccgtaggagtccgtggagtccgttggacaaacggacggtcccgggtcggggtccttacgaggttacgcgttcgggttcctccggtgtcgtcggttcttcggttcgttagttaccttactttcctttacccgtacgttacggtattacggtaggttcggtaggaacgccggacccgggtcccggggtagggtcgggtcgttagggaggtgggtaaggtcgggagtcgtaccgtaacggtacccgtaaccggttaaacggaaaacgttaaccggaaggttacgtaaggtaacgggaaggtaataccggtacggtaccgggagaacgtttagacgtactacgacgaccccgagacgtaccaacgtacgtaccggaccgttagaccgtaaccgtacgtaaacgacggtaacgttaccgggaaggcccggtaactccgacgtaggttacccgtcggaccgtaaccgtaccgcccgttaaatttaccgttacgtaccgaggccgtaagtacgtacctagttcgtacggtgttcgtaccgttcggtactcctacggtacgtagtcggttacgggctccgggg

SEQ ID NO: 29674 - DNA, 801 bp, Homo sapiens
  misc_feature: GYAE6OF01AQ1AK.1.49.E05.1.454.CMB.1.raw
  modified_base (446)..(446): a, c, t, g, unknown or other
  misc_feature (446)..(446): n is a, c, g, or t
tcagacgagtgcgtcacgaccggtgctcgatttagagcgactagcaacacacaaaggggacccaaaaaccacacccctccttgggagaatcccctagatcacagctcctcaccatgggacgggacctggagcattcctttttcgttggtggcagcagacaacgaggtcgcccaccgtcccgaggttccaccgttgggtcgcgagttcgtggagtcgttggagccgtgacgaaggtaacggccggtggggccctacgtaggtgtagttcggttcctccgtgaccgtagtcggttctttacgttacggttacctacttttccgtttacccgaccgttaggttattaggttaagtttggtacgacggaccgtaccggggaccccggagggtcgggttgtagcgggtggtaggtggtagtcgatacgacgttaccgtaaagaaactaagngtagtaggagtaagagtaacggtcggaggacgtaagtacgtactacgtacgtacgaccggaccggtaacgacgtaaccgtaacctaaccggaacgttaacgtacccgaaccggtttaaccctaacggtaacggttaccgggtaaaccgtagggaaacccggtcgtaacccgtcggtaactccgttaaccggcgaacccggttaccgggacccgtttaacctaagtttaccgccgtaggaaccctacgggtagtaaacccggtttgttaacggtcccgtagttaccgggttcgtttaaccggtccgttaacgtaaccggtacggttaccctggggtcccgggtcggtaaccccggg

SEQ ID NO: 29675 - DNA, 605 bp, Homo sapiens
  misc_feature: GYAE6OF01BDY74.1.49.E05.1.454.CMB.1.raw
  modified_base (459)..(459): a, c, t, g, unknown or other
  misc_feature (459)..(459): n is a, c, g, or t
  modified_base (542)..(542): a, c, t, g, unknown or other
  misc_feature (542)..(542): n is a, c, g, or t
  modified_base (562)..(562): a, c, t, g, unknown or other
  misc_feature (562)..(562): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcattccttttcttgggtggcagcagcaacaggtcgcccactcccaggttcacctggtgcagtcgtggagcgtgagctgcgagaacggccgtggggcctcgaggtgtagtggtcctccgtgactgtgtcgttcgtaggttactctttcctttacccaccgttacggtatacgttaagttggtagacgaccgtaccgggccccggagggtacgggtcgttggaggtcggtagtgggagtggactcgtacgtaccgtaacggaaacaagagtagtacgaggtaagagtagtacgacggtacagacgtacagtactacgacgacgacgacaacncgtacgacgtactacgacctacgtagagtacgacgagacgacacgagagtactcgacgacgacgacgtactaacgttgtacgngacgagaagtctaagttcgntcgtacgtcgcgtagtcgtacgtacgtagtcgtcggcgtacgg

SEQ ID NO: 29676 - DNA, 834 bp, Homo sapiens
  misc_feature: GYAE6OF01AJLEA.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatgggacgggacctggagcattccttttcttgggtggcagcagcaacaggtgcccactcccaggttcacctggtgcagtctggagctgagctgcagaagccgtggggccctgagtgatcggtctccgtgccgagtcggtctttacgttggttactactttcctttccaccgttcggtattagtaagttggttggaacgaccgtaccgggcccccgggaagggtacgggggtcgttggaggtgggtaggtaggggtatagggtacttaccgaacggttaccccttaaacgggtaaaacctaaaacgtaggaaggttaacgaggggtaacgaagggttaaccggttaccggaagggtacgtaaggtacgttacgaagtacgttaccgaccgaacccggtaccgggaactaaccgtaccgttaccggaaccggtaacgtcccaacggtacccgtaacacggttaaccggggaacgtcgggtaaacgtacccggtaacccgtaggaaaccgttcgaacccggtacgtaaccggaaccccggaacccggttacccgtaaaccgttttacgtaaccccgggtaggtcccggtaacggtaagtaaacgtacgtttaccggtaacggtacccgttaccgggttaccggggtaccgtaacccggtttacccggtaaccgttaaccccggttaccggtttcgggtttacccggggtagggtaaccccgggg

SEQ ID NO: 29677 - DNA, 621 bp, Homo sapiens
  misc_feature: GYAE6OF01B1301.1.49.E05.1.454.CMB.1.raw
  modified_base (218)..(218): a, c, t, g, unknown or other
  misc_feature (218)..(218): n is a, c, g, or t
  modified_base (388)..(388): a, c, t, g, unknown or other
  misc_feature (388)..(388): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctgggcctnagtgatggtctcctgcagtgcttcgtggttacattctttccactacggtatgtaattggtagagacgtacggccccggaggagggcttgagtgagtggtatggatcgacgtccgttaacggaataaaacgagtagtagtggaagagtaagttcgagggacagagtacatnagtacacgacggacacgtataccgaagacgtacacgacctaactaagtacgggaaacctgggaaacgggtacaccgttacgaggaattccgtagaaccgtaccgaaccgggtacctaaacgtttattaccgagggtaccgacgggaagtaacgtagtttagttcgaccgtacggttcggtaccgttaggaccttacggtaaccccacggtttaccgttgggtcgggtaaccgg

SEQ ID NO: 29678 - DNA, 773 bp, Homo sapiens
  misc_feature: GYAE6OF01A4LPG.1.49.E05.1.454.CMB.1.raw
  modified_base (621)..(621): a, c, t, g, unknown or other
  misc_feature (621)..(621): n is a, c, g, or t
tcagacgagtgcgtcacgaccggtgctcgatttagagcgactagcaacacacaaaggggacccaaaaaccacacccctccttgggagaatcccctagatcacagctcctcaccatgggacgggacctggagcacttccttttcttgggtggcagcagcaacgaggtcgcccactcccaggttcaccgtggtgcagtcgtggagctgagctgcagaacgccgtggggcctcgagtgagtcggtcctccgtagcgtagtcgtccgttcttcggttactacgtttcctttaccctaccgttacggtagtagttaaggttggtagacgtacggaccgggaccccgggtagggtaggggtcgttaggtaggtgggtacggtagggagttacgggtataccggtaccggtaaccccggttaacggaaaaacctaaacgtaaggtaacggtaaggtaagggtaacggtaagggtaaccggtaaccggaggggacaaggtaccgtagacgtactacgtacccggtaaccgacgggtaaccaacgtaccgtaaccggaaggtaacctacccgtaacgaacccgtaagtaacgttacggtaacgggtacgtaacgggtcgtaacccggtanaaccggtaacgtccgtaacgacccggaccggaaccgtacttaacgtactacccggtaggtccgaacggtagtacttacgttacgtcggtacgtcggttccggtacgtccgtacgttaaccgacggtaggttaccgtgggtacggggtacccg

SEQ ID NO: 29679 - DNA, 732 bp, Homo sapiens
  misc_feature: GYAE6OF01AR7GS.1.49.E05.1.454.CMB.1.raw
  modified_base (246)..(246): a, c, t, g, unknown or other
  misc_feature (246)..(246): n is a, c, g, or t
tcagacgagtgcgtcacgaccggtgctcgatttagagcgactagcaacacacaaagggaccaaaaccacaccctcctggagaatccctagatcacagctcctcaccatggacgggacctggagcattcctttcttgggtggcagcagcaacaggtcgcccacctcccgacggttcaccgtggtcgcagtcgtggagcgtgacgctgcagacgccgtcgggctcgagtgagttcggtctccgtgcgngtcggtcttcgttagttacgttattccgtttacccacgttacggtattacgttaagttggttaggacgtacggcccgggtaccccggtagggtacgggttcgtaggtaggtacggtaggttaggggagtacgggtactaacgtaccgtaaccgttaaaccggaaaactaacgaacgtaggtaacgtacggaaggtaacgtacgtacggagggtactaggaacgtacagtacgacgtcccgacggaccgtacgtaactacgtaccgaacggtacgtaccgtacgtacctaaacgtagtaccggaagtacggtaaccgaccgtacgtacgtaacgacgttacggaaccgaaccggtaccgtacccgtacctttaacggtaccttaccggtacgacgtaacgtaggtaccgttaagtttacgtccgtacggtaaccgttccggtacgtacgttacgtaccgtacctaggtctcgggtacggtacccggg

SEQ ID NO: 29680 - DNA, 710 bp, Homo sapiens
  misc_feature: GYAE6OF01DRCLH.1.49.E05.1.454.CMB.1.raw
tcagacgagtgcgtcacgaccggtgctcgatttagagcgactagcaacacacaaagggacccaaaaccacacccctccttgggagaatccctagatcacagctcctcaccatggacgggacctggagcatccttttctggtggcagcagcaacaggtcgcccactcccaggttcacctggtgcagtctggagctgagctgcagacgccgtggggcctcgagtgagtcggtcctccgtgactaggttcgtcttcgttacgtactactttccgttttacccacccgttaggtatacgtaacgttggttagacgtacggaccgggtcccccggtaggtacggggtccttaggaggtgggacgtgggtagtggacgtacgtacggtaccccgttaacggaaactaaaacgtaggtaacgtaggtaacgggtaggtaaacggtacggttaccggaagggtaccgtaaggtaacgtacgtagttaaccgctacccggaaccggacggtaaccacgtaccgtacccgaacgtaacgtaactaccgtaacctaacgaacgtacgggaactagggaacgcgtccgtaacgagtactcgtaacgaccgaaccgaccgtaccttacttaacttacgcgaccgtacgaggtacgtattacgtcgacgttccggttcgtacccgtggaccgttaccgacgtacgtacgtgggtcggtacccgg

SEQ ID NO: 29681 - DNA, 765 bp, Homo sapiens
  misc_feature: GYAE6OF01CJIAD.1.49.E05.1.454.CMB.1.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
tcagacgagtgcgtcacgaccggtgctcgatttagagcgactagcaacacacaaaggggacccaaaaccacacccctccttggagaatcccctagatcacagctcctcaccatggacgggacctggagcattccttttctggtggcagcagcaacaggtgcccactcccaggttcacctggtgcagtctggagctgagctgcagaagccgtggggcctnagtnagtggtctccgtgctagtgctttacgtggttaactacttcttttacccaccgtaggttatgtaaagttggttagaaggaccgacgggcccccggaggaggggtctttggaggtggtagtaggggattggactacgaacgtaccccgttaacggaaaacttaaaaacgagtagttaagagggtaaggtaaggtaacggttaccgaaggggaaccaaggtacggtacctaagttaccgaacgttaccccggaaccggtacccgggaaacctaaccaacggttaacccaaccggggtaattaacccgaacggtacccttaaaccgaggttaacgggaaccgttaggaacggggacgttcccctaaaggaactaacgttaccgttaaccgggaaccgttaccgaaccgggtcccttaaacgtttaacgtttaccgacggaccggtaaccgaaggtaaccgtttagtaagttcggaacctacggttcgggttacccgtagaccgtttaccggaaaccctaggtacccgtttggggacggtaccccgg

SEQ ID NO: 29682 - DNA, 794 bp, Homo sapiens
  misc_feature: GYAE6OF01AHGTI.1.49.E05.1.454.CMB.1.raw
  modified_base (139)..(139): a, c, t, g, unknown or other
  misc_feature (139)..(139): n is a, c, g, or t
  modified_base (187)..(187): a, c, t, g, unknown or other
  misc_feature (187)..(187): n is a, c, g, or t
  modified_base (198)..(198): a, c, t, g, unknown or other
  misc_feature (198)..(198): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttnttggtggcagcaggcaacaggtcgcccacctcccaggttccacctggngcagtcgtggngctgagctgcagagccgtggggcctcagtgtatcggtcctcctgcagtcgtcttcgttggtactacttcctttccgaccgttacggtataggtagtttgggtacgacggtaccgcccgggaccccggagggacggggtcgttacggagggtcggtacggtagggtataccggtagtaccgaacggttaacccgttaaacggaaaaccgttaaaacgacgggtaacgttaggaccggggtaacggtaaacggtaaccggttaccgggaagggtaccggacgtacgtacgtactacgacgtaccggaccgacgggtacaccgtaactaccgtacgacgtacgtaccgaccgtaacgaacggtacggtaacgtacggacggtccgtaacgtcggaacgttaccgacggtaaccggaaccgtacccggaccggttaacccttacggttaaccgttaccgggtacggaccgggtaacgtaacgggtactttaacgtaccgttcggtaccgttccgggttaaaccgggtcccgttaagggtccgttaaacccgggttacccgtaagggtttcgtaacccgggggtttcgggtaacccggggg

SEQ ID NO: 29683 - DNA, 735 bp, Homo sapiens
  misc_feature: GYAE6OF01BVCHH.1.49.E05.1.454.CMB.1.raw
  modified_base (273)..(273): a, c, t, g, unknown or other
  misc_feature (273)..(273): n is a, c, g, or t
  modified_base (701)..(701): a, c, t, g, unknown or other
  misc_feature (701)..(701): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttctggtggcagcaggcaacaggtagcccactcccaggttcacctggtgcagtctggagctgagctgcagagcctggggcctcgagtgatggtctcctgcagtgtcttcctggttacattctttccaccttacggtntgtaattggttgaagtcgacgggcccccggaggacgggggtcttggacgtgggtagtgggtacgtgggattaccgagttaccccgttaacggtaaaccgttaaaacacgggtaagttacggtagggaaggtaaacggtaacggtttacccgaaggggtacaaggtacgtacgaacgttcaacgttccgaacccgggaccggtaaccaaccgtaccgtaccgaaccgggtaacggtaaccctaacgggaccccttaacgtaacgttaccgggaaacgtttcgggaacgggtacctcccggttaccgagtacgtcgtaacggacccggtaacgacccgggtacccttaccttaaagtttccgacggtaccgcgggtaacgtagtaacgtttcgtacgtacgtacggtccgggttactcggtacccgttanaaaccccggtcgtcggttccgtaggggtccccgg

SEQ ID NO: 29684 - DNA, 681 bp, Homo sapiens
  misc_feature: GYAE6OF01CD1ZV.1.49.E05.1.454.CMB.1.raw
  modified_base (263)..(263): a, c, t, g, unknown or other
  misc_feature (263)..(263): n is a, c, g, or t
  modified_base (534)..(534): a, c, t, g, unknown or other
  misc_feature (534)..(534): n is a, c, g, or t
  modified_base (577)..(577): a, c, t, g, unknown or other
  misc_feature (577)..(577): n is a, c, g, or t
tcagacgagtgcgtcacgaccggtgctcgatttagagcgactagcaacacacaaaggggacccaaaaaccacacccctctgggagaatcccctagatcacagctcctcaccatggacgggacctggagcatccttttctggtgcagcagcaacaggtgcccactcccaggttcacctggtgcagtatggagctggagctgacagaaggccgtggggcctcgaggtgagtcggtctccgtgctagtcgtccttgtaggttactntttcctttccacgtacggtatgtaacgtttggtacgaggacgaccgggaccccggagggtacgggcttaggaggtggtagtgggatggtacgtaccgacggtacccgttaacgaaaactaaacgagtaacgttagagggaaagtaacggtaacggttaccgagggacaagtacgtacacgtactacgtaccgaccggtacgaacctacgacgtaccgaacggtaacgtaccgacgtaccctaagtacggtacgactagggacgacgcctanacgatccgtaggactaccgacgtacctaacgttcgttaaccgnggtacgtacggagtagttaatttaacgtcggtaactacgggtttcccgtcggttagtcccgttaaaccgtacgtaccggtcgtttcggggtaacgggtacccgg

SEQ ID NO: 29685 - DNA, 908 bp, Homo sapiens
  misc_feature: GYAE6OF01E0K7J.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctggagctgcagaacgcctggggcctcaggtgagtggtctacctgcagtgcttctggttacattccttttaccacgttacggtatgtaatttggggttacgacggtaccgaccggggtaccccccgggtacgggtacggggtacggttaggaggttcgggtacggtacgggggtaacgttacgggtaacgttaccgtaacgggtaaccccgttaaaccgggtaaaaccgttaaaaaccggtaacggtaacggttaaggtacgggtaacggtaaacggtaaacggttaccggtaacgggtacgtaacggtaacgtaccgtaacgttaccgtaacgtaccgtaacccggtaccggtaacccgtaaccgtaaccgtaacccgtaaaccggtaaaccggtaaacccgtaaccggtaacccgttaaaccggtaaccggtaacgggtaaaccggtaacgggtaaccgggtaaccggtaacccggttaccggtaaccggtaaccgttaacccggttaaccgggtaaacccggtaaacccggtaaacccgggtaaccccgttaaacccgtttaaccgtttaaccgttaaccggtaccggtaccggtaacggtaacggttaacgtttaacggttaccgttaccggttaccggttaccgggttacccggttaccgggtaccgttaccggttaacccgtaccggttaccggttacgggtaccggg

SEQ ID NO: 29686 - DNA, 776 bp, Homo sapiens
  misc_feature: GYAE6OF01CQRDL.1.49.E05.1.454.CMB.1.raw
  modified_base (585)..(585): a, c, t, g, unknown or other
  misc_feature (585)..(585): n is a, c, g, or t
  modified_base (624)..(624): a, c, t, g, unknown or other
  misc_feature (624)..(624): n is a, c, g, or t
  modified_base (746)..(746): a, c, t, g, unknown or other
  misc_feature (746)..(746): n is a, c, g, or t
tcagacgagtgcgtcacgaccggtgctcgatttagagcgactagcaacacacaaaggggacccaaaaaccacacccctccttgggagaactccctagatcacagctcctcaccagtggacgggacctggagcattccttttctggtggcagcagccaaacgaggtcgcccactcccgaggttccaccgtggtgcctagtctggagcgtgagctgcgaggacgccggtggggcctcgaggtgatcggtcctaccgtgctacggtcgtccgtttcgttacggttacctcttttacccgttttacccgaaaccggttaccgggttaagttggttaaaggtttggggttagaacggtaccggaccccggggtaccccccggggagggtacgggggttccgttagggtacggtagggtaggtgggtacgtggacgttaccgtaccggtaaaccccggtttaacggaaaacgtaaacggaggtacgtaaggtacgggaaagtaagggtaaccgttcggaacgggtacgaacggtacgtacgactacgacgtacccggacgaccgacacgtaccgaccgtaagacgtaaccncgtaccaacgacggtagaaccggtgacggactaccgtanacgtactacgtacggaaccgacctacccggtacttaacgttcgtaacgcgggaccgtacgaagtacgttattacgtcgacggttacgtcccggttggaaccgttccgtaaacggttacccgnggttttccgacgggttcggtaaccccgggg

SEQ ID NO: 29687 - DNA, 690 bp, Homo sapiens
  misc_feature: GYAE6OF01CAS03.1.49.E05.1.454.CMB.1.raw
  modified_base (403)..(403): a, c, t, g, unknown or other
  misc_feature (403)..(403): n is a, c, g, or t
  modified_base (649)..(649): a, c, t, g, unknown or other
  misc_feature (649)..(649): n is a, c, g, or t
tcagacgagtgcgtcacgaccggtgctcgatttagagcgactagcaacacacaaagggacccaaaaaccacacccctcttggagaatcccctagatcacagctcctcaccatggacggacctggagcatccttttctggtgcagcagcaacaggtgcccactcccaggttccacctggtgcagtctggagctgagctgacaggagccgtgggcctgagtgagtcggtctccgtgctaggtcgtcctttgttggttaacctactttcctttttacccaacccgttagggttattaggtaatttgggttagaaggtaccgtaccgggacccccggaagggacgggtcgttggaggtggtatgggagttggacgtcacggtacccgttaacggaaactaaaaacgngtaacgtagtaggaagtaaggtaacggtaccgagggactaggacgtactacgtacgaagtacccgacggaccgtaaccaactaccgtaccgaacggaactaacctacgaacctaacgaagttacggaagtacggagtacaccgtacaaggtactacgtacggaaccgtaaccgaaccggtaccttaacttagttaccgtcggaccggaagtggaaattaagttatacggtcttacgtcggttaccnggttaccgtacgaaaccccgtggtcgttcgggtggtacccg

SEQ ID NO: 29688 - DNA, 756 bp, Homo sapiens
  misc_feature: GYAE6OF01BD78R.1.49.E05.1.454.CMB.1.raw
  modified_base (263)..(263): a, c, t, g, unknown or other
  misc_feature (263)..(263): n is a, c, g, or t
  modified_base (592)..(592): a, c, t, g, unknown or other
  misc_feature (592)..(592): n is a, c, g, or t
tcagacgagtgcgtcacgaccggtgctcgatttagagcgactagcaacacacaaacggggacccaaaaaaccacacccctccttgggagaatcccctagatcacagctcctcaccatggacgggacctggagcatccttttcttggtggcagcagacaacaggtgcccactcccaggttcaccctggtgcacgtctagggagcctggacgctggacaggaacggcccgttcgggggcctcgtagtcgtagtcggttcctccgngtacgagttgtccgtttcgttcggttaactacttccttttcccgaaccgttacggttagtgttagttggttagacgaccggaccggggcccccggaagggacgggggtcgttacggtaggttagggtacgtggggtatagggtaactccgaccggtaaccccgtttaaacggaaacgtaaaaaccgaggtaacggttacggtagggaacggtaaggtaaccggttaccggaacgggtacgacggtataccgtactacgaactaccggaaccggacggaccacaccgtacccgaagtaaccgacgaacctacgactacgaacggtaacgnggacggacctccgtacgaacgacttaccggtacgaaccggaaccgaccgttaccgtaacttacgtaccgtgaccgacgtaggtaacgtagtttacgccgttactacggttccggaccgttcgaccgttaacggtacccgtgtacgggttcggtcgtaaccgggg

SEQ ID NO: 29689 - DNA, 672 bp, Homo sapiens
  misc_feature: GYAE6OF01B8389.1.49.E05.1.454.CMB.1.raw
  modified_base (198)..(198): a, c, t, g, unknown or other
  misc_feature (198)..(198): n is a, c, g, or t
  modified_base (246)..(246): a, c, t, g, unknown or other
  misc_feature (246)..(246): n is a, c, g, or t
tcagacgagtgcgtcacgaccggtgctcgatttagagcgactagcaacgacacaaaggggacccaaaaccacacccctccttgggagaatcccctagatcacagctcctcaccatggacgggacctggagcatcctttcttggtggcagcagcaacaggtgcccactcccaggttcacctggtgcagtctggagctgngctgcagagcctggggcctcgagtgatcggtctacctgcagtgtcttntgtactacttctttccacgtcggtatagtacttggtagagtaccacgggacccccggaggtacggggtcttggtaggtggtaacggtggggtatcggtactcgacgtaccccgttaacggtaaactaaaacgcggaagttaggtacggaaggtagacggttaccggaggacgagacgtgtaaactcgtaactcccgaaccggcgtaccgacgtaacctccgaacgtacgtacacgtaccgactacggtacgaacgtaggacggtacgcgttacgacgtatacgtacggacctacggtacccgcgttaacgttacgttacgttaccgacgacggtaacgtacgttaagtacgttggtacgttacgttccgggtccggttagtcccggttacgtaacccggtgtttaccggtgggtaccggtaccggg

SEQ ID NO: 29690 - DNA, 652 bp, Homo sapiens
  misc_feature: GYAE6OF01COS81.1.49.E05.1.454.CMB.1.raw
  modified_base (194)..(194): a, c, t, g, unknown or other
  misc_feature (194)..(194): n is a, c, g, or t
  modified_base (519)..(519): a, c, t, g, unknown or other
  misc_feature (519)..(519): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggngctgagctgcagaagccgtgggcctcgagtgagtggtctcctgcagtgcttcgtaggttactagttccttttccaaccgttacggttatagtaagtttgggttgaacgaccgtacgggccccccgggagggtacggggtccgtttggaggtgggagtgggagtggatcgacgtacccgttaacggaaactaaaacgagtaagtacgtaggaagtagtaacgttcgagggtacagtacgctagtcagtaccgaccgacgacacacgtaccaacggaactacgacgtaccctaagacggtaggaacgttggaacggacgtaccctanagtaacgtcgtaacgaacggaccgtaaccggtcctaacttacgtacgtcgacggtcgagtacgttattagttcgcttacggttcggtccgttcggacttacggtaacccgtattaccgttgggtaccggtacg

SEQ ID NO: 29691 - DNA, 662 bp, Homo sapiens
  misc_feature: GYAE6OF01A2ML0.1.49.E05.1.454.CMB.1.raw
  modified_base (529)..(529): a, c, t, g, unknown or other
  misc_feature (529)..(529): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtcgcccactcccaggttccacctggtgcagtctggagctgagctgcagacgccgtggggcctcgagtgatggtctcctgctagtcgcttcgtggttacattccttttccaaccttaggtatgtaatttcggttagacgtacgacgggacccccggagggacggggtcttggacggtggaggttgggagtgggactacgtacgtacccgttaaacggaaactaaaacgagtaggtacgtaggtaacgaaggtaacggtacggaagggacgagtagtacatacgacgtaccgaccgacgactacacgtaccacggtaactaccgaacgtacctaacgtacgacgggttaaccgtggaacgtacgcccgtaanacgtactacggtcgaaccgacggtaccgtaccttaagtttactcgtaccggagacgtagtacgtattacgtgtacgacggttcggtacctcggacgttaccgtaaccgtacgtcggttacgggcgttaccggg

SEQ ID NO: 29692 - DNA, 710 bp, Homo sapiens
  misc_feature: GYAE6OF01AZ9N6.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcacctggtgcagtctggagctgagctgcagaacgccgtggggcctcgagtgatcggtctccgtagctaggtcgtcctttcgtaggttacctacgtttcccttttacccgaaccgttacggttataggtaagtttggttaggaacgaccgtaccgggcccccgggtaagggacgggggtcgtttggaggtggaggtcgggtagtacgggattccgacgtacccgtaaacggtaaacgtaaaacgaggtagtagtagggaaggtaggtaacggttcgagggacgtaagtacgtactaatccaagtccgaaccggacgaccaaccactaccgacgactaccacgtactaagagtacggaagtagaggacgtacctagatactacgaccgacgtaaccgaccgtactaacttacgtacgtacggacgacggtaagttagtactttaacggtacgtaccgttacgttccgggtacgttaccgggtacgttaacccggtaaccccggttacgttgggttccggggtcggttaacccggg

SEQ ID NO: 29693 - DNA, 783 bp, Homo sapiens
  misc_feature: GYAE6OF01BNA2I.1.49.E05.1.454.CMB.1.raw
  modified_base (169)..(169): a, c, t, g, unknown or other
  misc_feature (169)..(169): n is a, c, g, or t
  modified_base (693)..(693): a, c, t, g, unknown or other
  misc_feature (693)..(693): n is a, c, g, or t
  modified_base (729)..(729): a, c, t, g, unknown or other
  misc_feature (729)..(729): n is a, c, g, or t
  modified_base (770)..(770): a, c, t, g, unknown or other
  misc_feature (770)..(770): n is a, c, g, or t
tcagacgagtgcgtcacgaccggtgctcgatttagagcgactagcaacacacaaaggggacccaaaaccacacccctctgggagaatcccctagatcacagctcctcaccagtggacggacctggagccattccttttcgttgggtcggcacgcgagacaacgaggtcnccctacctcccgtaggttccaccgttggtcgtacctagtccgtggacgtcgttaggagtcgtgaccgaaggtacggtcccggtgggccctagtaggttcgtacgttcggtccttccgtgtactggtcgttcgtttcgttacggtttacttacgttttcccgttttacccgtaaccggtttacggtacgttacggtttaacggtttaggttacgtaaccggaccggtaaccccggggccccgggtaaggggtcgggttacggttagggtcggtacgggtaggtgggtaacgtggtaccgtacgtaaccggtaaccgttaaagaaacctaaggacggtagtacggagggaagtacggtaagtaccggtaggtacgagtacgacgttaacaccgttacgaaccgacggtaccgacgtaaccacgtacgacgtagtacccacggtactagacgttaggtaaccgtagggaccgtaccgttacacgtacgtacgcgtaacggacctaccgacgttaccttaacgtacgngtacgacacggaagttagtacctacggtcttaaccncgggtaactccggtacgtaccgtaccgttacgatttcgggnggtccgtaccggg

SEQ ID NO: 29694 - DNA, 813 bp, Homo sapiens
  misc_feature: GYAE6OF01EZ4CX.1.49.E05.1.454.CMB.1.raw
  modified_base (201)..(201): a, c, t, g, unknown or other
  misc_feature (201)..(201): n is a, c, g, or t
  modified_base (317)..(317): a, c, t, g, unknown or other
  misc_feature (317)..(317): n is a, c, g, or t
tcagacgagtgcgtcacgaccggtgctcgatttagagcgactagcaacacacaaaggggacccaaaaacccacacccctccttgggagaatcccctagatcacagctcctcaccatggacgggacctggagcatccttttcttggtgcagcagcaacaggtcgcccactcccaggttcacctggtgcagtctggagctganctgcagacgtccgtggggcctcgagtgagtcggtctcctgcagttgctttcgtaggttacctagttctttccacgtacggtatagtaagttgtagacacggacggcccccggaggnggggtctcggtaggtacggtagtaggggtcgtagggtactacgtacgggttacccgttaacgggaaactaaaaccggtggtaaggtacgtagggaaggacgtaaggttccgagggcaaggtacgacgtacttacgacgtacccgaccgggtacgaacctaccgtacgtaccgaacggttacgtaacgaccggtactaacgtaacgtacgggaaaccggtgggtaacggaccgtccgttaacgacggtactacgtaacggaacccgtaaccggtacccgggtaacccttaacgttttaaaccgtccggtaaccgggtacccggtaggtaaaccggtaacgtttaacgttttaccgggtacccttaacccggggttaaccggttcccggggtttacccccggtaacgggtttcccccgtttaaaacggggtttaaacccccccttaccggggtttaccccggttttacgggggtccccggggtttaaaacccccgggg

SEQ ID NO: 29695 - DNA, 730 bp, Homo sapiens
  misc_feature: GYAE6OF01DSRIN.1.49.E05.1.454.CMB.1.raw
  modified_base (188)..(188): a, c, t, g, unknown or other
  misc_feature (188)..(188): n is a, c, g, or t
  modified_base (488)..(488): a, c, t, g, unknown or other
  misc_feature (488)..(488): n is a, c, g, or t
tcagacgagtgcgtcacgaccggtgctcgatttagagcgactagcaacacacaaaggggacccaaaaccacacccctccttgggagaactcccctagatcacagctcctcaccatgggacgggacctggagcatccttttcttggtggcagcagcaacaggtcgcccactcccaggttcaccgtggtncagtctggagctgagctgcagacgccgtggggcctcgagtgactggtcctcctgacctagtgtcctttcgtacggttactacttccttttaccgaccgttacggtatacggtaagtttgggtacgaacggaccggaccggggacccccgggtaagggtacgggggttccgttagggtagggtagggtaggtaggggtagtcggtactccggtaaccggtacccgttaaacgggtaaaactaaacgtgtaaggtacgtagggtaagaaggtacggttaccgagggacagtacgtcacgttnaccgtacaccgggactaaccgacacctacgaacgacgtacacgtactatagacggacgtcggagacctcgtacgacggtactacggtaacgaccggtaacccgacggtaccttaacgttaccgtaacggtcgaaccggtacgtaagtacgttaagttccgtcggtacccgtaccggttcggttaccggtcgtaacccggtaccggtacccgttaaggtcgttaacggggtcggtaacccggg

SEQ ID NO: 29696 - DNA, 748 bp, Homo sapiens
  misc_feature: GYAE6OF01CFS6P.1.49.E05.1.454.CMB.1.raw
  modified_base (218)..(218): a, c, t, g, unknown or other
  misc_feature (218)..(218): n is a, c, g, or t
  modified_base (686)..(686): a, c, t, g, unknown or other
  misc_feature (686)..(686): n is a, c, g, or t
  modified_base (718)..(718): a, c, t, g, unknown or other
  misc_feature (718)..(718): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtgggcctnagtgatggtctcctgcagtgcttctggttacattcttttccacgtacggtatagaagtttggtgagacgacgggccccggaggacggggtcgttaggaggtggtagttggggagttagggacttcgaacggtacccgttaaacggtaaacgtaaaaaaccgtaggtaagttaagtaagggaacggttaacgggaaaacggttaccccggaaagggggtacccgtaaagggaacgtttaccggaaacgttaccgaacgttaacccggaacccgggaccggggaaccgaaccgtaaaccttaccccgggaacggtaaccgggttaaaccgaacggggtaaccccttaaacggtaacgttaacgggaaacccggttaggaaacgggtacgacccttacgaacggaacgttaccggacgtaaacccggaccgaacccggtaccgtaaacgtttacttacgcgtacgacgtanagtattaagttcgactacgtcgtaccgcggtnttaccgaactcgttacgtggtcgggtaccg

SEQ ID NO: 29697 - DNA, 716 bp, Homo sapiens
  misc_feature: GYAE6OF01D0W51.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctctgcagtgcttctggttactattccttttccacctacggtatgtaagttggttgacgacgtacgggccccccgggaggacgggggtcgttaggaggttgggagtggggagtgggatcgacggtcccttaacggaaactaaaacaggaacgtagtaggagagaagttcgagggacagagcatacactacgaccgcgggaacacgactacccgaacgacgttaaccgaggaccctaagacgtacgggtaaacgttagggaacggaccgtacccgttacgaagtacttacgtaccggaaccggtaacccggtaacccgggtacccttaaacggtttaaccgtttaacgtccgggtaaccggacgtaacgggtacggttaaatttacggtttacggaccgtttacggttaccggggttacccgtgggttaaccttaccgggtaaaccctaccgggtttccgggtttacggtcgggggttaaacccccggg

SEQ ID NO: 29698 - DNA, 582 bp, Homo sapiens
  misc_feature: GYAE6OF01BSLQD.1.49.E05.1.454.CMB.1.raw
  modified_base (358)..(358): a, c, t, g, unknown or other
  misc_feature (358)..(358): n is a, c, g, or t
  modified_base (452)..(452): a, c, t, g, unknown or other
  misc_feature (452)..(452): n is a, c, g, or t
  modified_base (572)..(572): a, c, t, g, unknown or other
  misc_feature (572)..(572): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgtattggttgagacgaggcccccggaggagggggtcttggaggtggagtgggatggatcgagcccgttaggaactaaacagagtagnggagaggacgttcgagggcaggagtacatcatccgacgcggacacgactaccgacgacgtacagacctacgagtcggaactaggaggacgcctnagtactcgagacgacgaccggtacctaacgtttacgtaccgtaggaccgtaggaacgtaggtaacttagtcgtactacgttcggttccgtggtcttacggtaaccgtacggtcgttcggngggtacccgg

SEQ ID NO: 29699 - DNA, 712 bp, Homo sapiens
  misc_feature: GYAE6OF01D2NAC.1.49.E05.1.454.CMB.1.raw
  modified_base (213)..(213): a, c, t, g, unknown or other
  misc_feature (213)..(213): n is a, c, g, or t
  modified_base (374)..(374): a, c, t, g, unknown or other
  misc_feature (374)..(374): n is a, c, g, or t
  modified_base (404)..(404): a, c, t, g, unknown or other
  misc_feature (404)..(404): n is a, c, g, or t
tcagacgagtgcgtcacgaccggtgctcgatttagagcgactagcaacacacaaaggggacccaaaaaccacacccctccttgggagaatcccctagatcacagctccctcaccatggacgggacctggagcatccttttcttggtggcagcagcaacaggtgcccactcccaggttcacctggtgcagtctgagctgagctgcagaagccgnggggcctcgagtgattggtcctcctgctagtcgactttctaggttacattcctttaccaccgtacggtatgtaatttggttgagacgacggcccccggtaggacgggggacttggtaggtggacgtagggatgggatcgacgtcctaacggaactaaaacngaacgtagtaggaagagtaattcgaggtanagagtacagtactacacgtaccggacgaactacgacttaaccgaacgtacggtaacacgacccgtaaacgtacgtaagggtaacgttaacggacgggtaaccggaccctttacggaacgttaacgtcttaacgggaacccgttaaccacccggggaaccttaccgttttaacgtaacgggtccgaacggtcccggtaaaggtaccgaaagttttacggtaacgtacctaaccgtttcgggtaaccgttcgggtacccgtttaacgaaaaccgtaccgggtttaccgtttgggtagggtaacccccggg

SEQ ID NO: 29700 - DNA, 802 bp, Homo sapiens
  misc_feature: GYAE6OF01D0Y8W.1.49.E05.1.454.CMB.1.raw
  modified_base (161)..(161): a, c, t, g, unknown or other
  misc_feature (161)..(161): n is a, c, g, or t
  modified_base (203)..(203): a, c, t, g, unknown or other
  misc_feature (203)..(203): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
tcagacgagtgcgtcacgaccggtgctcgatttagagcgactagcaacacacaaagggacccaaaaaccacacccctcgttgggagaactcccctagatcacagctcctcaccagtggacgggacctggagcattccttttgtgggtggcagcagcaacgnggtcgcccactcccgtaggttcacgtggtgcaggtcgtggancgtgacgctagcaggacgccggtgggcctgagtgagttcggtcctcgngtacngtcgtcgtttgtacggttactctttccttacccgtaacgttacgttagtattaggttcgtaggacgtaaccggtaccccgggacccggtagggtccgggttagtaggtacggggtaggcgggtagggtaactggtaactacggtaccttaaaccggttaaaaccggtaaacgtaaaggagttaggtaacggaaggtaaaggtacgttaccgggacggacggtaagtaagtacggtactaggtacccaaacggttcccgaacgggggtaactaccgtaaccgtacccgtaaccgtaacgtaacgtaacgacgtaacccgtaagtaacggtacgggtaagtaccggaaccggtacctacccgttaagacgttaacgttccggaaacggtaacccaccggtaaccggtaaccctttagttaacccgtacggtaccgacggtaacgaaggttaactacgggtttaactccggttaacgtccggttccgtaccggttgtaacccgggttaccgtaacgtcccggtaggtttacggccgggttaaacccggg

SEQ ID NO: 29701 - DNA, 800 bp, Homo sapiens
  misc_feature: GYAE6OF01AEJRK.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccagtggacgggacctggagcatccttttctggtggcagcagcaacaggtgcccactcccgaggttcaccgtggtcgcagtctggagcgtgagctgcagaacgccgtgggacctcgagtgatcggtctccgtagcagtcgtcgtttcgtcgttactacttttcccgtttaccacgttacgtagtagttaacgttggttcgacggcgaccggggtccccggtagggtacgggtcgttacggaggtcgggagttcggggagttcggtaacgtaccgtacccgtaacccgtttaacggaaaaccttaaacgaggtaacggtagtacgggtaagtaagggtaaccgttaccgggaaggtagacggttaccgacttaacggtaacctccgtaccggacccggaccggtaacctaaccggtacgtaaccccggtaagtaaccggaacgtaaccgtaccgttaaaccgtacggttaacgggaaccggtaggtaaccgggtacgtacccgacgttacgtactccgggtaaacggtaccggaacccgaccgggtttaaccctaccgtttaacaccggtaccggacggaacgtaccgttaaagttacgttaccgtacgtacccggtacggttcccgggttaaccgtcgggttaaccttaccggttaaccgtggttaaccgtgggtcccgggtaacccggg

SEQ ID NO: 29702 - DNA, 786 bp, Homo sapiens
  misc_feature: GYAE6OF01BLFDE.1.49.E05.1.454.CMB.1.raw
  modified_base (257)..(257): a, c, t, g, unknown or other
  misc_feature (257)..(257): n is a, c, g, or t
  modified_base (288)..(288): a, c, t, g, unknown or other
  misc_feature (288)..(288): n is a, c, g, or t
tcagacgagtgcgtcacgaccggtgctcgatttagagcgactagcaacacgacaaagggacccaaaaaccacacccctccttgggagaactccctagatcacagctcctcaccatggacgggacctggagcattccttttcgttggtggcagcagcaacaggtcgcccactcccgtaggttccaccgtggtgcgtagtcgtggagtctggacgctcgacgagaacgcgtcgggctcgagtgacgttcggtactccgngacgtagtcgttactttacgtcggttaactntttacccgtttaccgtaacgttacggttatagttaacggttggtacgaacggacccgtaccgggtccccggaagggacgggtacgtaggtacggtaggtagtagggtagtacggacgtaccgaacggttaacccgtaaacggaaactaaacgtacggtaagtaggtaggaaggtaacgtacggtacggagggtacgaagttacgaacgtactaccgacgtaccgaccggacgtaccgacgtaacggtccgtaaacgtacgtaaccgaacgttaacccgaacgtaggtaacgggaaccggtaaggaccgggtaacctccgtaatacggtaaccgttagtaaaccggacccgtacgacccgttacttaaaccttggttaaaccgcgaacggtcggtagttaaaccgttacttaaggtccgaaggtttccccggtggttaccccggtacgtaccggttaaaccgtaccggacggttccggttaggggtccgtaaacccggg

SEQ ID NO: 29703 - DNA, 883 bp, Homo sapiens
  misc_feature: GYAE6OF01E30BM.1.49.E05.1.454.CMB.1.raw
  modified_base (246)..(246): a, c, t, g, unknown or other
  misc_feature (246)..(246): n is a, c, g, or t
tcagacgagtgcgtcacgaccggtgctcgatttagagcgactagcaacacacaaaggggacccaaaaaccacacccctccttggagaatcccctagatcacagctcctcaccatggacgggacctggagcatcctttcttagtggcagcagcaacaggtgcccactcccaggttcacctggtgcagtctggagctgagctgcagaagccgtggggcctcgagtgagtggtcctccgtgactaggtntccgtttagttacggttacctacttcccttttacccgaaccgttacggtaatacgtaagtttgggttagacgaccggaccggggacccccggtagggtacggggtcgttaggaaggtgggtacgttagggggtacgtacgggtacgttacccgtaaccggtaccccggtttaaaaccgggaaaaaccgttaaaaaccggtaaggtaaacggtttaaggtaacggggaaacggtaaacgggttaaccggttaccggaacggggactaacgggtaacgtaccgtaaacgttacctaccgtaacccggaaccccggtaacggaaccctaccgtaaaccgtaacccggaagtaacccgtaaacgtaaccgttaacccgtaacgtaacggttaaccggaaacgtacgggaacggtaccctacccggtaacgtaacggtaccgtaaccgtaccgggaaacccgtaacccgtaacccggttaaccttaaaccgtttacgttaccgaccgggtaccggaacggttaacggtaaactacgtttaccgtcggtaacccgttacccggttgggttaccccgttagggtaccgtttaaacccggtaaccgttacccgggttacgttttcggggaccggtttaccccggg

SEQ ID NO: 29704 - DNA, 691 bp, Homo sapiens
  misc_feature: GYAE6OF01AOLYL.1.49.E05.1.454.CMB.1.raw
  modified_base (146)..(146): a, c, t, g, unknown or other
  misc_feature (146)..(146): n is a, c, g, or t
  modified_base (225)..(225): a, c, t, g, unknown or other
  misc_feature (225)..(225): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (593)..(593): a, c, t, g, unknown or other
  misc_feature (593)..(593): n is a, c, g, or t
tcagacgagtgcgtcacgaccggtgctcgatttagagcgactagcaacacacaaaggggacccaaaaaccacacccctccttgggagaatcccctagatcacagctccctcaccatgggacgggcctggagcatcctttcttgggnggcagcagcaacaggtcgcccacctcccgaggttcaccgtggtcgcagtcgtagggagctgagctcgacagacggccgngggcctgaggtgacgttcggtctcgngacgtggttcnccgttgttcggttacctctttccttccgtacgtacgtgtagttagttgtgacggacgcggaccccggtaggacggtcgtcggtggtggtacgtgggtagtcggtagtacgaccggtacccgtaacgaaacgtaacgaggtaggtacgtaggacgtaaggtacggtacgacggtagtacggtaacgtcgtagtacgtaccgacgggtaacccgtaccggaacgtacacgtaaccgtaccgtacgttaccgtactaccgtaacgaccgtaggtaacgtggacggtacgccggtacaggtacgtacgacgaacgccgtaccgtaccttacgttntacgtcgctaaggcgtaagtccgttagcccgtgtaccggttacgggaccgttccggaacgtttaccggacgtaccggttccgtgggtccggtaaccgg

SEQ ID NO: 29705 - DNA, 676 bp, Homo sapiens
  misc_feature: GYAE6OF01DAKOS.1.49.E05.1.454.CMB.1.raw
  modified_base (301)..(301): a, c, t, g, unknown or other
  misc_feature (301)..(301): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttctggtggcagcagcaacaggtgcccactcccaggttccacctggtgcagtctggagctgagctgcagaagccgtggggcctcgagtgagtggtctacctgcagtgcttgtggttactattcctttccacgtacgtatagtattggtgagacgacggccccggnggtaggggtctggacggtggagtgggagtggactacgacgtacccgttaacggaaaccgtaaacgagtaacggtagtagggaagaaggtaacgttacgggaaggacgaagtacgtacgtaactcgactaccgaccgacggacactacctaccgacgacgaacacgtactaacgacgtaggaactagggaggtaccgcctacgacgtacgtacgtacggaaccgaccggtaccgtacccttaacgtttaccgttacggacgtaccggtaaccggaaaggtacgttaaacgttgttaccggtacaaccgggttttcgggaccgttcggtaaccgtacggttaacccgccgttacggttcgggtcgggttaacccggg

SEQ ID NO: 29706 - DNA, 741 bp, Homo sapiens
  misc_feature: GYAE6OF01D3NK3.1.49.E05.1.454.CMB.1.raw
  modified_base (126)..(126): a, c, t, g, unknown or other
  misc_feature (126)..(126): n is a, c, g, or t
  modified_base (200)..(200): a, c, t, g, unknown or other
  misc_feature (200)..(200): n is a, c, g, or t
  modified_base (339)..(339): a, c, t, g, unknown or other
  misc_feature (339)..(339): n is a, c, g, or t
tcagacgagtgcgtcacgaccggtgctcgatttagagcgactagcaacacacaaaggggacccaaaaccacaccctctgggagaatccctagatcacagctcctcaccatgggacgggacctggancattcctttttcgttggtggcagcagcaacaggtcgcccactccaggttcaccgtggtgcagtctggatcgtgngtctgacagacgccggtcgggcctgagtgtagtcgttctcgtgctagtctcttgtgttaactctttcttacctacgtagtatagtagtgtagacgacgaccggccggagggtacggtcgtggtacggtggagggtcggngtaggactacgaccgtaaccgttaacggtaaaacgtaacaggtaagttaggacggtaagtacgttaacggtcggaggtaacgacgtgtactacagtaccgaccgtaacgggtacccgtaacaacgtacccgtaacggtaacgtacgtaacccgtacgtaacccgtagtaacggttaaggaacggtacggaacgggtccgaccgtacgagtaccgtcggaacgtaacccggaaccgttaccgttaacgttttaagtcttacgggacgtacgaacggtaaacttgttttaaggtaaccggttcggtacgttaccggggtccttttaccgggggccctttaaacccggtacggtttaaacccccgtggggtttaaacccggttggggaacccggttacccggggg

SEQ ID NO: 29707 - DNA, 779 bp, Homo sapiens
  misc_feature: GYAE6OF01BBRVQ.1.49.E05.1.454.CMB.1.raw
  modified_base (160)..(160): a, c, t, g, unknown or other
  misc_feature (160)..(160): n is a, c, g, or t
  modified_base (209)..(209): a, c, t, g, unknown or other
  misc_feature (209)..(209): n is a, c, g, or t
  modified_base (462)..(462): a, c, t, g, unknown or other
  misc_feature (462)..(462): n is a, c, g, or t
tcagacgagtgcgtcacgaccggtgctcgatttagagcgactagcaacacacaaaggggacccaaaaaccacaccctcttgggagaactccctagatcacagctcctcaccagtggacgggacctggagcattccttttcttgggtggcagcagcaacgnggtcgcccacgtcccaggttcaccgtggtcgctagtctggacgtctganctgcaggacgccgtggggcctgtaggtcgtgttcggtccttccgaggcgtaggttcggtccttacgttacggtttactacgtttccgtttaccgtaaccggttacggtattaggtaacggtttggtacggaacgtaccggtacccggggaccccggtaagggtacggggtcttacgggtaggttaggaggtacggtaggttcggaacgttcgaacgtaccgttaaacggaaacgtaaacgaggtagtaacggnggtaaacgaggtaacggtcggtaacggagtacgtagtacgtacgtacgtacgtaaccgggccgtaacgactaaccgactaccggtaagaccggtacaccgtacgacgtacggtagtaacgtaagggtccgtaactccgagtaacggtactacgggttaaccaacgggtaccgaaccgtaccgtttaattacggtacgaccggacggtaacgacggttaactaaggtttaccgtcggtacggttaccgtgggttaccggtaccgttaaccgttaccgggaaacgttgggtttcgtaccgggggttcggtaaccccggg

SEQ ID NO: 29708 - DNA, 740 bp, Homo sapiens
  misc_feature: GYAE6OF01DVKA9.1.49.E05.1.454.CMB.1.raw
tcagacgagtgcgtcacgaccggtgctcgatttagagcgactagcaacaccaaggtggaacccaaaaaccacacccctccttgggagaatcccctagatcacagctcctcaccatggacgggacctggagcatccttttcttggtggcagcagcaacaggtcgcccactcccaggttcaccgtggtgcagtctggagctgagctgcagacgccgtgggcctcagtgatggttcctccgtgcgagttcgtctttcgttggttactactttccttttcccaccgttacggttattagtagttggttagacgaccggaccgggtcccccggagggacgggtcgttggaggtggaggtgggagtggatcgacggtacccttaaggaaactaagagagtagaggaagtaagtacggtacgacgggacgaggtactcgtactacgtacgtaccgtaccggaccggaacaccgtaccgtacccgaacggtacgtaaccgaccgtacctaacggacgttaacgggaaccgtagggaaccggtacgtaccctacggaacgttccgttacggtaccggaaccgtaacccggtaacccgggttaccctttaacttaccgttaacggcggtaacccgggtacgtaaggtacgttagttaaccgttccggtaccggttcggttaccggttaccggtcggttaaaccgtttaccggtaacccgtaccgggtttgttccggggcggtacccgggg

SEQ ID NO: 29709 - DNA, 963 bp, Homo sapiens
  misc_feature: GYAE6OF01BNB0Y.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtcgcccactcccaggttcaccgtggtgcagtctggagctgagctgcagagccgtggggcctgagtgagtcggtctacctggctagtgtcctttcgtggttactattcttttaccaccgttacggtatgtaattggtacgagtacgaccgggtcccccggagggtacgggtccgttaggtaggtcgggaaggttaggggtagttcgggacgttaccggtaaccgttaccccggtttaaaccgggtaaaaccgttaaaaacgtacgggtaaggttaacggtacggggtaaacggtaacggtaaacggtttacccgggaagggggtaacccgtaagggtaaccggtttacccgtaaagttacccgtaacccgggttaaccccggtaacccgggaacccgggtaaacccgtaaaccccggttaaaccgttaaccccccgggtaaccgggttaaaaccggttaaacccccggttaaaccgggaaaccccccgtttaacgggttaaaccgggttaaccgggttaaaacccgggtttaccgggggaaaccggttaacccggttacccgttacggtaaacgttaccggttacccggttaaacgggaaaccccgggtaacccgggaacccggggttaacccctttaacgtttttaaccggtttaacccggtcgggttaaacccgggtacccggtaaggttaaccgtttaagtttaccgttcggtacccgttacggtttccgggttacccgttaggtacccgttaacgggttaacccgtaccggtttcggttcggggtcggttaacccgggg

SEQ ID NO: 29710 - DNA, 738 bp, Homo sapiens
  misc_feature: GYAE6OF01BSPGQ.1.49.E05.1.454.CMB.1.raw
  modified_base (644)..(644): a, c, t, g, unknown or other
  misc_feature (644)..(644): n is a, c, g, or t
  modified_base (679)..(679): a, c, t, g, unknown or other
  misc_feature (679)..(679): n is a, c, g, or t
  modified_base (721)..(721): a, c, t, g, unknown or other
  misc_feature (721)..(721): n is a, c, g, or t
tcagacgagtgcgtcacgaccggtgctcgatttagagcgactagcaacacacaaaggggacccaaaaacacacccctcttgggagaatcccctagatcacagctcctcaccagtgggacgggacctggagctattcctttttcttggtggccagcagcaacaggtcgcccactcccgaggttccaccgtggtgctagtccgtagggacgtctgacgtctgacgaaggacggtcccggttgggacccttagaggttaggacttccgggttcctaccggtgtcgtaggtcgtttccgtttacgtttacgttaacctcgttttaccctttaacccgtaccggtttaacggttagttacgttaaggtttgggttaacggacggtacccggtccggggtacccccgggaagggtacggggttcgttagggtagggtagggcggtgggtagtcgggtactaccggtaccgtaaccgtaaacggtaaaccgtaaacggtaggacggttagtaacgggagtaacgggtacgtccggaacgggtatacggacgtacgtcgtactaccgcgaaccgggtacgaaccgtctaaccgtacgtacgaacgtacaccgtcgtacacggtaacgtacggagacgtcctagacgacttanagtccgacgaccgttacgtacttagtactcgacgngtacgatagtctgtcgtagtcgtcgctcggactacgtacgtntggtacgggcgttacgg

SEQ ID NO: 29711 - DNA, 784 bp, Homo sapiens
  misc_feature: GYAE6OF01D9O23.1.49.E05.1.454.CMB.1.raw
  modified_base (679)..(679): a, c, t, g, unknown or other
  misc_feature (679)..(679): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcattcctttcttgggtggcagcagcaacaggtcgcccactcccgaggttcaccgtggtagcgagtctggagctgacgctgacgacggaacgtcccggtggggacctcgaggtgagttcggtcctccctggccaggttcgtccgtttcgtacggttacctcttttccttttacccaccgttacggtagtagtagtttggttaggacgaccgaccgggcccccgggtaagggtcgggtcgttaggagggtgggtaggttgggtagtcggtacgttacgacccgggttaccgttaaacggaaaaccttaaaaggaacgttaggtaaggaggggtaaacgtaacggtaacggttaccgggaaaggggtacgtaacggtacggtaactacgtaaccgtaccgtaaccggaaccccggaggtaacccaacgttaccggaaccgtaaccggaacgtaaccgaccgacccttacggacgtaacggtaacggacgaacggtccacgtacgacgagttcgacggaaccggaacccgcgggtaaccttattacgttaacgngggtacgacgtacgtaggttcttaacggttcgtgtacccggtttacggtccggtaaccgttaccgtcgtaaccccggtagttcggttacgggcggtaacccgggg

SEQ ID NO: 29712 - DNA, 714 bp, Homo sapiens
  misc_feature: GYAE6OF01DR75U.1.49.E05.1.454.CMB.1.raw
  modified_base (692)..(692): a, c, t, g, unknown or other
  misc_feature (692)..(692): n is a, c, g, or t
tcagacgagtgcgtcacgaccggtgctcgatttagagcgactagcaacacacaaagggacccaaaaaccacacccctccttgggagaatcccctagatcacagctcctcaccatggacgggacctggagcatccttttcttggtggcagcagcaacaggtcgcccactcccaggttcaccgtggtgcagtcgtggagctgagctgcagaacgccgtcggggcctcgagtgagtcggtcctccgtcgctaggtcgtcttcgttcgttactacttcctttcctaccgttagtactagtagttggttagacgacgtacccgggaccccggagggtacggggtcttggaggtcggaggtgggtagtggtagtacgaccgtacccggttaaacgaaaaccgtaaaacgaggtaagtaagtaggaaagtaacggtaacggttaccggaagggtacgaacggtacgtacgtactacgaccgtacccgaacccgggtaccggaaccaacctaccgtaacccgaaggtaacgtaacccgacgtacctaagacggtaacggtacgacggaagggtccctaccgtagaacgtcttacggaacgaaccgacccgtaccgtacttaacgtttcaacggcgacgtacgaagtacttatttacgcgaccttaggtccggttaccgtcggaaccgttacgttaaccgngttccggtggtcgggaccccgg

SEQ ID NO: 29713 - DNA, 738 bp, Homo sapiens
  misc_feature: GYAE6OF01CMCB9.1.49.E05.1.454.CMB.1.raw
  modified_base (139)..(139): a, c, t, g, unknown or other
  misc_feature (139)..(139): n is a, c, g, or t
  modified_base (201)..(201): a, c, t, g, unknown or other
  misc_feature (201)..(201): n is a, c, g, or t
  modified_base (248)..(248): a, c, t, g, unknown or other
  misc_feature (248)..(248): n is a, c, g, or t
tcagacgagtgcgtcacgaccggtgctcgatttagagcgactagcaacacacaaaggggacccaaaaaccacacccctcttgggagaatcccctagatcacagctcctcaccatggacgggacctggagcatccttttnttggtggcagcagcaacaggtgcccactcccaggttcacctggtgcagtctggagctgagcngcagaagccgtggggcctcaagttgatggtctcctagctagtgcttntggttaactacttccttttaccaccgtacggtaattgtaaagttggttagaggaactccggggacccccggagggagggggtcttggaaggtgggagtagggtataggtatacgtaacggtacccgttaaaggaaaaacttaaaacgaggtaaagttagaaggaagaagtaacggtccgaaaggccgaagtaggtactaatacgataccgaacggtcgaaactacgactaccgaacgaacgtaacgaccgtaccaaacggtagtaacggtaacgtagggtaaacggaccgtaccgtacggaacgttaaccgtacgtaacggaacccggaacccgttaaacgggaaccctttaaccgttaaactttacccgaggtaaccgaggtaaacggtaaagttacgttagttaaccgacttaacggttccgggaaccttggaacccgtttaccggtaaaacccgtcggttaaccgttgggccgggttaaccccgggg

SEQ ID NO: 29714 - DNA, 766 bp, Homo sapiens
  misc_feature: GYAE6OF01DVWNS.1.49.E05.1.454.CMB.1.raw
  modified_base (279)..(279): a, c, t, g, unknown or other
  misc_feature (279)..(279): n is a, c, g, or t
  modified_base (322)..(322): a, c, t, g, unknown or other
  misc_feature (322)..(322): n is a, c, g, or t
tcagacgagtgcgtcacgaccggtgctcgatttagagcgactagcaacacacgaaaggggacccaaaaaccacacccctccttgggagaactccctagatcacagcctcctcaccagtgggaccgggacctggacgcacttcctttttcgttgggtcggcaggcagaccaacgaggtcgcccaactcccgtaggttccaccgtgggtgcaggtcgtggagctggacgtcgtacggacgaagaacggtccggtcgggacctgagtcgtgtcggtcctcgngactgtcgtcttcgtcgtacttcttctttaccgacgttaggtntagtagttgtagaacgcgaccggccggtaggtacggtcgtaggaggtggagtcggtagtacggtacgtacgtaacggtacccgtaaaggaaactaagacggtaaggtacggaaggtaaacggtaacgttaacggtacgggaacggaggacgtaactcgtaacaacgtaccggaccggtaaaccggccgaacctacgaacgtaaccccggaaggtaaccgtacgaaccggtaccaacggtaacggtacggacggtacggacgtaccgtacctaggacgtaccgttcggacggaaccggtaaccgtaccgttaccgttaagtttaccgtagggccgaagggtactagtaacgtttcgttacggtcggacgttaccgggttgttaacccgttgggtaaacgtccccggtaagggttccggttacgggtcgggtaacggggtcccggg

SEQ ID NO: 29715 - DNA, 759 bp, Homo sapiens
  misc_feature: GYAE6OF01CXI1Y.1.49.E05.1.454.CMB.1.raw
  modified_base (190)..(190): a, c, t, g, unknown or other
  misc_feature (190)..(190): n is a, c, g, or t
  modified_base (235)..(235): a, c, t, g, unknown or other
  misc_feature (235)..(235): n is a, c, g, or t
  modified_base (376)..(376): a, c, t, g, unknown or other
  misc_feature (376)..(376): n is a, c, g, or t
  modified_base (689)..(689): a, c, t, g, unknown or other
  misc_feature (689)..(689): n is a, c, g, or t
tcagacgagtgcgtcacgaccggtgctcgatttagagcgactagcaacacacaaaggggacccaaaaaccacacccctccttgggagaatcccctagatcacagcctcctcaccatggaccgggacctggagcatccttttctggtggcagcagcaacaggtcgcccactcccgaggttccacctggtgnagtctggagcttgacgctgcacgaacgccgtggggccctcgagtntagtcggtcctcctgacctggtcgtcgttcgttcggttaactctttccctttcccgtacccgttaaccggtattacggttaagtttcggttggaaccgaacggaccgggccccccgggtaggtacgggggtcctttacggngggtagggtacggtagggtagtacggtacgtacgtaccggttaaccccggttaaacggtaaaactaaaaccggtaggtaaccgttagtagggaacggtaacggtaaccggtttaccggagggtacaggtaactccgtaacgtcgtacgtaccccgaccggccggaaccaccgtaccgtaacccgaggtactaacccgacgtaaccgtaaccacggtaccggtaacgttggaaccggtaccgtcctaccggataccggtcgtacgaaccggaccgtaccgtacttacgttacttacgtcgacgagtagtaactnttaccggtcgcgtaacggttcggtcctacgtccgttaacctaacccgtcgttccgtgggtccgtcccggg

SEQ ID NO: 29716 - DNA, 675 bp, Homo sapiens
  misc_feature: GYAE6OF01BDVGK.1.49.E05.1.454.CMB.1.raw
  modified_base (256)..(256): a, c, t, g, unknown or other
  misc_feature (256)..(256): n is a, c, g, or t
  modified_base (654)..(654): a, c, t, g, unknown or other
  misc_feature (654)..(654): n is a, c, g, or t
tcagacgagtgcgtcacgaccggtgctcgatttagagcgactagcaacacacaaagtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagacgccgtggggcctcagtgactggtcctcctgccagttgcttgtgtactnttcctttccacctacggtatagtacttggttagacgtaccgacggcccccgggtaggacggggtcttgggagtaggaggtagggacgtgggtacgtctacggtaccccgttaaacggaaacgtaaaacgtaggaaggttaagtcggggaaggaagtaacggtaccggtagggtacgaggtaggtacagtaccgactccggaaccggtacgaccaccgacttacccgaacgtacgtaaccacgtacctaacgaggtaccgtaacgtgggacggaacctccaacgtacgtaacgtcgtaacggaccgacgtaccggaccttacgttacgttacgtcgcggtacgagtacgtagttagtaccgacggttctcgggtaccctaggttacctaccggttaccnccggtttggttcggtaccggg

SEQ ID NO: 29717 - DNA, 731 bp, Homo sapiens
  misc_feature: GYAE6OF01DD6A0.1.49.E05.1.454.CMB.1.raw
  modified_base (83)..(83): a, c, t, g, unknown or other
  misc_feature (83)..(83): n is a, c, g, or t
  modified_base (203)..(203): a, c, t, g, unknown or other
  misc_feature (203)..(203): n is a, c, g, or t
  modified_base (368)..(368): a, c, t, g, unknown or other
  misc_feature (368)..(368): n is a, c, g, or t
tcagacgagtgcgtcacgaccggtgctcgatttagagcgactagcaacaccaaggtggaacccaaaacacaccctcttggganaatccctagatcacagctcctcacagtcgggaccgggacctagggagctattcctttttcgtgggtcggacagcagacaacgtaggtcgaccctacgtccccgaggttaccacgtgggtnactagtcgtggaagtctgacgctacgcgagtaacgtccggttgggacctcgaggtcgtatcggtcctccgttaggactaggcgttattcggttacgttacttacgttcctttaccgacgtagttacgtgtaagtgtacgacgacgtcgggccggaggtacgggtntaggacggtggtaggtacggagtggtactaagaccgttaaccggtaacgaaaagtaaacgtagtaggttaagtaggaagtaagtaccggtacgaagggtacacggtagtacgtacgttcaaccggacgaaccgtcggaataccgtacgtaaccgaacgtacgaacgtcgaacgtaacgcggttaacgaacgtgaaacggctaccgtagaacgtacgtagtacgtaaccgaaccggtacggtaccttaatacgtaccggtacgtacgggtaaccagggttaaactcgttaaacgtcgtacgacggtttcggacggtttaccgtacgtaacgtaaccgttccggtaggtccgggttcggaaccgg

SEQ ID NO: 29718 - DNA, 866 bp, Homo sapiens
  misc_feature: GYAE6OF01CMSXA.1.49.E05.1.454.CMB.1.raw
  modified_base (207)..(207): a, c, t, g, unknown or other
  misc_feature (207)..(207): n is a, c, g, or t
  modified_base (356)..(356): a, c, t, g, unknown or other
  misc_feature (356)..(356): n is a, c, g, or t
tcagacgagtgcgtcacgaccggtgctcgatttagagcgactagcaacacacaaagggacccaaaaaccacaccctcctgggagaactccctagatcacagctcctcaccatggacgggacctggagcatccttttctggtgcagcagacaacgtaggtcgccctactcccgtaggttccaccgtggtgactagtctggagcgtganctgcagacgcgtgggcctcgagtcgagtgtacctcgtgacgtagttcgtcgtttcgtaggttactactttccctttaccgaaccgttacggtattacggttaagttggttacgacgtaccggaccgggtaccccggtagggtacgggtnttcggaggtacgggtacggagggtagtacgggtacttcgtaacccggtaacccgttaaacggtaaaacgtaaaacggtagtaacggttacggtagggtaaaccggttaacgtaaccggttacgggtaaggtacgaagttacggtctaaacgttccgtaaacggtaccccggaacgggtaccgaaccgtaaccgtaaccgtaaccccgtaaggtaacccgtaaaccgtccgtaacctaaacgggttaaccggtaacgggtaaacggtaacggtaccggtaacccgaccgttacgaaacgttcccgttaacgaccgggaaaccctaaccgggttaacccgttaacgttaccggtttaaacgttaccgggaacgtacccgggtagtaaacgttcgtttaaccgtttaacggtacccgttaacgggttacccggttaccggttcccggtaaaccggttaaccgttacccggttaaacgtcggtttaaccgggtcggtacgggttaaccccgggg

SEQ ID NO: 29719 - DNA, 715 bp, Homo sapiens
  misc_feature: GYAE6OF01AS38F.1.49.E05.1.454.CMB.1.raw
tcagacgagtgcgtcacgaccggtgctcgatttagagcgactagcaacaccaaggtggacccaaaaaccacacccctccttgggagaatccctagatcacagctcctcaccatgggacgggacctggagcattccttttcttggtggcagcagcaacaggtcgcccacctcccaggttccacctggtgcagtctggagctgagctgacaagacgccgtgggcctgagtgatggtcctctgctagtgtcttcgtcgttactactttccgttttacccaccgtaacggtatgtaacgttggttagaacgtaccgacggacccccgggaaggacggggtcttaggagtggagtggatggactacgagtaccccgttaacgaaaacgtaaaacgaggtaaggtaacgtaggaacgtaacgtaacgttacggaggtacgaaggtaacgactaacgtcaacgtacgaacccggtacgtaaacaacgtactaccgtaacgaacgtaaccgaagtacccgtaagttaacggtaaggaactacgggacgtaaccgcgtaacgtagtaattccgtaacggaacccgtaggtaacccgtacccgttaaacgtttaacgtaaccgtacggacgtacgtaacgtacgttaagttaggtcgtaaccctggttaccgtccggtagtaccgtaacgttaacccgtaccgtcgggtccgggttagacccggg

SEQ ID NO: 29720 - DNA, 768 bp, Homo sapiens
  misc_feature: GYAE6OF01C23ZJ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccacctcccgaggttccacctggtgcagtctggagctgagctgcagacgccgtgggcctgagtgagtcggtctccgtgactggtcgtcttcgtgttactacttcctttaccacgtacgtatagtagttgtagacgacgaccgggccggaggtacggggtcttaggaggtggtaggtagggtagtggactacgtaacgtacccgttaaacggaaaacgtaaaacgaggtaagtaaggtacggaaagtaaacgggtaacgtaccggaagggtacctaaggtaacgtactaactcgtaacgtaccggacccggtacggaaccaactacccgttaccaacgtacgacaccgtacgtaaacacggtaacgaacgtgggaaaccgacggtaccttacgaacggtacttaaccggtacggaacccgtaaacccgtaccgggttaccttaacgttaacgtttacccgggcggtaaccggtaaccggtaaggtaccgtttaacgtttacggtaccggtaacccggttacggttcccgggttcccgtaacgggtaccgtttaaccccgggtaaaccgttccggttacgggttacgggtcccgggtaacccgggg

SEQ ID NO: 29721 - DNA, 747 bp, Homo sapiens
  misc_feature: GYAE6OF01BVHYH.1.49.E05.1.454.CMB.1.raw
  modified_base (608)..(608): a, c, t, g, unknown or other
  misc_feature (608)..(608): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtgggcctcgagtgatggtctcctgcagtgtccttcgttggttactactttccttttacccaaccgttacggtaattgtaacgtttgggttacgacggtacgaccggggaccccccgggtaggggacgggggtcgttacgggtaggtagggtaggtggggtacgtgggtaacgttaccgtaaccggtaacccccgtttaaacgggaaaaacctaaaaaccggtaggtaacgttaaggtagggtaaagggtaaagtaaacggtttaccggaaggggacctaaggtacggtacacttaccgaactacccggacggaccggaacctaacgacgtaaccgacgaacgtaacgacgtacctacgaacgtacggtaacgtggacggactaccgtacgaagtntacgacgtaccgaccgtaccggtaaccttactttacgtagtccgacgtaggaagtacgttatttacggcgttaccgtacgttccgggtaccgtcgtaccgttaccgtaccgtacccgtcggttcgggtcggtacccggg

SEQ ID NO: 29722 - DNA, 826 bp, Homo sapiens
  misc_feature: GYAE6OF01CPNNR.1.49.E05.1.454.CMB.1.raw
  modified_base (203)..(203): a, c, t, g, unknown or other
  misc_feature (203)..(203): n is a, c, g, or t
tcagacgagtgcgtcacgaccggtgctcgatttagagcgactagcaacacacaaaggggacccaaaaaccacacccctccttgggagaatcccctagatcacagctcctcaccatgggacgggacctggagcattccttttcttggtggcagcagcaacaggtcgcccactcccaggttccacctggtgcagtctggagctgngctgcagagccgtggggcctcgagtgagttcggtctccgtgcgagtcgtctttcgtggtttactctttaccttttccgtaaccgttacggttattaggttaagtttgggttagacggtaccggacgggtacccccgggagggtacgggggtactttggtacgggtaggtaaggtacgggtagtacggtaacgtaccggtaaccggtaaccccggtttaaaccgggtaaaaccgttaaaaaaccgtaggtaaacggtaaggtaaggggtaaaggtaaacgggttaacggttaccgggaaagggtaccgaaggtaacgtaaccgtacgttaccgtacgtaccggaccggtaccgaaccgaccgtaccgtaacccgtacgtaacggtaaccctaaccgaaccgttaaccgacggttaacggtacggtacggaaacgggtaccgtacccgtaacgtaccggtaattaccggaaccggtaaccgaaccggaccccggttaacctaaccgtttacgttaacgcccggtaaccggtagtaacgtagttagtttcgactaaccggttcggtccggtttacccggcgttaccgtacgtaacccggtagttccgggtggtcccgggtaccggg

SEQ ID NO: 29723 - DNA, 721 bp, Homo sapiens
  misc_feature: GYAE6OF01B49A4.1.49.E05.1.454.CMB.1.raw
  modified_base (326)..(326): a, c, t, g, unknown or other
  misc_feature (326)..(326): n is a, c, g, or t
  modified_base (526)..(526): a, c, t, g, unknown or other
  misc_feature (526)..(526): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatccttttctggtggcagcagccacaggtcgcccactcccaggtccagtcttgtgcagtctggggctgaggtgaagacgccgtggggacctgagtaggtaacggtttcctgacgaggtcttcgaggtactaccaccttacacgtaggtatgaccttatactagttgggtcgaccgaccgaccgggacccccggaanaacggtctaggaggtcggtaggtagggtagtggactacgacgtcgtacgactaagtacggtaaacaaactaaaactcgaacgaaggtacgtacgaggacgagtacgtacctacccgttacgaacggtacacgtacgtaccgaggtaagttacttaacgttaagtacggaggtacgtacgtgaacgaccgtacggtaccgngtaacggtaccgtaccggaaggtaccgcggttacgttagtttaactttggttttacgacgtacccgttacgtacggttaggtcgggtacgttacttaagttacgttaccgtacttacggttaacgtttcggaacccggtttccgggtaacgggtacccggtaacccggtacctttaccgggtcccgtaaccccgg

SEQ ID NO: 29724 - DNA, 578 bp, Homo sapiens
  misc_feature: GYAE6OF01A6RF3.1.49.E05.1.454.CMB.1.raw
tcagacgagtgcgtcacgaccggtgctcgatttagagcgactagcaacacacaaaggggacccaaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgctttcgtggttacattccttttccacctacggtatgtaattggttgagacacggccccccggaggagggggcttggaggtggagtgggatggatcgagcccgttaacggaactaaaacgagagtagtggagagaagttccgaggcagtagtcatcatcaccgcgacactactccgacgatacagcctaacgagtcggaacttaggacgacgccttacagactcgtacggaacgtaccgaccggtcctaacgttacttaactcggacgcgagtagagtttacgtcgtatccgtcggtcgtcggtacgttacgtaacccgtactcgttggtcgggtacg

SEQ ID NO: 29725 - DNA, 787 bp, Homo sapiens
  misc_feature: GYAE6OF01A8A8J.1.49.E05.1.454.CMB.1.raw
  modified_base (225)..(225): a, c, t, g, unknown or other
  misc_feature (225)..(225): n is a, c, g, or t
tcagacgagtgcgtcacgaccggtgctcgatttagagcgactagcaacacacgaaaggggacccaaaaaccacacccctccttgggagaatcccctagatcacagccctcctcaccatggacgggacctggagcatccttttcttggtggcagcagcaacaggtgcccactcccaggttcaccgtggtgcagtcgtggagctgagctgcagacgccgtgggcctnagtgagtcggtcctcgtgcagtgtctttcgtaggttactactttcctttacccaccgttaacggttattaggtaagtttgggttagacggtaccggtacgggaccccccgggtagggacggggtcgttgggacggtagggaggtagggagtgggtacgtcgacggtacccgttaaacggaaaacgtaaaacgaggtaggtacgaggaacgaaggtaacgtcggaacgggtacgaaggtacgtactacgtacgaacgtcccgaaccggacgggaaccaacctacgtacccgtaacgtaacgtaaccgacgtacccttaacgacggttaacgggaacgttacgggaaggtaaccgccgtaacgagtaacgtacgacggaacccgtaacgacccgggtaaccttaaccgtttacgttaaccgtacgggtaccggaaccggtaaggtacgttaacggtttagtaccgggtaccgtttaacgggtcccgggttaacgttaccgggtaccgtttaacccggaaacccggttaccgggtttcggttaaccgggtcggggtaaccccggg

SEQ ID NO: 29726 - DNA, 669 bp, Homo sapiens
  misc_feature: GYAE6OF01AXV7V.1.49.E05.1.454.CMB.1.raw
  modified_base (202)..(202): a, c, t, g, unknown or other
  misc_feature (202)..(202): n is a, c, g, or t
  modified_base (493)..(493): a, c, t, g, unknown or other
  misc_feature (493)..(493): n is a, c, g, or t
  modified_base (557)..(557): a, c, t, g, unknown or other
  misc_feature (557)..(557): n is a, c, g, or t
  modified_base (597)..(597): a, c, t, g, unknown or other
  misc_feature (597)..(597): n is a, c, g, or t
  modified_base (603)..(603): a, c, t, g, unknown or other
  misc_feature (603)..(603): n is a, c, g, or t
  modified_base (661)..(661): a, c, t, g, unknown or other
  misc_feature (661)..(661): n is a, c, g, or t
tcagacgagtgcgtcacgaccggtgctcgatttagagcgactagcgaacacacaaaggggacccaaaaaccacacccctcctgggagaatcccctagatcacagctccctcaccatgggacgggacctggagcatcctttctggtggcagcagcaacaggtgcccactcccaggttccacctggtgcagtcctggagctagngctagcaagtagccgtcggggcctcgagtcgattcggtcctccgtaggcctagtgtacctttagttacggttactacgtttcccgttttccgaccgttacggtagtagtaaacgtttggttacggaaggaaccggacccgggtaccccccggagggtaacgggggtctttaggaggtggtaaggtgggtacgttaggactacgacggtacccgttaacgaaactaaagagtacgagtagacggtagtagtaccgaggagagtagtacacgtactatccgaccgtaccgacncgtacgtccaacgtacggtaccacggtactagtacgtacgaagtacggtagacgtccacgtaanctcgtacgaccgacgtacgtaccttacgttactacggtcncggagngtaactgttactcgacttcggtcgtcgtacgtacctaacgtacgtacgtacgttcggnggtaccgg

SEQ ID NO: 29727 - DNA, 724 bp, Homo sapiens
  misc_feature: GYAE6OF01BWPQE.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctaggggcctcgagtgagtcggtctcctagcagtgtcctttgtggttaactattccgttttaccaaccgttacggtattggtaaagtttgggtttagaacggtaccgaccggggccccccggaagggtacgggggtacgtttaggaaggtacgggtaaggtaggggtagtacgggtaagtaccgtacggtaacccgttaaaccgggaaaaccttaaaaacggagtaacgtaagtaggaacggtaagtaacgttacgaagggacgtaaggaagttcgactacgactacgaccggacgacgtacactaccgaacgacgtaccgaacgtactaacgacgtaacggacgtacggacgacgtaccgtacgagtacgtcgtacggtaaccaaccggaccgtaccgtaacttacgttagcggtaccgaggtaacgtagtaagttacgtacgtacgtaacggttggtcccgtagtaccgttaaccggtaaccgttaccgtccgttagggccgtaaacccggg

SEQ ID NO: 29728 - DNA, 682 bp, Homo sapiens
  misc_feature: GYAE6OF01ARAT9.1.49.E05.1.454.CMB.1.raw
  modified_base (95)..(95): a, c, t, g, unknown or other
  misc_feature (95)..(95): n is a, c, g, or t
  modified_base (160)..(160): a, c, t, g, unknown or other
  misc_feature (160)..(160): n is a, c, g, or t
  modified_base (621)..(621): a, c, t, g, unknown or other
  misc_feature (621)..(621): n is a, c, g, or t
tcagacgagtgcgtcacgaccggtgctcgatttagagcgactagcaacaccaaggtggacccaaaaccacacccctccttgggagatcccctagntcacagctcctcaccatggacgggacctggagcatccttttcttggtggcagcagcaacaggtcncccactcccaggttcaccgtggtagcagtctggagctgagctgcagacgccgtgggcctgagtgtatcggtcctcctgctagtcgtcttcgtgttactactttcctttacctacgtacgtatcgtagttggtagtacgaccgtaccggggaccccggtaggggtaccgggtcgttaggacggttacggtaggttacggggagttaccggaacgttcggtaaccccgtaacccgggttaaaaccggtaaaaccgttaaacggacgggttaggttaacggtaccggggaaagtaacgggttacggttaccggaacggtccggaaggtacttacgactacgtacgtaccgaccgacgacaccgactaccgtacgacgacgtacacgtactacggacgtacggagacgtctacccgtgacgtacctgaccgagaccgaccgtatccgttagtaccgcgcgacgtntagtacgttagtacgtcgacgtccgtcgtgtcctacggtacaggttcgcggtcggtaccgg

SEQ ID NO: 29729 - DNA, 710 bp, Homo sapiens
  misc_feature: GYAE6OF01CRBHV.1.49.E05.1.454.CMB.1.raw
  modified_base (188)..(188): a, c, t, g, unknown or other
  misc_feature (188)..(188): n is a, c, g, or t
  modified_base (234)..(234): a, c, t, g, unknown or other
  misc_feature (234)..(234): n is a, c, g, or t
  modified_base (420)..(420): a, c, t, g, unknown or other
  misc_feature (420)..(420): n is a, c, g, or t
  modified_base (584)..(584): a, c, t, g, unknown or other
  misc_feature (584)..(584): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttttgtgggtggcagcagcaacgaggtgcccactcccaggttcaccgtggtncgtagtctggagctgagctgacagacggccgtgggcctcgagtcgngtcggtctactggctggtcgtacttgttacggttatactttccgtttaccctacggtacggttattaggttaagtttcggttaggaacgaccggtaccgggaccccggagggtacgggggtcttgggtaggtcggtaaggttgggagtggaattacgacgtaccgttaaacgggaaactaaaacgnggtacgttaggtaagggagtaaacgtaacgtacggaagggcggtaagtagtaacagtaacctacggtaccgaccggtacgaaactcgaacgtccggaaagtcgtaaccgacggtaccctaaagacgggtacgtaacgagacggtacacccggtgaagttccggnaaccgaaccgggtctaaccggacttacttaacggtccgaggagaccggttaagattatttcggattaccggtaacgtccggtcgtacgtaacctacggtaacgccggttagcggtcggggtaaccg

SEQ ID NO: 29730 - DNA, 760 bp, Homo sapiens
  misc_feature: GYAE6OF01ETZDG.1.49.E05.1.454.CMB.1.raw
  modified_base (196)..(196): a, c, t, g, unknown or other
  misc_feature (196)..(196): n is a, c, g, or t
  modified_base (239)..(239): a, c, t, g, unknown or other
  misc_feature (239)..(239): n is a, c, g, or t
  modified_base (345)..(345): a, c, t, g, unknown or other
  misc_feature (345)..(345): n is a, c, g, or t
tcagacgagtgcgtcacgaccggtgctcgatttagagcgactagcaacacacaaagggacccaaaaaccacacccctcttgggagaatcccctagatcacagctcctcaccatggacgggacctggagctattccttttcttggtggcagcagacaacaggtcgccccacctcccgaaggtttccaccgtggtgcncggttcgtagggacgctggagctgcagagccgtcgggcctcgngtgtacgtggtcctcgtgctagtgtcttcgtagttactcttccttttacccacgttacggtactagttaacttgggtagaagtaccgaccgggtccccggtaaggnggggtaccgttggtaagggtcgggtaagtggggtacgtacgggtaacttaccgacgggtttaaccccgttaaacgggaaacgtaaaacgtaggtaacgtaggtacggaaagtaacgggtaaccgttacgggagggtaccgtaaggtactaccgtagttaccgtacgtcccgaaccggtaccggaacctaaccgaccgtaccgacgtaacgtaaccgaacgtaccgtaacgtaacgtacgggaacgtacgggacggaccgtccgtaacggactcgtacgtaccggaacccggacgtaaccggtaccctttaacgttaacttccgaggccgttaacggacgttagtacgttacgttacgcgttaacggtccggttaccgaggtacttaccgtaacgtaggtccgttggcggtaccgg

SEQ ID NO: 29731 - DNA, 770 bp, Homo sapiens
  misc_feature: GYAE6OF01C6M85.1.49.E05.1.454.CMB.1.raw
tcagacgagtgcgtcacgaccggtgctcgatttagagcgactagcaacacacaaaggggacccaaaaaccaccacccctccttgggagaatcccctagatcacagctcctcaccagtgggacgggacctggagcattccttttctggtggcagcagcaacgaggtcgcccacctcccgtaggttccacctggtgacagtcgtcggagctgagcgtgacaggaacgccggtggggcctcgagtgtagtcgtctcgtgctagtgtcttcgtaggttactactttcctttacctaccgtagtagtgttaagttggtagacgaccgaccgggaccccggaggtacgggtcgtaggaggtggaggtagggtacgtaggtacgacgtaaccggtaccgtaaacgaaaacgtaaagtaacggtaagtaggtaaggaaggtaaaggtaaccggttacggaaggaccgtaaggtaacgtacgaactacgaaccgtaccgaaccggtacgaaccaacgtacccgtaaccgaacggtacgtaaccgtacggaaccttaaacgtaggtaacggtaacggacgggtaaccgtacgtaccctaagaacgtaccgttacggaaccgaacccgaacgtaccggtaccttaacgtttacgtaacgtcggaccggtaacggtagaacggttaactttacggaccgttaaccggtacggttaccgttccggttaaccgggcttaaacgggtaacccgttcggttaccgtcggggtccgggtaaacccgg

SEQ ID NO: 29732 - DNA, 788 bp, Homo sapiens
  misc_feature: GYAE6OF01ET8D7.1.49.E05.1.454.CMB.1.raw
  modified_base (467)..(467): a, c, t, g, unknown or other
  misc_feature (467)..(467): n is a, c, g, or t
  modified_base (476)..(476): a, c, t, g, unknown or other
  misc_feature (476)..(476): n is a, c, g, or t
tcagacgagtgcgtcacgaccggtgctcgattttagagcgactagcaacaccaaggtggaacccaaaaaaccacacccctccttgggagaactcccctagatcacagctcctcaccatggacgggacctggagcatccttttctggtggcagcagcaacgaggtcgcccactcccgaggttcaccgttggtgcagtcgtaggagtctggacgctgacaggaacggccggtcggggccctgaggttcgagttcggtctccgtggactaggtcgtcttcgttacggttacttactttccttttaccgaaccgtacggtattacggtagtttggttaggacgaccggacccggtaccccgggaggtcgggtcgtgtagggtacggtagtagggtagtcggtacgtccgacggttaccgtaaacgtaaacgtaacgagtaggtagtaggaagtaaggtacgtcggagacgngagtaccgntacgacgtcgaccgacgacgacgtactaccgacgtaacgtaccgacgtacgtaactacggtaacgtacgggttaccggaggtaccgtacgtaacgtaacgtacgttaacggtaccggaaaccgtacccggtaacccgggtttaaccttaccggtttaaaccgtttaacggcggtaaccgggtacggtaaccggttagttaagttccgtttaacggtacccgttacgggtttaccgtccccgggttaagggttacccgttaaccggtaaccggttacccggggtttaggtccccggggttgggtaacccgggg

SEQ ID NO: 29733 - DNA, 871 bp, Homo sapiens
  misc_feature: GYAE6OF01BHI9H.1.49.E05.1.454.CMB.1.raw
  modified_base (766)..(766): a, c, t, g, unknown or other
  misc_feature (766)..(766): n is a, c, g, or t
tcagacgagtgcgtcacgaccggtgctcgatttagagcgactagcaacacacaaaggggacccaaaaaccacacccctccttgggagaatcccctagatcgacagctcctcaccatggacgggacctggagcatcctttcttggtggcagcagcaacaggtcgcccactcccaggttcacctggtgcagtcctggagctgagctgcagagccgtgggcctgagtcgatcggtctccgtgcgtagtcgtcttcgtacggttactacgtttcccttttacccgtaccgtttaaccggttagttacgttaacggttttgggttaggtaaccggtaaccggtacccgggggtacccccccgggaagggtacgggggggttacccgtttagggtagggttagggtaggttacggggtaggtacgggtaacgtaccgtaacccggttaacccggtttaacccggtaaaacgtaaaacccgaagggtaccggtaaggttacgggtaacggtaacggttaaaccggttacccgggaaggggttaaccgaaggtaacggttaccgaacggttacgtaacccgtacccggtaacccggtaacggtaaccccgacgtaacccgtaccgtaaccggtaacgtaccgaaaccgtcccgtaacgtaacgtagggtaaccgtaaggaccggataccgtacgaatacgttaccggccggtaaccgaccggtccggaacccttacgttaaccgttccggtacggaccggacggtaaccggttnttaaacgtttcgtacgtaccgttaaccggttccgggttaaccgttcgggtaacccgtttaccggaaaccccggttaggtccggggttcggttcggggaacccggg

SEQ ID NO: 29734 - DNA, 997 bp, Homo sapiens
  misc_feature: GYAE6OF01CC1WO.1.49.E05.1.454.CMB.1.raw
  modified_base (161)..(161): a, c, t, g, unknown or other
  misc_feature (161)..(161): n is a, c, g, or t
tcagacgagtgcgtcacgaccggtgctcgatttagagcgactagcaacacacaaaggggacccaaaaaccacacccctccttgggagaactcccctagatcacagctcctcaccatgggacgggacctggagcattccttttcttggtggcagcagcaacnggtcgcccactcccaggttcaccgtggtgcagtctggagcctgagctagccgaagaacggccgtcggggcctacgagtgatcggtcctcgtgctagtcgtcttcgtaggtactcgtttcctttaccgaccgttacgtataggttaagtttcgggttaggaacgtaccggacccggggtacccccggtaagggaccgggggttcggttacggtaggggtaggttacgggtcggggtaacgttacggtaaccgttaccggtaacccggtaccccggtttaaaaccggggtaaaaaccttaaaaccggtagggttaaaccggttaaggttaaacggggaagttaaaccgggtaaacccggtttaccgggaacgggtacgtaacgtacggttaccggaacctttacggaaccgtacccggtaacccgggtaccggaaacccgttacgaacccgtaaccggtaaccggttaacgggtaaaccccctacgggttaaacccctaagggttaaccggtaacggtaccgggtttaacgggaaccgggtacccgtacccgtaacgtacgggtaaaccgttcccgggttaaccggaaacccggttaacccggtcccggtttaaaccccgttaaacggtttttaacccggacccgggttacggtaacccgggggtaacgtaaacggttttaaccgggttaacgttttacccggaaacccgggttttaacccggttcgggttaccggttttaccccgggtacccgggttttaaccccgggtaaacccgttaaacccccgggttaggggtttccccgggtttaaggggtcccggttaaacccccgggggg

SEQ ID NO: 29735 - DNA, 683 bp, Homo sapiens
  misc_feature: GYAE6OF01BB3S0.1.49.E05.1.454.CMB.1.raw
  modified_base (156)..(156): a, c, t, g, unknown or other
  misc_feature (156)..(156): n is a, c, g, or t
  modified_base (242)..(242): a, c, t, g, unknown or other
  misc_feature (242)..(242): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttctggtggcagcagcaacnggtgcccactcccaggttcacctggtgcagtctggagctgagctgcagaacgccgtaggggcctcagtgatggtctccgtgcagtncttcgtggtactcttcttaccgtacgttacggtatagtagttggtagacgaccgaccgggccccggaggacgggtcgtggaggtaggaggtagggtagtacggtacgtacgtaccggtacccgtaaacggtaaaactaaacgtaggtaagtagtagggtaaacgtaacggtaacggtacggacgggtacgaacggtacgtactacgtacgtacgtaccgaccggacgtaccgaccgtaccgtaccgaacgtacgtaccgaccgtaccgtaacgtagtacggtaacgacggtacggaccgtaccgtacgacgtacgtcgtaacgaccgaccgaccgtaccgttacttacgtacgtaggacgtagtacgtagtacgttacgtcgtacgtacggtccggtacgtcgttacggtaccgtaacgtaccgtcggttggtcgggtacg

SEQ ID NO: 29736 - DNA, 900 bp, Homo sapiens
  misc_feature: GYAE6OF01EP3VU.1.49.E05.1.454.CMB.1.raw
tcagacgagtgcgtcacgaccggtgctcgatttagagcgactagcaacacacaaaggggacccaaaaaccacacccctccttgggagaatccctagatcacagctcctcaccatggacgggacctggagcattccttttcttgggtggcagcagcaacgaggtcgcccactcccaggttcaccgtggtgcagtcgtggagctgacgctgcaaggtacgccggtcggggcctacgaggtgtagttcggtccttccgtcgcgtggtcgtccgtttcgtcgggtttaacttactttacccttttacccgtaaccgtttaaccgggttagttacggttacgttttacggggttagaacggtacccggaccccggggacccccggggtaaggggtcgggggttaccggttaggggtacggggttaggggtaaggttaggggtacgggttacgggtaaccgttccgtaacccggtaaccccggtttaaaaccggaaaaccgttaaaaacggtaaacggtaaagggtaacggtaaggggtaaacgggtaaacgggttaaccgggttaccggaacggggtaacgtacgggttaacgtaccgtacgtacccgtaaccgtaccgggaacccgggaccgtaaccgtaacccttaccggtaacccgggtaacggaaccgttaccgaaccggttaacccgtaagtaacggttacgggtaaacggcgggtaacgtaccggtccctaggaacgttccgtacggtaaccggaaccgacccggtaacggttaccttacgttaaccgtacggccggaacgtaccggtaaaggtccttaaagtttcggacggtacccttcggtcggttccggtaccgtacgttacgtaaccggtccgtttggtcggtccgggtaaccgg

SEQ ID NO: 29737 - DNA, 942 bp, Homo sapiens
  misc_feature: GYAE6OF01EIUDQ.1.49.E05.1.454.CMB.1.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (635)..(635): a, c, t, g, unknown or other
  misc_feature (635)..(635): n is a, c, g, or t
tcagacgagtgcgtcacgaccggtgctcgatttagagcgactagcaacacacaaagggacccaaaaaccacacccctccttgggagaactcccctagatcacagctcctcaccatgggacgggacctggagctattccttttcttggtggcagcgagcaacgaggtcgccctactcccgaggttcaccgtggtncagtctgganctgagctgcaggacgccgtgggcctcgaggtcgagttcggtcctccgtgctagtcgtctttcgtacggttactacgttcctttaccgacgttaggtactagtagttggtacggacgtaccgccgggtccccggaggtacggggtcttagggtacgggtaggtaggtacggtagtacgggtacgttccgtaaccggtaacccggttaaaacggtaaaaccgtaaacgtaaggtaacgtaaggtacgggtaaggtaaacgttaacgggttacgaacgggtaactaacggtacgtaaccgtacgtacgaaccgttacccggaaccgtacgggtaaccaacgtccgtaaacggaccgtaaacgtaaccgtaaccgtaaccgttaaaggtaaccggtaacggtaaacggtacggaacggtacccgtacccggtaanaaacccgggttacgttaacccggtacccggtaaaccgggtacccggtaaacccccgggtttaaccttaaacccggtttacgggtttaaaccgtcccgggggtaaccgttaaacggggtaaaccggtttaaaacggttaccggtttttaaaaccggtcccgggtttaaacccgggttaaccgggtttcccccggggtttaccggttacccggggttaaaccccgggtttaaaccccggtttaaaccccggggtaccggttttaccgggggttttaacccgggaacccggggggtttaaacccccgggg

SEQ ID NO: 29738 - DNA, 791 bp, Homo sapiens
  misc_feature: GYAE6OF01EVUCH.1.49.E05.1.454.CMB.1.raw
  modified_base (164)..(164): a, c, t, g, unknown or other
  misc_feature (164)..(164): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcattccttttcgttggtggcagcagcaacaggtcncccacctccccgaggtttccacctggtgcagtctggagctagagctgacaaggaacgtcccggtcggggacctcgtaggtggagttcggttcctcccgtaggcctaggttcggttaccttttcggttggtttaacctacttttccttttaccccgtaaccgttaacggttattagtaagtttggttagaacggtaccgacccggggcccccggggtaagggtacgggggtcgttagggtaggttagggacggttaggggaagttcgggtacttacgtaccggtaaccccgtttaaacgggtaaaactaaaaacggtaaggtaaggttaagtaggggaaggtaaacggtaacggttccgggaagggtacgtaaggtacgtactaatacgtacctaccggaccggacggacaaccgtaccacggtaacgtacgtacgaaccgttacaagtacgtacggaacgacggtacggacgccgtagactacgtacgtacggaccgtaacgacggtacttaaccgttatccgtcgaacgacgtacgtaacgttagtttactcgtacgtacggttggtccgttacggtaccgttaaccggtacccggtaggtttcggttaccgggtcgggtacccgg

SEQ ID NO: 29739 - DNA, 750 bp, Homo sapiens
  misc_feature: GYAE6OF01BD5MX.1.49.E05.1.454.CMB.1.raw
  modified_base (629)..(629): a, c, t, g, unknown or other
  misc_feature (629)..(629): n is a, c, g, or t
tcagacgagtgcgtcacgaccggtgctcgatttagagcgactagcaacaccaaggtggacccaaaaaccacacccctccttgggagaactcccctagatcacagctcctcaccatgggacgggacctggagcattccttttcttgggtggcagcagcaacgaggtcgacccactcccaggttccaccgtggtgcgagtctggagctgagtctggcagacgtccgtcgggcctagagtgagtcggtcctccgtgcgagtgtcttcgttagtactatttccttacctacgttacgtacgtagtaagttggtacgacgtacgaccgggtaccccgggaggtgggtacgtggtaggtggtaggtcggtagtaggactacgacgtaccgtaaacggtaaactaaaacgaggtaagtaggtaagagtaaggtacggttacggacggtacgagtaacgtactagtaccgaacgtaccgaccggacggacctaacgtaccgaaccgtacggtaaactaaccgtaaccgtaaccctaaaggtacgtaacgggtaacggtacgggaaacgtaccggttccaacggtactaacggtacgaaccgtacccgacggtaacccgtattaaccttaggttaccncggaccggaagtaagtaccgttaattcgggtaccttacgggcggtttaccccggaggtttacggaaccgtttaacggtaccccggtaccgttaacggtttcggggccggttaacccggggg

SEQ ID NO: 29740 - DNA, 890 bp, Homo sapiens
  misc_feature: GYAE6OF01A1OJ3.1.49.E05.1.454.CMB.1.raw
tcagacgagtgcgtcacgaccggtgctcgatttagagcgactagcaacacacaaaggggaccaaaaccacaccctcctcgggagaactccctagatcacagctcctcaccatggacgggacctggacgcatctttctggtggcagcagcaacaggtcgcccacctccgaggttcaccgtggtcgcacgtcgtggacgtcgtggacgcgtgcgaacggaacggtcccgtcggggcctcgtaggtgtacgtggtcctccgtcgaccgtaggtcgtcctttacgtgggttaaccttcgtttaccgtttaccgtaaccggttacggtagttacggttaacggtttcgggtacgtaccggaccgggtacccgggtaccccggggtaggggtaccgggtcggttacgggtacgggttacgggtacgggtacggggtaacggtacggtaacggttaccggtaaccggttaaacccgggttaaaccggtaaaaccggtaaacggtaacgggttaacggttaaacggtacgggaaacggtaaacgggttaacggtaccgggtaacgggtaacgtaacggtacgtacgtaacgtaccgtaccggtaaccggtaccggaaccgtacgtaaccgtaacggtaacccggtaacggtaaccgtaccgtaccgttaaccgtaacggtaacggttacgggaaccgtacgggtaacgtacccgtacgtaacgtacgtaccgtaccggtacggtaaacccggaccggtaaccgtaaccgttacgttaacgtaccggcgtaaccgggtaacgtacggtaacgttacgttacggtccgtacggcgttaccggtaccgtacccggttacgtacccggtaacggtacggttcggttccggtacggtaccggg

SEQ ID NO: 29741 - DNA, 810 bp, Homo sapiens
  misc_feature: GYAE6OF01E5S7M.1.49.E05.1.454.CMB.1.raw
tcagacgagtgcgtcacgaccggtgctcgatttagagcgactagcaacacacaaaggggacccaaaaaaccacacccctcctgggagaatcccctagatcacagctcctcaccatgggacgggacctggagctactccttttcttggtggcagcagcaacgaggtcgcccacctccctacggttcaccgtgggtgccagtcgtggagctgagctggacaggaacggtccgtcggggcctcgacgtgtacgttcggtcctccgtgccgtaggtcgtcttgtacggttacctacttccgttaccgacgttacgtagtagtagttcggtacgacggaccggaccgggtaccggtagggtcggggtcgttaggaggtaggtacggtagggtaggtcggtaccgtacgtaccggtaaccgttaaacggaaaacgtaacggtaggtaacgtaggacggtaacggtaacggtacggtacggaagggacgagtaacgtacgtacgtaaccgtaccgtaacccggaccggaacgtaccgtaaccgacgtaacccgtaacggtaaccgtaacccgaaccgtacgtaacgtaacggtaacggtaacggtacggacggtaccgtaccgtacgtaacgtcgtacggacggtaaccgtaccggtacccggttaaccttaaccgttacgtaccggtacgtacggtaacggtacggtaacgttacggttacgtaccgtacggttaccggttccggtccgttaccggttaaccgttaacccgggttacccggtaccgggtttacggtccggggtccgggtaccgggg

SEQ ID NO: 29742 - DNA, 768 bp, Homo sapiens
  misc_feature: GYAE6OF01CYGUU.1.49.E05.1.454.CMB.1.raw
  modified_base (244)..(244): a, c, t, g, unknown or other
  misc_feature (244)..(244): n is a, c, g, or t
tcagacgagtgcgtcacgaccggtgctcgatttagagcgactagcaacaccaaggtggaccaaaacacaccctccttgggagaatcccctagatcacagctcctcaccatggacgggacctggagcatccttttcttggtggcagcagcaacgaggtcgcccactcccgaggttcaccgtggtgcgagtcgtggagcgtgacgctgcagaacgccgtcgggcctcgagtgagtcggtcctccgngtcgagttcgtacttcgttgtactactttcccgttaccgtacgtagtagtagttagttggtacgacggaccggaccgggacccggtagggcgggtcgttaggaggtcggtaggcggtagtcggtacgtaccgtaccggtaaccgttaaccgaaacgtaacgtaggacgtaggacggtaacggtaaggtaccgttacggacggtacgacgtacgtactacgtaccgactaccgaccggtaccgaaaccgtcgaccgtaacaacggtacccgtaacgtaaccgaccgtaacgtaggtacgaacggtacggacggtaccctagtacgacgtaacgtccgtaaacgaacccgtaaccggtacccgtaccgttaacgtttacgttacccggcgaaccggtacgtaaacgtacgtttaaaggttacgtccggaccgtttaaccggtttcggtacccggtttaaccgtaccggttaacccggttaaccgtacccgggttagggttccccgggggaggttaaacccccgggg

SEQ ID NO: 29743 - DNA, 697 bp, Homo sapiens
  misc_feature: GYAE6OF01C0KH8.1.49.E05.1.454.CMB.1.raw
  modified_base (159)..(159): a, c, t, g, unknown or other
  misc_feature (159)..(159): n is a, c, g, or t
  modified_base (187)..(187): a, c, t, g, unknown or other
  misc_feature (187)..(187): n is a, c, g, or t
  modified_base (476)..(476): a, c, t, g, unknown or other
  misc_feature (476)..(476): n is a, c, g, or t
tcagacgagtgcgtcacgaccggtgctcgatttagagcgactagcaacacacaaaggggacccaaaaccacacccctctgggagaatcccctagatcacagctcctcaccatggacgggacctggagcatccttttctggtgcagcagcaactaggtcncccactcccgaggttccaaccgtggtancctagtcgtaggagtctgagctgcagacgccgtcgggactcgagtcaagtcggtcctcgtcgctagtcgtactttcgtacgttacttacttcctttacctaccgttaaggtacttagtaagtttggtacgacgtacgaccggaccccgggtaggacggggtacttaggaggtgggtaggtagggtagtaggtacgtcgtaaccggtaccgtaaacggaaaccgtaaacgagtaagtaggtaggaacgtaaggtaacggttacggacgggacgtaaggacgtacgttaanccgtaacgtaccgaccggaccgggaacctaacggtacttacccgaaggtaaccgactacggtaactaacgagtaacgtacgaggtacgacgtacctacgactacgttagacgacgaacgacgtactacttacgtactacgtacgacgtaacgtagttacgtatacgtacgtacggtctaccggtacgacttaacggactacgttacgtcgtcggtaacggg

SEQ ID NO: 29744 - DNA, 748 bp, Homo sapiens
  misc_feature: GYAE6OF01E38MF.1.49.E05.1.454.CMB.1.raw
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggcagctagcaacgaggtcgcccactcccgaggttccaccgtggtcgctagtcgtgggagcgtgagctgcgaagacgccgtgggcctacgaggtgtatcggtcctccgtgcgtagtcgtactttcgtcggttacctacgttccttttacccaaccgttacggttacttaggtaagtttggtacggacgaccggtaccggggtacccccggaggggtacgggggtccgttaggtacgggtacggtaggttggggtagttcgggtaactaccggtaacccggttaccccggtttaaaacggtaaaacgtaaaaccggaaggttaaccggttaagtacggggaaacggtaggtaaaccggttaccggaaagggtacctaaaggacgttaacagtaccgtaaccgtcggacccggtaacgacgaccgtaaccgtaccgacgtaacgtacgaacgtacctaacgacgtaacgtagtacggacgtaccgacctagacgtactacgagaaccgacgccgtaactacttatacgacgcgagtacgtactattcggtctacgtacgtcggacgtacgggtacctaacggtacccgagttcgtcggcggtacgg

SEQ ID NO: 29745 - DNA, 821 bp, Homo sapiens
  misc_feature: GYAE6OF01EX61M.1.49.E05.1.454.CMB.1.raw
  modified_base (86)..(86): a, c, t, g, unknown or other
  misc_feature (86)..(86): n is a, c, g, or t
  modified_base (164)..(164): a, c, t, g, unknown or other
  misc_feature (164)..(164): n is a, c, g, or t
  modified_base (212)..(212): a, c, t, g, unknown or other
  misc_feature (212)..(212): n is a, c, g, or t
tcagacgagtgcgtcacgaccggtgctcgatttagagcgactagcaacacacaaaggggacccaaaaaccacacccctcttggganaatccccagatcacagctcctcaccagtgggacgggacctggagctattccttttcttggtggcagcagcaacaggtncccactccctaggttccaccgtggtgcctagtctggagctgagtctgnagagccgtgggccttgagtgtagtcggtcctcctgcgtagtcggtacttttcgtaggttacctatttccttttacccgaccgttacggttattagtagtttaggttagacggtacgtaccgggcccccggagggtacgggtcgttaggtaggtagggtaggttagggacgttcggtagttacccgtaccggttaacccggttaaaccggtaaaacgtaaaaccgttaacggtaaggtaacggttagggaaaggtaacgggttaaacgttaccgggaacgggtaacgtaacggtaaggttaccgaagttaccgtaacgttacccggaacccggtaacccggtaaccgtaacccggtaaccctaaccgaacggtaaccgtaaccgaccgttaaccgactaacgggttaacgaaccgggtacgggtaagtacccgtaaccgtactaacggtacgttaaccgttacggaaccttaacccggaacccgtaccttaacgggtttaccttaccggcgaaccgtggaacgttattaacgttcggttacgtaccgttcggtccggtaccgttcgttaccgtacgttaccgtacggttacggttggacggttacccggg

SEQ ID NO: 29746 - DNA, 865 bp, Homo sapiens
  misc_feature: GYAE6OF01APK7O.1.49.E05.1.454.CMB.1.raw
  modified_base (441)..(441): a, c, t, g, unknown or other
  misc_feature (441)..(441): n is a, c, g, or t
  modified_base (743)..(743): a, c, t, g, unknown or other
  misc_feature (743)..(743): n is a, c, g, or t
tcagacgagtgcgtcacgaccggtgctcgatttagagcgactagcaacacaacaaaggggacccaaaaaccacacccctcttgggagaactccctagatcacagcctcctcaccagtcgggaccgggacctggagctacttccttttcgttggtggcagcagacaacgaggtccgaccctacctcccgtaggttccaccgtggtcgactacgtcgtagggactcgtaggacggtctgacgaacggaaccggtccggtcgggtaccttacgaggttggtacgttcggttaccgttcgccgtacgtcggttcttcgttccgttaggtttaccttactttccccgtttacctacggttaaacgttgttagtaacggtttcggtagacggtaccggtaccggggacccggtaggtcgggttcggtaacggtaggttggtacgggnggtagtacgtacgtacgtaaccgtaaccggtaaacgttaaaacgaagtaacggtagtaacggaagtaacggtaggtaacgtacggagggagtaacgtacgtaatcgttaaccggtacgaccggtacccggtaacgaaactacccgtaaccgtaacgtaaaccgtacggaaccctccgttaaacggtaaccgttaacgtaacgttaacgggcctaaccggggtacttaacccgtaacgtacggtaaacgtccggtaaaccgtaacggtaccccgttaacgtttacctaccgtttaaacgggtnaaacccgggtcggtaagtaaggtacctttaccggtaaggtcccttagggtcgttccccgggtcttacccggtacttaacccggttacgggttacccgtggtttacggggcccggtaacgggg

SEQ ID NO: 29747 - DNA, 952 bp, Homo sapiens
  misc_feature: GYAE6OF01AUP5X.1.49.E05.1.454.CMB.1.raw
tcagacgagtgcgtcacgaccggtgctcgatttagagcgactagcaacacgacaaaggggacccaaaaaccacacccctccttgggagaatcccctagatcacaggctcctcaccatggacgggacctggagcatccttttctggtggcagcagcaacaggtgcccactcccaggttcacctcggtgcagtctggagctgtagctgcagaagccgtggggcctcagtgactggtctccgtgtcgagttcgcttcgtcggttacacttcttttaccctaccgtacggttataggaatttcggtagacgtaccgacgggacccccccgggtaaggtaggggggtcttttacgggtaggttacgggagggttacggggtaagtcgggtaacgtacccgggtaacggtaacccccggttttaaacggggaaaaccccgttaaaaaagtacgggtaaacggtaaacgtgggggtaacggtaaaggtaaccgggtttacccgaacggggtaccgacgggtaacgttaccgaagttaccagtacccgaaccggaccgggaaccctaacacggtaaccccaacgggtaaccgtacccgtaaacgggtaccccgtaaacggtaaggttaccggggaaaacctttcggggaaaggggtaaaccgtccccgttaaacgggtaacccgttaaccggtacggttaaaccgggtaacccgggttacccgaaacccgggttccgtttaaaacccgtttaaccgttacccggggttaacgggcccggttaaacgggaaccggtttaaacggtaaaacccggttttttaagcccgggggtttaaacccttcccgggtttaacggggttaccccggggttacccggtttaaaccccggttaaaccgggtttaaaaccccccttacggggttcttttaaacccgggggggtcgggggtttaaacccccggg

SEQ ID NO: 29748 - DNA, 734 bp, Homo sapiens
  misc_feature: GYAE6OF01DZ1LV.1.49.E05.1.454.CMB.1.raw
tcagacgagtgcgtcacgaccggtgctcgatttagagcgactagcaacacacaaaggggacccaaaaccacacccctccttgggagaatcccctagatcacagctcctcaccatggacgggacctggagcattccttttcttggtggcagcagcaacaggtcgcccactcccaggttccacctggtgcagtctggagctgagctgcagacgccgtgggcctacgagtgagtggtcctccgtagcgtagtcgtaccttcgtacggttactactttaccttttacccgtacccgttaggttacgtagttaacgtttggtagacggaccggacccgggtacccccgggaggtacgggggtccgttaggtagggtgggaggtacggggtagttacggactccgtaaccggtacccgttaaacggtaaactaaaacgaggtaacgttaggtagggaacgtaacggtaccggttaccgggacgggtactaggacgtctaacgtacgaacgttaccggaacccggacggtaaccacccgtaacgtaccgaacggtagttacccaacggtaccctaaggaccgtaagggtacgttagggaacgtaccgaccgtagacgtataccggtaacggaccgtaacccggcggttaccttacgttacgtacgtcggacgtacaggtacttaagttcgtacgcttacggtcgttcgtcgtactacggtacctagtcgtggccgtacggg

SEQ ID NO: 29749 - DNA, 725 bp, Homo sapiens
  misc_feature: GYAE6OF01DMR5M.1.49.E05.1.454.CMB.1.raw
  modified_base (169)..(169): a, c, t, g, unknown or other
  misc_feature (169)..(169): n is a, c, g, or t
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (482)..(482): a, c, t, g, unknown or other
  misc_feature (482)..(482): n is a, c, g, or t
tcagacgagtgcgtcacgaccggtgctcgatttagagcgactagcaacacacaaaggggacccaaaaaccacacccctcctgggagaactcccctagactcacagctcctcaccatgggacgggacctggagcatccttttcgttggtggcagcagaccaacagggtcncccgactcccgaggttccactggtgcngtctgganctgagctgcaggacgccgtcgggctcgagtcgagtcgtctcctcgctaggttcgtccgttagttcggttaactactttcctttaccctaaccggttacggttagtaagtttacggtttaggggttacgaacggaccggaccggggtcccccgggtaaggtacgggggtcgtttagggtagggtgggacggtagggtacgtacgggcgtacgtacccggtaccgtaaaccggaaaactaaacgaggtaggtacgtagggaagtaacggtacgttacggnggtagtacgagtcaagtccagtccgacggtacgaaccgtacacgtacgacgtaacgaccgtacgacctaaggtacgtacgggagtcggacgtacaccgtagaacgtacgtcgtaacgaccgtacgacctaccttacgttacgttaccgtgcggtaacgacgtaagttacgttacgtccgtaccgtcggtccgttaccgtcggttaacgtccgtaaccggcggtttacgtgggaccgttacggg

SEQ ID NO: 29750 - DNA, 644 bp, Homo sapiens
  misc_feature: GYAE6OF01BEPXJ.1.49.E05.1.454.CMB.1.raw
  modified_base (257)..(257): a, c, t, g, unknown or other
  misc_feature (257)..(257): n is a, c, g, or t
  modified_base (624)..(624): a, c, t, g, unknown or other
  misc_feature (624)..(624): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccgttttcttggtggcagcagcaacaggtgcccactcccaggttcacctggtgcagtctggagctgagctgcaagaacgccgtggggcctacagtgatggtctcctgcagtgcttcgtgttacnttcctttccaccgttacggtatgtaatttggtgagacgacggccccggaggagggtcttggagtggtagtgggagtggagtcgacggtaccgtaacggaaactaaacgagtagtacgtaggaaggaaggtacggttccggaggacaggtagtcacgtacgacgtaccgaccggacgaacgacctaacgtacccgaacggtaaccgtaacgtaccgtacctaacgtaacggtacgtaaacgtagggaccggtaccgtaccgtacgtaagacgtcgtaacgaacgacccgacgtacctaagtttacgacgtagccgagagtattacgttacgcgtctagtccggtaccgtaggtaccgtacgtaaccgngttcctgggccggtaccggg

SEQ ID NO: 29751 - DNA, 748 bp, Homo sapiens
  misc_feature: GYAE6OF01EX3IB.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagacgccgtggggcctcgagtgagtggtctcctgctagtcgtcttcgtggttacattccttttcccaccgttacggtattagtaagtttgggttagaacgtaccgaccgggacccccggtagggtacgggggtcgttgggtacggtgggaggtggggtagttgggtacgtcgtaaccggtacccgttaaacggaaaaccgtaaaaacgtaggtaacggttaagtagggtaacggaaggtaaccggttaccggaacggggtaacgtaacgggtaacggttacgtaacgtacgtaaacgttcccggaaccgggtaccgggaaccaaccgtaaccgtacccgaacgtaacgttaacgacgtaaccctaacgacgtacggacgtaggacggtaccgcgtaacgagtacgtcgacgaaccgaccggaccgtaccttaacgtttactacgtcggacggtacggagtagtagttacgtcgaccgtcggttacggttccggtcggtaccttacgggtaccctaccggttcggttacgggtcgggtacccggg

SEQ ID NO: 29752 - DNA, 506 bp, Homo sapiens
  misc_feature: GYAE6OF02JAWBC.1.49.E05.1.454.CMB.1.raw
  modified_base (462)..(462): a, c, t, g, unknown or other
  misc_feature (462)..(462): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttgagtggatgggatggatcagcccttacggactaaaacagagtatggagagaagttccagggcagagtcatcatcaccgcggacacatccacgagtacagcctacatggaactgaggagcctcagatctgacgacacggccacttattactgcgcgagngattatgcactggtcctggctgtaaccacgcttggtgggtaccg

SEQ ID NO: 29753 - DNA, 726 bp, Homo sapiens
  misc_feature: GYAE6OF02INPD3.1.49.E05.1.454.CMB.1.raw
tcagacgagtgcgtcacgaccggtgctcgattttagagcgactagctaacgacacgaaaggggacccgaaaaaccacccaccccctccgtttcgggaggaattcccctagattcgacagctcctcaccatggacggacctggagcatccttttctggtggtcgagcagcaacgtacggttgtcccacttcccttaaggttcacctggtgcagtctggagctggagctgcggagagtccgtcgggcctcagggtcgatggtcctcctcgcgagtcgcttcctggttacgattccttttaccctaccttaacggttatttagtaatttggttagagacctacgggtccccccgggaggacggggcttcggtacggtagggagtgggatagggatcgacgtcccgtttaagggaaactaaaacgagtaagtagtacggaagaagtaagttaccgaagggtactaggaacgtacagttacgtaagtaccggaccgacggaacctacgaactaccgaacggtaacgtaaccgaacgtacccttaacgaacgtacggaaacctggaagggtactacccgttacaaaggtagtcctaggaaccgtacgaaccggtcctaacgtttagtaccgtagacccgggcgtaaggtacgtaagttttacgtggaccgtacggtcgggtaccgtcggacgttacgggtaacccgtagggttccgttggggacggtaccgg

SEQ ID NO: 29754 - DNA, 511 bp, Homo sapiens
  misc_feature: GYAE6OF02JBYCZ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttgagtggatgggatggatcagcccttacggaactaaaacagagtatggagagaagttcagggcagagtcatcatcaccgcggacacatccacgagtacagcctacatggaactgaggagcctcagatctgacgacacggccacttattactgcgcgagagattattgctacgtggtcctggctgtaacccaggtcttggtggtccg

SEQ ID NO: 29755 - DNA, 505 bp, Homo sapiens
  misc_feature: GYAE6OF02HLSKO.1.49.E05.1.454.CMB.1.raw
  modified_base (410)..(410): a, c, t, g, unknown or other
  misc_feature (410)..(410): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccagggcagagtcatcatcaccgcggacacatccacgagtacagcctanatggaactgaggagcctcagatctgacgacacggccacttattactgcgcgagagattagtgctactgtcctggctgtaaccacgcttgtggtcg

SEQ ID NO: 29756 - DNA, 545 bp, Homo sapiens
  misc_feature: GYAE6OF02FYVXT.1.49.E05.1.454.CMB.1.raw
  modified_base (443)..(443): a, c, t, g, unknown or other
  misc_feature (443)..(443): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggttacattcttttccacctacggtatgtaattggttgagacacggcccccggaggacggggcttggaggtggagtgggatggatcgagtcccgttacggaactaaaacagagtatggagagaagttcgaggcagagtcatcatcaccgcggacacatccacgagtacagcctacatacggaactgaggacgcctanagtatcgtagacgacgaccggcctacttattactgcgcgagagtattagtcgactacgtcggttccgtggcgttacgtaacccacggtcgttggcggtaccg

SEQ ID NO: 29757 - DNA, 512 bp, Homo sapiens
  misc_feature: GYAE6OF02FW7Y0.1.49.E05.1.454.CMB.1.raw
  modified_base (437)..(437): a, c, t, g, unknown or other
  misc_feature (437)..(437): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggagtggatgggatggatcagcccttacggaactaaaacagagtatggagagaagttccagggcagagtcatcatcaccgcggacacatccacgagtacagcctacatggaactgaggagcctacagatcngacgacacggcctacttattactgcgcgagagattagtgcacgtggtcctggctagtaaccagtcttggtggtcg

SEQ ID NO: 29758 - DNA, 647 bp, Homo sapiens
  misc_feature: GYAE6OF02JDT9G.1.49.E05.1.454.CMB.1.raw
  modified_base (385)..(385): a, c, t, g, unknown or other
  misc_feature (385)..(385): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatctttccactacggtatgaattggttgagacaggccccggagagggcttgagtggatgggatggatcagtccttacggaactaaaacagacgtagtggaagtagaacgttccgaggcagagtcgatcatcacgngacacatcacgagtacagactacagtacgaacgttgaagggacaccgtacgaacgtacgttaccgttacggaaaccgaaccgtaacccggggtacccttaaacgtttaaacgttttaaccggtacggtaaccgaacgggtaacgtaacgggttaactttaaacggtttcggaaccgttaaccggttacgggttacccgttacgggtaccgttaaccggttaaacccgtaaccggttcgtttacggggttcggggtaacccgg

SEQ ID NO: 29759 - DNA, 523 bp, Homo sapiens
  misc_feature: GYAE6OF02GZHC2.1.49.E05.1.454.CMB.1.raw
  modified_base (435)..(435): a, c, t, g, unknown or other
  misc_feature (435)..(435): n is a, c, g, or t
  modified_base (506)..(506): a, c, t, g, unknown or other
  misc_feature (506)..(506): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacaggcccccggagagggggcttggagtggatgggatggatcgagcccttacggaactaaaacgagagtatggagagaagttccagggcagagtcatcatcacgcgacacatccacgagtacagacctacatggaacttgacggagcctanagatcgtgacgacaccggacacttatactgcgcgagagattatgtactacgtggtcctggactcgtaaccncgtcttcggtggtaccg

SEQ ID NO: 29760 - DNA, 509 bp, Homo sapiens
  misc_feature: GYAE6OF02GO7SF.1.49.E05.1.454.CMB.1.raw
  modified_base (427)..(427): a, c, t, g, unknown or other
  misc_feature (427)..(427): n is a, c, g, or t
  modified_base (493)..(493): a, c, t, g, unknown or other
  misc_feature (493)..(493): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaacagagtatggagagaagttccagggcagagtcatcatcaccgcggacacatccacgagtacagcctacatggaactgaggagcctnagatctgacgacacggccacttatactgcgcgagagattagtgactactggtcctggctgtaaccncgtcttggtggtaccg

SEQ ID NO: 29761 - DNA, 520 bp, Homo sapiens
  misc_feature: GYAE6OF02GLJYH.1.49.E05.1.454.CMB.1.raw
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
  modified_base (513)..(513): a, c, t, g, unknown or other
  misc_feature (513)..(513): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccagggcagagtcatcatcaccgcggacacatccacgagtacagcctanatggaactgaggagcctanagatctgaccgacaccggcctaacttacttactgcgacgagagtattattgactacgtgtccgtggctcggtaaccacgcttgngggtccg

SEQ ID NO: 29762 - DNA, 507 bp, Homo sapiens
  misc_feature: GYAE6OF02GHOVF.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggactaaaacagagtatggagagaagttcagggcagagtcatcatcaccgcggacacatccacgagtacagcctacatggaactgaggagcctcagatctgacgacacggccacttatactgcgcgagagattagtgactacgtggtcctggctgtaaccacgcttggtggtacg

SEQ ID NO: 29763 - DNA, 514 bp, Homo sapiens
  misc_feature: GYAE6OF02GPELS.1.49.E05.1.454.CMB.1.raw
  modified_base (497)..(497): a, c, t, g, unknown or other
  misc_feature (497)..(497): n is a, c, g, or t
  modified_base (506)..(506): a, c, t, g, unknown or other
  misc_feature (506)..(506): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaacagagtatggagagaagttccagggcagagtcatcatcacgcggacacatccacgagtacagcctacatggaactgaggagcctcagatctgaccgacgacgcctacttattactgcgcgagagtattattgctacgtcggtcctggctgtaaccncgtcttggngggtaccg

SEQ ID NO: 29764 - DNA, 523 bp, Homo sapiens
  misc_feature: GYAE6OF02IS86Z.1.49.E05.1.454.CMB.1.raw
  modified_base (385)..(385): a, c, t, g, unknown or other
  misc_feature (385)..(385): n is a, c, g, or t
  modified_base (410)..(410): a, c, t, g, unknown or other
  misc_feature (410)..(410): n is a, c, g, or t
  modified_base (458)..(458): a, c, t, g, unknown or other
  misc_feature (458)..(458): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacaggcccccggagaggggcttgagtggatgggatggatcgagcccttaggaactaaacgagagtatggagagaagtccgaggcagagtcatcatcaccgngacacactccacgagtacagcctanagtggaactgaggacgcctcagatctgacgacacggccacttattacngcgcgagagtatttagtgactcgtcggtcctggtctacgtaacccgacgtcttcggtggtaccgg

SEQ ID NO: 29765 - DNA, 583 bp, Homo sapiens
  misc_feature: GYAE6OF02HNQNC.1.49.E05.1.454.CMB.1.raw
  modified_base (575)..(575): a, c, t, g, unknown or other
  misc_feature (575)..(575): n is a, c, g, or t
tcagacgagtgcgtcacgaccggtgctcgattttagagcgactagctaacgtacggacaaacggggacccaaaaacccacgacccctcccttgggagaattcccctagattcacagctcctcaccatggacgggacctggagcatccttttcttgggtggtcgagcagcaacgtaggtgcccactccctaaggttcacctggtgcagtctggagctgagctggcagaagcctggggcctcggacgtgatggtctcctgcagtgcttctggttactatcttttccaccttacggtactgaattggttgagacagggcccccggagaggggcttcggaggtgggatgggagtgggatcgagtccttaaggaactaaacgagaggtatggagagaagttcgagggcagagtcgagtcatcaccgcgacacataccgaacgacgtacagacctacgatcggaacttgaggacgacctagagtactctaggaacgacgacggccaacgtttactacgtgacgtacgagtacgtattacgtagctacgtgtccgtgctacgtaaccctcggtacgttcggnggtaccgg

SEQ ID NO: 29766 - DNA, 573 bp, Homo sapiens
  misc_feature: GYAE6OF02I93ZG.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttgagtggatgggatgggatcgagcccttaggaactaaaacagagtagtggagagaagttccagggcagagtcatcatcacgcgacacactccacgagtacacgcctacataggaactggaggacgccctacagtactcgtaggaccgaaccgaccgggaccctaactttaacttaccgtacggtccgacgagacgtaatttagtggacctacgttcggttcccttgggtccttacggtaacccaccggtctttcgggtagggtacccg

SEQ ID NO: 29767 - DNA, 533 bp, Homo sapiens
  misc_feature: GYAE6OF02JSK4R.1.49.E05.1.454.CMB.1.raw
  modified_base (227)..(227): a, c, t, g, unknown or other
  misc_feature (227)..(227): n is a, c, g, or t
  modified_base (417)..(417): a, c, t, g, unknown or other
  misc_feature (417)..(417): n is a, c, g, or t
  modified_base (438)..(438): a, c, t, g, unknown or other
  misc_feature (438)..(438): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgagtnggtctcctgcagtgcttctggttactatctttccactacgtatgattggtgagacgaggcccggagagggcgttgagtggagtggagtggagtcgagaccgttaacgaacgtaaacagagtagtaggagagaagtacgaggacgagagtacatacactacacgacgacacatacacgagacagactacanagaacgagagagactacaganacgtagacgacgacgactacttatacgtacgacgacgagagtagttatagtacgtacgtacgtcgtacgtacgtacgtacgtacgtcgttgtcgg

SEQ ID NO: 29768 - DNA, 526 bp, Homo sapiens
  misc_feature: GYAE6OF02JJKVK.1.49.E05.1.454.CMB.1.raw
  modified_base (405)..(405): a, c, t, g, unknown or other
  misc_feature (405)..(405): n is a, c, g, or t
tcagacgagtgcgtcacgaccggtgctcgatttagagcgactagcaacacacaaagggacccaaaaccaacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttaggaactaaacagagtatggagagaagttcagggcagagtcatcatcacgcggacacatccacgagtacagcctanatacggaacttggacggagcctcagatcgtagacgacgacggccaactttattactggcgcgagagtattagttgactacgtggtcctggccttacggtaaccacggtcttggtgggtacc

SEQ ID NO: 29769 - DNA, 552 bp, Homo sapiens
  misc_feature: GYAE6OF02HKZCP.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtggagtgggatggatcgagcccttacggaactaaaacagagtatggagagaagttcagggcagagtcatcatcacgacggacacgactaccgacgagtacagacctacgataggaacttggaaggacgcctagagactcgtagaccgaccgacgggacctaacttattacgtgcgacgagagtattagttgctacgtcggtaccgtggtccgttacggtaacccacggtcttggtggtaccgg

SEQ ID NO: 29770 - DNA, 517 bp, Homo sapiens
  misc_feature: GYAE6OF02GAAZ3.1.49.E05.1.454.CMB.1.raw
  modified_base (343)..(343): a, c, t, g, unknown or other
  misc_feature (343)..(343): n is a, c, g, or t
  modified_base (458)..(458): a, c, t, g, unknown or other
  misc_feature (458)..(458): n is a, c, g, or t
  modified_base (500)..(500): a, c, t, g, unknown or other
  misc_feature (500)..(500): n is a, c, g, or t
tcagacgagtgcgtcacgaccggtgctcgatttagagcgactagcgaacgacacaaaggggacccaaaaaccacacccctccttgggagaatcccccagatcacagctcctcaccatggacgggacctggagcatcctttcttggtggcagcagcaacaggtgcccatcccaggttcacctggtgcagtctggagctgagctgcagaagcctggggcctcagtgatggtctcctgcagtgcttctggttacatctttccacctacggtatcgaattggttgagacaggcccccggagaggggcttgagtggagtgggatggatcagccttacggaactaaacngagtatggagagaagtcgagggcagagtcatcatccacgcgacacatccgacgagtacagacctacagtggaactgaggagcctgagatcgtgacgacacggtccacgttatacngcgacgagagattagtgacacgtggtcctggcttagtaaccncgtcttcggcggtaccg

SEQ ID NO: 29771 - DNA, 520 bp, Homo sapiens
  misc_feature: GYAE6OF02G2034.1.49.E05.1.454.CMB.1.raw
  modified_base (430)..(430): a, c, t, g, unknown or other
  misc_feature (430)..(430): n is a, c, g, or t
  modified_base (513)..(513): a, c, t, g, unknown or other
  misc_feature (513)..(513): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttcagggcagagtcatcatcaccgcggacacataccagagtacagcctacatggaactgaggagcctaganatctgacgacaccggcctacttattactgacgcgagagattagttgctacgtggtcctggacttgtaacctacggtctttggnggtaccg

SEQ ID NO: 29772 - DNA, 602 bp, Homo sapiens
  misc_feature: GYAE6OF02J0Q5H.1.49.E05.1.454.CMB.1.raw
  modified_base (414)..(414): a, c, t, g, unknown or other
  misc_feature (414)..(414): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagtacaggcccccggagaggggcttgagtggatgggatggatcagcccttacggaactaaaacagagtactggagagaacgttccagggcagagtcatcatcacgcggacacactccacgagtacagacctanataggaacttcggaacggtagacccgtcgaacgacttacctgggaaccgaccgaaccggaccgtaactttaaccgttaaccgtacggcggaccggtaaggtacgagtttaacgttcggtcgaaccttcgggttacccttggtaccgttacggtaaacccctacggtaccctttggtacgggtacccgg

SEQ ID NO: 29773 - DNA, 517 bp, Homo sapiens
  misc_feature: GYAE6OF02G3ZBV.1.49.E05.1.454.CMB.1.raw
  modified_base (408)..(408): a, c, t, g, unknown or other
  misc_feature (408)..(408): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggagtggatgggatggatcagcccttacggaactaaaacagagtatggagagaagttcagggcagagtcatcatcacgcgacacatccacgagtacagcctanatggaactgaggagcctcagatctgaacgacgaccggccaacttattactgacgcgagagattagtgctacgtggtcctggctggtaaccacgtcgttcggtggtaccg

SEQ ID NO: 29774 - DNA, 530 bp, Homo sapiens
  misc_feature: GYAE6OF02HIFWO.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtggatgggatggatcagcccttacggaactaaacagagtatggagagaagttcaggacagagtcatcatcaccgcggacacatccacgagtacagcctacatgaactgaggacgcctacagatctgacgacacggcctacttatacgtgccgtacgagacgtattagtcgctacgtggtccgtggtcctacggtaacccacggtccgttggtcggtaccgg

SEQ ID NO: 29775 - DNA, 501 bp, Homo sapiens
  misc_feature: GYAE6OF02HLR6E.1.49.E05.1.454.CMB.1.raw
  modified_base (381)..(381): a, c, t, g, unknown or other
  misc_feature (381)..(381): n is a, c, g, or t
  modified_base (452)..(452): a, c, t, g, unknown or other
  misc_feature (452)..(452): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggagtgggatggatcagcccttacggaactaaacagagtatggagagagttcaggcagagtcatcatcaccgngacacatccacgagtacagcctacatggaactgagagcctcgagatctgacgacacggccacttatacgtncgcgagagattagtgcagtcgtcctggctcgtaccacgtctgtggtacg

SEQ ID NO: 29776 - DNA, 521 bp, Homo sapiens
  misc_feature: GYAE6OF02IIPV5.1.49.E05.1.454.CMB.1.raw
  modified_base (433)..(433): a, c, t, g, unknown or other
  misc_feature (433)..(433): n is a, c, g, or t
  modified_base (505)..(505): a, c, t, g, unknown or other
  misc_feature (505)..(505): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagtacaggccccccggagagggggcttggaggtggatggggatggatcgagcccttacggaactaaaacgagagtatggagagaagttccagggcagagtcatcatcaccgcggacacatccacgagtacagcctacatggaactgaggacncctacagatctgacgacacgccacttattactgcgcgagagatttagtgcacgtgtccgtggctgtaacccncgtcttgtgggtaccg

SEQ ID NO: 29777 - DNA, 605 bp, Homo sapiens
  misc_feature: GYAE6OF02JU4RR.1.49.E05.1.454.CMB.1.raw
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
  modified_base (529)..(529): a, c, t, g, unknown or other
  misc_feature (529)..(529): n is a, c, g, or t
tcagacgagtgcgtcacgaccggtgctcgatttagagcgactagcaacacacaaaggggacccaaaaaccacacccctccttgggagaatcccctagatcacagctcctcaccatggacggacctggagcatccttttcttggtggcagcagcaacaggtgcccactcccaggttcacctggtgcagtctggagctgagctgcagaagcctggggcctcagtgagttcngggtcnccgtggcagttgtcgtttactggttactactcttttaccgacttacggtattggaattggtagacggaccgagggccccgggtagagggcgttggagtggagtgggatggatcgtaagtaccttaacggaactaaacgagaggtagtaggaagtaggaaggtacgagggacagagtacagtacacgtcgaccgacgacacgagtaccgacgacgtacagactaagagtaggaacgtacgacgacgacgtacgagtacgtacgacgaccgacgacggtacctacgttacgtacgngacgacgtagtagtagttatcgacgtacgtcggtaccgtacggtacgtacgtaccgtacggtacgttacggtacgg

SEQ ID NO: 29778 - DNA, 543 bp, Homo sapiens
  misc_feature: GYAE6OF02G14ZF.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtggatgggatggatcagccgttacggaactaaacagagtagtggagagagttccagggcagagtcatcatcgaccgcggacacactccgacgagtaccagacctacatacggaactggaggacgccgtcagactctacgacgaccgaccggaccctacgttacttacgtcgcgacgagagtattagtgactacgtggtccgtggcttacgtaccgacgtcgttggtcggtaccg

SEQ ID NO: 29779 - DNA, 564 bp, Homo sapiens
  misc_feature: GYAE6OF02IMN1B.1.49.E05.1.454.CMB.1.raw
  modified_base (242)..(242): a, c, t, g, unknown or other
  misc_feature (242)..(242): n is a, c, g, or t
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
  modified_base (481)..(481): a, c, t, g, unknown or other
  misc_feature (481)..(481): n is a, c, g, or t
tcagacgagtgcgtcacgaccggtgctcgattttagagcgactagcgaacgacacaaaggggacccaaaaaccacacccctccttgggagaatcccccagatcacagctcctcaccatggacgggaccctggagcatcctttctggtggcagcagcaacaggtgcccactcccaggttccacctggtgcagtctggagctgagctgcagaagcctgggcctcagtgatggtctcctgcagtncttctggtacatctttccacctacggtatcgaattggttgagacacggtcccccggagacggggtcttggagtggaagtgggatggatcgacgtacccgttacggaactaaacgagtagtagtggagagtaagttccgaggcagagtcagtacagtccacgcgacacacnccgacagtacagcctanagtggaactgagacnctnacgatcgngaccgacgaccgcctaactagttacnggaccgagacgagtagttacgtcgacctagtcggtacctcgggtccttacggtaaccctacggtacgtttcgtcgggtacccg

SEQ ID NO: 29780 - DNA, 511 bp, Homo sapiens
  misc_feature: GYAE6OF02HAA5Y.1.49.E05.1.454.CMB.1.raw
  modified_base (504)..(504): a, c, t, g, unknown or other
  misc_feature (504)..(504): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacgagagtatggagagaagttccagggcagagtcatcatcacgcggacacatccacgagtacagcctacatggaactgaggacgcctcagatctagacgacacggccacttatactgcgcgagagattagtgacactggtcctggctgtaaccacgtcttggnggtaccg

SEQ ID NO: 29781 - DNA, 561 bp, Homo sapiens
  misc_feature: GYAE6OF02JVEJ5.1.49.E05.1.454.CMB.1.raw
  modified_base (427)..(427): a, c, t, g, unknown or other
  misc_feature (427)..(427): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagactaggcccccggagacggggcttggaggtggagtgggatggatcgagtcccgttacgggaactaaacgagaagtatagggagagaagttacgagggtacgagagtacatcatcgacgtcggacacatccacgagtacagcctanagtagactgacggacgcctagagactacgagtaccgacacggacctacttactacgtacggcgacgagacgtagttagtcggactacggtcgtccgtaggtcttacggtaacctccgtcgttacggtcggtacg

SEQ ID NO: 29782 - DNA, 506 bp, Homo sapiens
  misc_feature: GYAE6OF02HP3GX.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttcagggcagagtcatcatcacgcggacacatccacgagtacagtctacatggaactgaggagcctcagatctgacgacacggccacttattactgcgcgagagattatgcactggtcctggctcgtaaccacgtcttggtggtaccg

SEQ ID NO: 29783 - DNA, 541 bp, Homo sapiens
  misc_feature: GYAE6OF02IFSHQ.1.49.E05.1.454.CMB.1.raw
  modified_base (391)..(391): a, c, t, g, unknown or other
  misc_feature (391)..(391): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcgagcccttacggaactaaacagagtatggagagaagttccagggcagagtcatcatcgaccgcggacncatccacgagtacagcctacatggaactgagagcctnagatcgngacgacgacgggcctacgttaattacctgtccgacgagacgtagttatggactacgtcggtaccctgggccttacggtaacccacggtacctttggtcgggtaccg

SEQ ID NO: 29784 - DNA, 525 bp, Homo sapiens
  misc_feature: GYAE6OF02GD3BY.1.49.E05.1.454.CMB.1.raw
  modified_base (356)..(356): a, c, t, g, unknown or other
  misc_feature (356)..(356): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggtagagggggcttggagtggagtgggatgggatcgagcccttacggaactaaaacagagtanggagagagttcgagggcagagtcatcatcaccgcgacacatccagagtacagcctacatggaactgaggagcctcagatctgaccgacacgcctacttatactgacgcgagagtattagttgctacgtggtcctgggtcctcgttaacccacggtcttggtaggtaccg

SEQ ID NO: 29785 - DNA, 511 bp, Homo sapiens
  misc_feature: GYAE6OF02GWJOW.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttcagggcagagtcatcatcaccgcggacacatccacgagtacagcctacatggaactgaggagcctcagatctgacgacacggccacttattactgcgcgagagtattagtgctactggtcctggctgtaacccacgtcttggtgggtacg

SEQ ID NO: 29786 - DNA, 508 bp, Homo sapiens
  misc_feature: GYAE6OF02FHXBY.1.49.E05.1.454.CMB.1.raw
  modified_base (409)..(409): a, c, t, g, unknown or other
  misc_feature (409)..(409): n is a, c, g, or t
  modified_base (426)..(426): a, c, t, g, unknown or other
  misc_feature (426)..(426): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccagggcagagtcatcatcacgcggacacatccacgagtacagcctanatggaactgagagcctnagatctgacgacacggccacttatactgcgcgagagattagtgcacgtggtcctggctagtaaccacgtcttggtggtaccg

SEQ ID NO: 29787 - DNA, 536 bp, Homo sapiens
  misc_feature: GYAE6OF02IMJ3Z.1.49.E05.1.454.CMB.1.raw
  modified_base (412)..(412): a, c, t, g, unknown or other
  misc_feature (412)..(412): n is a, c, g, or t
  modified_base (434)..(434): a, c, t, g, unknown or other
  misc_feature (434)..(434): n is a, c, g, or t
  modified_base (487)..(487): a, c, t, g, unknown or other
  misc_feature (487)..(487): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagtacaggcccccggagaggggcttggagtggatgggatggatcagccttacggaactaaaacagagtatggagagaagttcgagggcagagtcatcatcgaccgcgacacatccacgacgtacagcctanagtaggaactggaggacgcctnagatctagacgacgaccgaccacttattactagcgcgtagagtagtttagtcnccgtacgtcggttccgtggtctacggtaccacggtcttggtcggtaccg

SEQ ID NO: 29788 - DNA, 587 bp, Homo sapiens
  misc_feature: GYAE6OF02JJ89V.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagtacaggtcccccggagaggggcttgaggtggagtcgggatggatcgagtacccgttacggaactaaacgagacgtagtaggagagtacgttacgagggacaggagtcgagtacagtcgaccgtcggacacgataccacgacgtacacgactacgagtcggaactggacggacgtaccgtcagactcgaggaccgacgaaccggacctacgttactacgtcgtacgacgagacgtagttacgttggacctacggtacgttccgtaggtacttcggtaaccctcggttaccgttaggtcggtaaccgg

SEQ ID NO: 29789 - DNA, 533 bp, Homo sapiens
  misc_feature: GYAE6OF02H22L9.1.49.E05.1.454.CMB.1.raw
  modified_base (525)..(525): a, c, t, g, unknown or other
  misc_feature (525)..(525): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcatggggcctcagtgatggtctcctgcagtgcttctggttacatcttttccactacggtatgaattggttgagtacacggtcccccggagaggggctttggaggtggatgggatggatcgagtcccttacggaactaaacagagtatggagagagttcaggcagagtcatcatcacgcgacacatccacgagtacagtccacagtaggaactaggaggacgcctacgagtatcgtagaccgacaccgggacctacttactactggaccgcgagacgtagttagtgctacgtcggtcctggctacgtaccgacggtntggtcggg

SEQ ID NO: 29790 - DNA, 507 bp, Homo sapiens
  misc_feature: GYAE6OF02FGPQE.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccagggcagagtcatcatcaccgcggacacatccacgagtacagcctacatggaactgaggagcctcagatctgacgacacggccacttatactgcgcgagagattattgcactggtcctggctggtaacccagcttgtgggtccg

SEQ ID NO: 29791 - DNA, 616 bp, Homo sapiens
  misc_feature: GYAE6OF02HQG4V.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatggtctcctgcagtgcttctggttacattctttccacctacggtatgtaattggttgagacacgggcccccggaggacggggcttggaggtggagtgggagtggatcgacgtcccgttaacggaaactaaaacgagagtagtaggagagtaagttcgagggcaggagtcatcatcgaccggacgacacactaccacgacgtacacgacctacgagtaggaactggaacgacgccttacgagtactacgtacggaaccgaccgacggtaccctacgtttaacgttaccgtcgaccgtacgagtacgtacgttttacgtcgtaccgtacgttcggttacccgtggtaccttacggtaacccgtaccggtacgtttagggtccggtaaccgg

SEQ ID NO: 29792 - DNA, 520 bp, Homo sapiens
  misc_feature: GYAE6OF02H7MQ9.1.49.E05.1.454.CMB.1.raw
  modified_base (435)..(435): a, c, t, g, unknown or other
  misc_feature (435)..(435): n is a, c, g, or t
  modified_base (464)..(464): a, c, t, g, unknown or other
  misc_feature (464)..(464): n is a, c, g, or t
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttcacctacggtatgaattggttgagacaggcccccggagaggggcttgaggtggatgggatggatcagcccttacggaactaaaacgagagtatggagagaagttcgagggacagagtcatcatcaccgcggacacatccaacgagtacagccctacataggaactaggaggagcctanagatctgacgacaccgcctacttattacngcacgagagtattatgcacgtcggtcctggctcgtaaccacgtcttggtggtaccg

SEQ ID NO: 29793 - DNA, 576 bp, Homo sapiens
  misc_feature: GYAE6OF02JCZ83.1.49.E05.1.454.CMB.1.raw
  modified_base (445)..(445): a, c, t, g, unknown or other
  misc_feature (445)..(445): n is a, c, g, or t
  modified_base (459)..(459): a, c, t, g, unknown or other
  misc_feature (459)..(459): n is a, c, g, or t
  modified_base (556)..(556): a, c, t, g, unknown or other
  misc_feature (556)..(556): n is a, c, g, or t
tcagacgagtgcgtcacgaccggtgctcgatttagagcgactagcaacgtacgaccaaaggggacccaaaaacccacgaccccttcccttgggagaattccccctagatcacagctcctcaccatggacgggacctggagcatcctttcttggtggcagcagcaacaggtgtcccactcccaggttctaaccgtggtcgcagtctgggagctgagctggcgagaagcctggggcctcaggtgactggtctcctgccagtgcttctggttacattctttccacctacggtactgaattggttgagacagggtcccccggagaacggggtcttaggaggtggagtgggagtgggatcgagcccttaggaactaaaacagagtatggagtaagtaagttcgagggcagagtcgatcatcaccgcgacacatccacgagtacagcctanagcgaatgacgganacctcgaagactcgtagacgacgaccgctacttagttacgtgcgacgtagagtagttattcggactacgtcggtacccgtggcgttacggtaacccncggtacgttcggaggtaccg

SEQ ID NO: 29794 - DNA, 510 bp, Homo sapiens
  misc_feature: GYAE6OF02GFG3K.1.49.E05.1.454.CMB.1.raw
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (432)..(432): a, c, t, g, unknown or other
  misc_feature (432)..(432): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggggcctcagtgatggtctcctgcagtgcttctggttacatcttttccacctacggtatgaattggttgagacaggcccccggagaggggcttgagtggatgggatggatcagcccttacggaactaaacagagtatggagagaagttccgagggcagagtcatcatcaccgcgacacatccacgagtacagcctacatggactgagngccncagatcngacgacacggccacttattactgcgcgagagtattagtgcacgtggtcctggtctacgtaacccagtcttggtggtcg

SEQ ID NO: 29795 - DNA, 593 bp, Homo sapiens
  misc_feature: GYAE6OF02FVFCI.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccactacggtatgaattggttgagacaggcccccggagaggggcttgagtggatgggatggatcagtcccgttacggaactaaaacagagtagtaggagagtagttacgagggacagagtcatacatcacgcgacacataccagacgtacacgacctacagtagaacgtgaggacgacctcgacgtatacgtacgaaccgtaccgaccggtaccctaactttacttaaccgtcggaccgacggacgtagtactttagttacgacctaacggttcggtacccgttggtaccgttacggttaaacccgaccggttacgtttcgggtcgggtacccgg

SEQ ID NO: 29796 - DNA, 557 bp, Homo sapiens
  misc_feature: GYAE6OF02HU3MU.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacaggcccccggagaggggcttggagtggagtgggatgggatcagcccttacggaactaaacagagtagtggagagaagttccgaggcagagtcatcatcaccgcggacacactccaacgagtacagcctacacgtaggaaccgttgaggaagcctacagactcgtcgaccgacaccgggcctactttacttacgtgccgacgaggagtaatttagttgaccttacgtcggttcctggccttggtaacccctaggtccgttggtgggtaccgg

SEQ ID NO: 29797 - DNA, 560 bp, Homo sapiens
  misc_feature: GYAE6OF02JCMB0.1.49.E05.1.454.CMB.1.raw
  modified_base (344)..(344): a, c, t, g, unknown or other
  misc_feature (344)..(344): n is a, c, g, or t
  modified_base (428)..(428): a, c, t, g, unknown or other
  misc_feature (428)..(428): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggagtgggatggatcagcccttacggaactaaacngagtatggagagagttcaggcagagtcatcatcacgcgacacatccacgagtacagacctacagtggaactggaggacgccgtnagactcgtagaccgaacaccgggacctacgtttaattaccgcggaccgtacggaagagtagttacgttcgacctacgtcggttccgtggtaccgttcggtaacccgtacggtccgttggtacgggtacccgg

SEQ ID NO: 29798 - DNA, 677 bp, Homo sapiens
  misc_feature: GYAE6OF02IO0JN.1.49.E05.1.454.CMB.1.raw
tcagacgagtgcgtcacgaccggtgctcgatttagagcgactagcaacgtacgacaaaggggacccaaaaaaccacacccctccttgggaggaatcccctagatcactagctcctcaccatggacgggacctggagcatccttttcttggtggcagcagcaacaggtgcccactcccaggttcacctggtgcagtctggagctgagctgacgaggaagcctggggcctcgagtgatggtctccgtgctagtcgtcttcgtggttacagttccttttccaccttacgggtatcgaacttggttgacgtacgcggtcccccgggaggtagggggccttagggagggtggtaagtgggacgtgggatacgacggtccccgttaacggaaaccttaaaacgaacgtaagtagtacgggtaagtaagtaaacggttaccgagggacaacggagtacagtacataccgaccgacgggtaccactaactacccgaacgacgtaaccacgaccctaagtagtacggaaccgtggaacggacgacccgtcgaagaacgttcgtaccggacgaaccgaccgacctaacgtttacgttaccgtcggccgtacggacgtagtactttacgttacgcctacgtcgttaccgtggtaccttacgtaaccgtcggcgtttcggcggtaccgg

SEQ ID NO: 29799 - DNA, 523 bp, Homo sapiens
  misc_feature: GYAE6OF02GPA3D.1.49.E05.1.454.CMB.1.raw
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctggttacatcttttccacctacggtatgaattggttgagacaggcccccggagagggggcttggagtggatgggatggatcagcccttacggaactaaaacagagtatggagagagttcgagggcagagtcatcatcaccgcggacacatccacgagtacagcctacatggaactggaggagcctnagatcngacgacacgcctacttatacgtcgcgcgagagattagtgcctacgtcggtccgtggtctacgtaaccctacgtcgttggtggtaccgg

SEQ ID NO: 29800 - DNA, 508 bp, Homo sapiens
  misc_feature: GYAE6OF02GIZU9.1.49.E05.1.454.CMB.1.raw
  modified_base (492)..(492): a, c, t, g, unknown or other
  misc_feature (492)..(492): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccagggcagagtcatcatcacgcggacacatccagagtacagcctacatggaactgaggagcctcagatctgacgacacggccacttatactgacgcgagagattagtgcacgtggtcctggctcgtaaccncgtcgttggtggtccg

SEQ ID NO: 29801 - DNA, 597 bp, Homo sapiens
  misc_feature: GYAE6OF02ITZVG.1.49.E05.1.454.CMB.1.raw
  modified_base (434)..(434): a, c, t, g, unknown or other
  misc_feature (434)..(434): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctccgtgcagtgcttctggttacatcttttccacctacggtatgaattggttgagacgaggcccccggaggacgggtcttgagtggagtgggagtggatcaggtcccttaacgggaactaaaacagtatagtaggaagaggaacgttccgagggacgagagcgtaatacgatcgaaccgcgaacgacacgtaccaacgagtaacgngacctacatcggaacttaggaggaacgccgtacgaagtcgtactacgaaccggactaccgggaccttacgttagttaccgagtccgacgtaggacgtagttagttacggctaacgtcggtacctagggtacttacgaacccgttaggcgtttaggtcggaccg

SEQ ID NO: 29802 - DNA, 546 bp, Homo sapiens
  misc_feature: GYAE6OF02IRUK5.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccactacggtatgaattggttgagacaggcccccggagaggggcttggaggtggagtggggatggatcagcccttaggaaactaaaacagagtatggagagagttcgaggcagagtcatcatcacgcgacacgaatcacgagtacagacctaacagtacggaactaggaggacggacctcgaagatcgtacgaacgaccgacggcctaactttaattacgtgacgacgagtacgagtttagtgacacgttggtcctggcttacggtaacccaggtcttggtggtaccgg

SEQ ID NO: 29803 - DNA, 506 bp, Homo sapiens
  misc_feature: GYAE6OF02GOJVV.1.49.E05.1.454.CMB.1.raw
  modified_base (455)..(455): a, c, t, g, unknown or other
  misc_feature (455)..(455): n is a, c, g, or t
  modified_base (493)..(493): a, c, t, g, unknown or other
  misc_feature (493)..(493): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccagggcagagtcatcatcacgcggacacatccacgagtacagcctacatggaactgaggagcctcagatctgacgacacgcccacttattacngcgcgagagattagtgctacgtgtcctggctgtaaccncgcttgtggtacg

SEQ ID NO: 29804 - DNA, 600 bp, Homo sapiens
  misc_feature: GYAE6OF02IU4XD.1.49.E05.1.454.CMB.1.raw
  modified_base (406)..(406): a, c, t, g, unknown or other
  misc_feature (406)..(406): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggctcagtgatggtctccgtgcagtgcttcgtggttacattcttttccacctacggtatgtaattggttgagacaggccccggtagacggggcttgagtggatggatggatcgagtccctaaggaactaaaacgagtagtataggaacgagtaagttccgaagggacgtagagtacagtacacgtacacccgnggaacacgagtccaacggacgtacagtcctaagagtaggaaactgacggagacctacgagactacgtacgaacgacaccggactacgttattaaccgtgacgcgtaacgacgttaatttacgtgtactaccggttacggtcccgttaacgggctttaaccggtaaccctaaccggtgtttccggaggggtaccc

SEQ ID NO: 29805 - DNA, 537 bp, Homo sapiens
  misc_feature: GYAE6OF02HYSWP.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggagtgggatggatcagcccttacggaactaaacagagtatggagagaagttcgagggcagagtcatcatcaccgcggacacatccacgagtacagacctacatcggaactggaggagcctacagatctgacgacgaccgctacttattacgtgcgacgagagtattagtcgactacgtcggttccgtggtcgttacgtaacccgtacggtcgtttggtcgggtaccg

SEQ ID NO: 29806 - DNA, 628 bp, Homo sapiens
  misc_feature: GYAE6OF02FNWUL.1.49.E05.1.454.CMB.1.raw
  modified_base (107)..(107): a, c, t, g, unknown or other
  misc_feature (107)..(107): n is a, c, g, or t
  modified_base (129)..(129): a, c, t, g, unknown or other
  misc_feature (129)..(129): n is a, c, g, or t
tcagacgagtgcgtcacgaccggtgctcgatttagagcgactagcaacacacaaaggggccaaaaccacacccctccttgggagaatcccctagatcacagctcctnaccatggacgggacctgagcancctttctggtggcagcagcaacaggtgccactcccaggttcacctggtgcagtctggagctgagctagcagaagcctagggcctcagtgatggtctcctgctagtgacttctggttactactcttaccacgtacgtatagtagttggtcgacgtacgacggtacccggaggtacgggtcgttacggtacggtcggtacgtggtacgtggtactacgacgtaccgtaacggaactaacgagtagtacgtacggagtagtacgtacgaggtactagtacgtacgtatacgacgtaccgacgacgactacgtacgtaccgacgtacgtacgtacgtacctacgacgtacgtacgtacgtacggtacgtaccgtacgacgtacgtacgtacgtacgacgtaccgtactacgttacgtacgtacgacgtacgacgtagtacttacgtcgacgtacgtcgttacgtacgtaccgtacgtaccgtacgtcgttacggtacggtacg

SEQ ID NO: 29807 - DNA, 515 bp, Homo sapiens
  misc_feature: GYAE6OF02GC7Y4.1.49.E05.1.454.CMB.1.raw
  modified_base (409)..(409): a, c, t, g, unknown or other
  misc_feature (409)..(409): n is a, c, g, or t
  modified_base (433)..(433): a, c, t, g, unknown or other
  misc_feature (433)..(433): n is a, c, g, or t
  modified_base (507)..(507): a, c, t, g, unknown or other
  misc_feature (507)..(507): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggagtggatgggatggatcagccttacggaactaaaacagagtatggagagaagttcaggcagagtcatcatcaccgcgacacatccacgagtacagacctanactggaactgagagcctcagatcngacgacacgcctacttactactgcgcgagagattagtgcacgtggtcctggtctacgtaacccgacgtcttggnggtaccgg

SEQ ID NO: 29808 - DNA, 541 bp, Homo sapiens
  misc_feature: GYAE6OF02JGSB5.1.49.E05.1.454.CMB.1.raw
  modified_base (534)..(534): a, c, t, g, unknown or other
  misc_feature (534)..(534): n is a, c, g, or t
tcagacgagtgcgtcacgaccggtgctcgatttagagcgactagcaacacacaaaggggacccaaaaaccacacccctccttgggcgaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgaattggttgagacaggcccccggagagggggcttggaggtggagtgggatggatcagccctacggaactaaaacagagtagtggagagaagttcgagggcagagtcatcatcaccgcggacacatccacgacgtacacgacctacagtacggaactggaggacgcctacgagactcgacgacgacgaccggcctaacgttacttacgtcgcgcgagtagattagtgacacgtggtcctggtctacgtaccgcgtcgttcggnggtaccg

SEQ ID NO: 29809 - DNA, 517 bp, Homo sapiens
  misc_feature: GYAE6OF02H7W15.1.49.E05.1.454.CMB.1.raw
  modified_base (429)..(429): a, c, t, g, unknown or other
  misc_feature (429)..(429): n is a, c, g, or t
  modified_base (464)..(464): a, c, t, g, unknown or other
  misc_feature (464)..(464): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggtcacctggtgcagtctggagctgagctgcagaagcctggggcctcagtgatggtctcctgcagtgcttctggttacatcttttccacctacggtatgaattggttgagacaggcccccggagagggggcttggagtggatgggatggatcagcccttacggaactaaaacagagtatggagagaagttccagggcagagtcatcatcaccgcgacacatccacgagtacagcctacatggaactgaggagcctanagatctggacgacacggccattactactgcgcganagtattagtgactactggtcctggtctacgtaacctacggcttggtggtaccg

SEQ ID NO: 29810 - DNA, 540 bp, Homo sapiens
  misc_feature: GYAE6OF02GKD9E.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggtcccccggagagggggcttggagtggatggggatggatcagcccgttacggaactaaaacagagtatggagagaagttccagggcagagtcatcatcaccgcggacacatccacgagtacagcctacatgaactggaggacgcctcgagatcgtagacgtacgacggcctaacttattactgacgacgagagtattacgtgtactacgtcggtccttggacttcggtaacccacggtcgttggtggtaccgg

SEQ ID NO: 29811 - DNA, 526 bp, Homo sapiens
  misc_feature: GYAE6OF02IRZ4V.1.49.E05.1.454.CMB.1.raw
  modified_base (425)..(425): a, c, t, g, unknown or other
  misc_feature (425)..(425): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggaggtggatgggatggatcagcccttacggaactaaacgagagtatggagagaagttcgaggcagagtcatcatcacgcgacacatccacgagtacacgcctacataggaactgaggacncctacagactctagacgacacggacctacttacttacgtcgcgacgagagattagtgctacgtcggtcctggctacgtaaccgacgtcgttggtggtaccg

SEQ ID NO: 29812 - DNA, 547 bp, Homo sapiens
  misc_feature: GYAE6OF02G5NBE.1.49.E05.1.454.CMB.1.raw
  modified_base (393)..(393): a, c, t, g, unknown or other
  misc_feature (393)..(393): n is a, c, g, or t
  modified_base (412)..(412): a, c, t, g, unknown or other
  misc_feature (412)..(412): n is a, c, g, or t
  modified_base (427)..(427): a, c, t, g, unknown or other
  misc_feature (427)..(427): n is a, c, g, or t
  modified_base (459)..(459): a, c, t, g, unknown or other
  misc_feature (459)..(459): n is a, c, g, or t
  modified_base (468)..(468): a, c, t, g, unknown or other
  misc_feature (468)..(468): n is a, c, g, or t
  modified_base (496)..(496): a, c, t, g, unknown or other
  misc_feature (496)..(496): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcatggtaacacaaaaattcacagaattccagggcagagtcacctttacagggacacatccgngaggattacttatatgganctagagcagcctganatccgaagacacggctagtacttagtttttgngcgtacctntagtggtagttcagtttattacggcttntaatttgacgttccgtggggcctacggggtaacccttgggtacctacccgg

SEQ ID NO: 29813 - DNA, 597 bp, Homo sapiens
  misc_feature: GYAE6OF02H3FJE.1.49.E05.1.454.CMB.1.raw
  modified_base (390)..(390): a, c, t, g, unknown or other
  misc_feature (390)..(390): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtcggcagcagcaacaggtgcccactcccaggttcacctggtgcagtctggagctgagctgcagaagcctggggcctcagtgatggtctcctgcagtgcttctggttacatcttttccacctacggtatgaattggttgagacacggcccccggagaggggctttggaggttgggagtgggatgggatcgagcccgttaacggaactaaaacgagagtagtggagagaagttcaggtcagagtcatnatcgaccgcggacacactccaacgagtaacagacctaacagtaggaacgtggaaggacgacctcgaagacgttactacggaaccgaccgacggaccctaacgtttaacttacgtacgccgacggaacgagtaactttagttcgaccgtacgttacggtccttcggacttaccggtaacccgtaccggttcgttcggtaggtacccgg

SEQ ID NO: 29814 - DNA, 544 bp, Homo sapiens
  misc_feature: GYAE6OF02I00DN.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggtcccccggaggagggggcttggagtgggactgggatggatcgagcccttacggaactaaaacagagtatggagagagtacaggtcagagtcatcatcaccgacggacacatccacgagtacagcctacagtgaactgaggacgcctacagtactacgtgaccgacaccggcctacttattactgacgcgtagagtattacgttggacacgtggtacctggtacctacggtaacccgtgtaccgttggtcggtaccg

SEQ ID NO: 29815 - DNA, 548 bp, Homo sapiens
  misc_feature: GYAE6OF02GILWI.1.49.E05.1.454.CMB.1.raw
  modified_base (405)..(405): a, c, t, g, unknown or other
  misc_feature (405)..(405): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatctttccacctacgtatgaattggttgagtacaggcccccggagaggggcttggagtggatgggatggatcagcccttacggaactaaacagagtatggagagagttcaggcagagtcatcatcaccgcgacacatccacgagtacagcctaanactggaaccttgacggacgccttacgacgactcgtacgaccgacgaaccgggcctaacttattacctggaccgacgagagtattagttcgactacgtggttccgtggtccttggtaaccctacgtcgtttaggtcggtaccgg

SEQ ID NO: 29816 - DNA, 600 bp, Homo sapiens
  misc_feature: GYAE6OF02H2JWT.1.49.E05.1.454.CMB.1.raw
  modified_base (393)..(393): a, c, t, g, unknown or other
  misc_feature (393)..(393): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttctggtggcagcagcaacaggtgcccactcccaggttcacctggtgcagtctggagctgagctgcagaagcctggggcctcagtgatggtctcctgcagtgcttctggttacatcttttccacctacggtatgaattggttgagactaggcccccggagaggggcttggagtggatgggatggatcgagcccgttacggaactaaacgagagtagtggagagaagttccgaagggcagagtcatacatcaaccggnggaaccacatcccgaagagtaaccgagaccctaacacgtagggaaccttagggacggagcctacgagacgtactacgggaacaccgtacgggacctaacttaacgttccgtaggcgtacgaacgaggtaactttagttacgaccgtaacgtcggttaccctggggtcttaccggtaacccacggtcgtttacgggtcgggtaccggg

SEQ ID NO: 29817 - DNA, 616 bp, Homo sapiens
  misc_feature: GYAE6OF02J1WT3.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccactacggtatgtaattggttgagtacaggcccccggagaggggcttgagtggagtgggatgggatcgagtcccgttacggaactaaaacgagagtagtaggagagaagttccgaggcagagtcatcagtcacggcggaccacgactaccgaacggacgtaacgacgtacctaacgagtacgggaaaccttaggaacggacgacccgttacgaacgtacgttaccgtaggaaccggacgaaccgggtaccctaacgtttacttaacgtacggtaccgacgaacggtagtagtttaagtcggactacgttccggtccttggtaccgttacgtaacccgcgtcgttacggtcgggtaccg

SEQ ID NO: 29818 - DNA, 616 bp, Homo sapiens
  misc_feature: GYAE6OF02FVEDA.1.49.E05.1.454.CMB.1.raw
  modified_base (390)..(390): a, c, t, g, unknown or other
  misc_feature (390)..(390): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggggcctcagtgatggtctcctgcagtgcttctggttacatctttccacctacggtatgtaattggttgagacacggcccccggagagggggcttggagtggagtgggatggatcagcccttacggaactaaacaggagtatggagagaagttcgagggcagagtcatcatcaccgngacacatccagacgtacacgacctacagtgaacgtggaggacgcctacgacgtactcgttacggaccgaaccgacccggtaccctaacgttttaacgttaaccgttcggaccggtacgaacggtacggtaactttagtttacggacctaaccgttcgggttaccccgttagggtcccgttaacggttaacccgaccggtccggtttacgggtacgggttacccggg

SEQ ID NO: 29819 - DNA, 513 bp, Homo sapiens
  misc_feature: GYAE6OF02F72YD.1.49.E05.1.454.CMB.1.raw
  modified_base (419)..(419): a, c, t, g, unknown or other
  misc_feature (419)..(419): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccactacggtatgtaattggttgagtacaggcccccggagagggggcttggagtggatgggatggatcagccttacggaactaaaacagagtatggagagaagttcaggcagagtcatcatcacgcggacacatccagagtacagctacatgaactgaggancctacagactcgagacgacaccggacctacttatactgccgcgagagattagttgactactggtcctggctcgtaaccacgtcttggtggtccg

SEQ ID NO: 29820 - DNA, 540 bp, Homo sapiens
  misc_feature: GYAE6OF02ILISI.1.49.E05.1.454.CMB.1.raw
  modified_base (299)..(299): a, c, t, g, unknown or other
  misc_feature (299)..(299): n is a, c, g, or t
  modified_base (416)..(416): a, c, t, g, unknown or other
  misc_feature (416)..(416): n is a, c, g, or t
  modified_base (440)..(440): a, c, t, g, unknown or other
  misc_feature (440)..(440): n is a, c, g, or t
  modified_base (520)..(520): a, c, t, g, unknown or other
  misc_feature (520)..(520): n is a, c, g, or t
  modified_base (533)..(533): a, c, t, g, unknown or other
  misc_feature (533)..(533): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacacggccccggagnggggcttggagtggagtgggatggatcgagcccttaaggaactaaaacgagagtatggagagaagttccaaggcagagtcatcatcaccgcggacacactccacgagtacagcctanatggaactgagagcctacagatcngacgacacggcctacttatacgtgccgcgagagtaattacgtgacctacgtcggtccctagggtaccttacgtaaacccncggtcgtttcggnggtaccg

SEQ ID NO: 29821 - DNA, 594 bp, Homo sapiens
  misc_feature: GYAE6OF02JHEZP.1.49.E05.1.454.CMB.1.raw
  modified_base (388)..(388): a, c, t, g, unknown or other
  misc_feature (388)..(388): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacacggcccccggagaggggcttgaggtggagtgggatggatcgacgtcccgttaacggaaactaaaacaggagtagtaggagagaagttccgagggcagagtnatcatcacgcgacacatccacgagtacagcctacagtaggaactggaggacgcctgagagtcctaggaaccgaccgaccggaccctaacgtttacttaacgtcgaccgcgaaggacgttaattacgttacgaccgttaacgttcgggttaccgtacggtaccgttacggtaaacccgtaccggtacgtttcgggacgggtacccgg

SEQ ID NO: 29822 - DNA, 550 bp, Homo sapiens
  misc_feature: GYAE6OF02FZ4HO.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtggatgggatggatcagccttacggaactaaacagagtatggagagaagttccgagggcagagtcatcatcacgcggacacatccagacgtacacgcctaacataggaactggaggacgccctacagtatcgtgaacgacgaaccggcctaactttacttacgtcgcgacgagagtatttagttgcctacgtcggttccgtggtaccttcggttaaaccacggtcgttaggtcggtaccgg

SEQ ID NO: 29823 - DNA, 549 bp, Homo sapiens
  misc_feature: GYAE6OF02HHG2X.1.49.E05.1.454.CMB.1.raw
  modified_base (416)..(416): a, c, t, g, unknown or other
  misc_feature (416)..(416): n is a, c, g, or t
  modified_base (541)..(541): a, c, t, g, unknown or other
  misc_feature (541)..(541): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccaccttacgtatgaattggttgagtacacggccccggagaggggcttgagtggagtgggatggatcgagtcccttacggaactaaaacgagagtagtaggagagaagttcgaggcgagagtcatcatcacgcgacacactaccacgagtacagcctanacgtgaactgaggacgcctacgagactcgtagacgacgaccggacctaacgtttactacgtcgtacgacgagagtattagtcgactacgtcgtccgtggtactacgtaacctacggtcgtttggnggtaccgg

SEQ ID NO: 29824 - DNA, 662 bp, Homo sapiens
  misc_feature: GYAE6OF02I3LZM.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtcctctgcagtgcttcgtggttacattctttccacctacggtatgtaattggttgagacgtacgggacccccggaggacggggtcttggaggtggaggtgggagtaggactcgacgtacccgttaacggaaactaaaacgagaaggttagtaggaagaagtaacgttacgagggacaaggagtacgatacgactacgacgacgaccaacactaccgaacggtacgtacgacgtacctaacgagtacggaacgttaggaacggacgtacccgtacgtaacgacgttacgtacgaaccgaaccgaacccggtacctaaccgtttaacgttacgtacggtaccgacggaacgtagttactttagtacgtacctaccggttcggttaccgtgggtaccgttacggaacccgtaggttaccgttgggtcggtaaccggg

SEQ ID NO: 29825 - DNA, 541 bp, Homo sapiens
  misc_feature: GYAE6OF02JHJ4T.1.49.E05.1.454.CMB.1.raw
  modified_base (376)..(376): a, c, t, g, unknown or other
  misc_feature (376)..(376): n is a, c, g, or t
  modified_base (396)..(396): a, c, t, g, unknown or other
  misc_feature (396)..(396): n is a, c, g, or t
  modified_base (468)..(468): a, c, t, g, unknown or other
  misc_feature (468)..(468): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctggttacatcttttccacctacggtatgaattggttgagacacggcccccggaggaggggcttggagtggagtgggatggatcagtcccttacggaactaaacagagtagtggagagagtccgaggcagagtnatcatcgaccgcggacacanacacgagtacagactaacagtggaactggagacgcctcagactctagaccgacacggacctacgttagtacngtccgacggagagtaatagttcgactacgtcggtccctaggcttacgtaacccgacgtcgttgggcggtaccg

SEQ ID NO: 29826 - DNA, 517 bp, Homo sapiens
  misc_feature: GYAE6OF02GN2PZ.1.49.E05.1.454.CMB.1.raw
  modified_base (417)..(417): a, c, t, g, unknown or other
  misc_feature (417)..(417): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
  modified_base (510)..(510): a, c, t, g, unknown or other
  misc_feature (510)..(510): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtggatgggatggatcagcccttacggaactaaacagagtatggagagagttcagggcagagtcatcatcaccgcggacacatccgacgagtacagcctacatggaacnggaggagcctnagatcgngacgacgacggccacttactactgcgcgagagtattagtgactacgtggtcctggctacgtaaccacgtcttggnggtaccg

SEQ ID NO: 29827 - DNA, 627 bp, Homo sapiens
  misc_feature: GYAE6OF02IIED2.1.49.E05.1.454.CMB.1.raw
  modified_base (484)..(484): a, c, t, g, unknown or other
  misc_feature (484)..(484): n is a, c, g, or t
  modified_base (529)..(529): a, c, t, g, unknown or other
  misc_feature (529)..(529): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctggttacattctttccacctacgtatgaattggtgagacgcggcccccggagaggggcttggaggtggagtgggagtggatcgacggtacccttaacgggaaacctaaaacgagaggtaagtagggaagtaacggtaaacgttccgagggtacgaagtacgtacactacgtatccgaccgacggacacactccgaacgtagtacacgtacctaactagtacgtaacgtagcggaacgtccncgtacgaactcgtacgaccgacgaccggccttaacgttacttacncggacgtacgaggtacgtattagtcggtcctaacgttccgggttaccgtacggggtaccttacggtaacccgtacgtcggttacgggtggtaacccgg

SEQ ID NO: 29828 - DNA, 530 bp, Homo sapiens
  misc_feature: GYAE6OF02HP711.1.49.E05.1.454.CMB.1.raw
  modified_base (437)..(437): a, c, t, g, unknown or other
  misc_feature (437)..(437): n is a, c, g, or t
  modified_base (469)..(469): a, c, t, g, unknown or other
  misc_feature (469)..(469): n is a, c, g, or t
  modified_base (486)..(486): a, c, t, g, unknown or other
  misc_feature (486)..(486): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggaggacggggcttgagtggagtgggatggatcagtcccttacggaactaaaacgagagtagtggagagaagttcgagggcagagtcatcatcaccgcggacacatccacgagtacagacctacataggaactgagacgcctanagatctagacgacgacgacctacttattacgngcgcgagagtattagtnactacgtgtccgtggtcgtacgtaccgacgtcgttggtggtacg

SEQ ID NO: 29829 - DNA, 549 bp, Homo sapiens
  misc_feature: GYAE6OF02G5SSP.1.49.E05.1.454.CMB.1.raw
  modified_base (345)..(345): a, c, t, g, unknown or other
  misc_feature (345)..(345): n is a, c, g, or t
  modified_base (383)..(383): a, c, t, g, unknown or other
  misc_feature (383)..(383): n is a, c, g, or t
  modified_base (424)..(424): a, c, t, g, unknown or other
  misc_feature (424)..(424): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccaccttacggtatgaattggttgagacaggcccccggagaggggcttgagtggatgggatggatcagcccttaggaactaaaacgngagtatggagagagttcgaggcagagtcatcatcacgnggacacatccagagtacagcctacatggaacttggacggancccgtacagactcgtagaccggaccacgggaccctaacgtttacttaactcggacgacgagtagatttagtggacctacgtcggtccttgggaccttcggtaacccacggtcgttggcggtaccg

SEQ ID NO: 29830 - DNA, 555 bp, Homo sapiens
  misc_feature: GYAE6OF02H9695.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagctggggcctcagtgatggtctcctgcagtgcttctggttacattcttttccaccttacggtatgaattggttgagacaggcccccggagacggggcttggagtggagtgggatggatcgagcccttaacggaactaaaacgagagtagtagggagagaagttaccgagggcagagtcatcatcaccgcgacacataccacgagtacagacctaacataggaactggaggacgcctcagatcgtacgacgacaccgcctactttacttactgacgacgagagtatttagtcgactacgtcggttacctaggtcttacggtaaccctacggtcgttacggtggtaccgg

SEQ ID NO: 29831 - DNA, 535 bp, Homo sapiens
  misc_feature: GYAE6OF02G8TSC.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgtagacaggccccccggagaggggcttgagtggatgggatggatcgagcccttacggaactaaaacagagtatggagagagttccagggcagagtcatcatcaccgcggacacatccacgagtacagcctacatggaactggaggagcctcagatctgaccgacacggaccacttattactcgacgcgagagtattagttgacctacgtcggtacctggcttacggtaacccacggtccgttaggtcgggtaccg

SEQ ID NO: 29832 - DNA, 545 bp, Homo sapiens
  misc_feature: GYAE6OF02IEHFT.1.49.E05.1.454.CMB.1.raw
  modified_base (515)..(515): a, c, t, g, unknown or other
  misc_feature (515)..(515): n is a, c, g, or t
  modified_base (528)..(528): a, c, t, g, unknown or other
  misc_feature (528)..(528): n is a, c, g, or t
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctggttacattcttttccacctacgtatgaattggttgagcaggccccggagagggcttgaggtggagtgggatggatcagcccttacggaactaaacgagagtagtggagagaagttcagggcaagagtacatcatcgaccgcggaacacactccgtacgagtacacgacctacatacggaactgacggacgacctcgagactcgtacgaccgaccaccgggacctaacgttacttacgtgacgacgagagtattagtgactacgtcgtccgnggtcacgtaaccncggtcttcggaggtccg

SEQ ID NO: 29833 - DNA, 527 bp, Homo sapiens
  misc_feature: GYAE6OF02FFY75.1.49.E05.1.454.CMB.1.raw
  modified_base (345)..(345): a, c, t, g, unknown or other
  misc_feature (345)..(345): n is a, c, g, or t
  modified_base (510)..(510): a, c, t, g, unknown or other
  misc_feature (510)..(510): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagacaggcccccggagagggggcttgagtggatgggatggatcgagcccttacggaactaaaanagagtatggagagaagttccagggcagagtcatcatcaccgcggacacatccagagtacagcctacatggaactgacggagcctgagactctgacgaccgaccgggcctaactttatactgcgacgagagattacgtgctacgtcggtcctggactggtaacccngtcttaggtggtaccgg

SEQ ID NO: 29834 - DNA, 544 bp, Homo sapiens
  misc_feature: GYAE6OF02G8TA5.1.49.E05.1.454.CMB.1.raw
  modified_base (386)..(386): a, c, t, g, unknown or other
  misc_feature (386)..(386): n is a, c, g, or t
  modified_base (451)..(451): a, c, t, g, unknown or other
  misc_feature (451)..(451): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggggcctcagtgatggtctcctgcagtgcttctggttacatcttttccaccttacggtatgtaattggttgagtacagggcccccggaggaggggcttggagtggagtgggatggatcagcccttacggaactaaaacagagtatggagagaagttcagggcagagtcatcancaccgcgacacatccaacgagtacagcctaacatacgggaacttggaggacgacctcaggatcgngaccgacgcgacctactttacgtctgcgacgagagtattagttcgctacgtcggtcctggaccttagtaccctagtccgttaggtggtaccgg

SEQ ID NO: 29835 - DNA, 551 bp, Homo sapiens
  misc_feature: GYAE6OF02HSFJ3.1.49.E05.1.454.CMB.1.raw
  modified_base (476)..(476): a, c, t, g, unknown or other
  misc_feature (476)..(476): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagagcctggggcctcagtgatggtctctgcagtgcttctggttacatcttttccacctacggtatgaattggttgagtacaggccccggagagggcttgagtggatggatggatcgagccgttacggaactaaacgagagtagtggagagaagttcgaggcagagtcatcatcaccgcggacacactccgaacgagtacagtacctacgagtacgaacgtggaacggacgacctcgagtactcgtacgacgacgaccgacctacttattacgngcgacgagagtactttagtgactacgtcggttccgtggtacctcggtaaaccctccggtcttgggtcggtaccgg

SEQ ID NO: 29836 - DNA, 520 bp, Homo sapiens
  misc_feature: GYAE6OF02I6N01.1.49.E05.1.454.CMB.1.raw
  modified_base (464)..(464): a, c, t, g, unknown or other
  misc_feature (464)..(464): n is a, c, g, or t
  modified_base (506)..(506): a, c, t, g, unknown or other
  misc_feature (506)..(506): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagtacaggcccccggagaggggcttggacgtggatgggatggatcgagccttacggaactaaacagagtatggagagagttcagggtcagagtcatcatcacgcgacacgatccacgagtacagcctaacatcggaactggaggacgtcctagagatcgtgacgacacggctacttattacngcgcgagagtattagtgctactggtcctggtactcgtaaccncgtcttgcggtacg

SEQ ID NO: 29837 - DNA, 663 bp, Homo sapiens
  misc_feature: GYAE6OF02I5RSR.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctccgtgcagtgcttcgtggttacatctttccacctacggtatgaattggttgagacaggcccccggagaggggcttgagtggatgggatggatcgagtcccgttaacggaacgtaaaacgagaagtaacgtaggaagtaaggaacggttccgaagggacgtaagacgtacgactacgagtaccgaaccgtacggacaccgactaccgaacgtacggtaccaacgcctaacacgtacggtaacgttaggaggacggcctacgagtacgtacgttacggaaccgtacgaaccggtaccgtaacgtttaacgttaccgtacggaccggaccggaagtacgtaagtttacgttacggtacctacggttacgggttacccgttacgggtaccgttacggtaacccgtacggtccggtttacgggtcgggtaacccggg

SEQ ID NO: 29838 - DNA, 523 bp, Homo sapiens
  misc_feature: GYAE6OF02HVFGU.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttctggttacatcttttccacctacggtatgaattggttgagacaggcccccggagaggggcttggagtggatgggatggatcgagcccttacggaactaaacagagtatggagagaagttcagggcagagtcatcatcaccgcgacacatccgacgagtacagcctacagtgaactgaggacgcctacgagactcgtacgacgacgacggcctacgttacttacgtgcgcgagagtagttagtgctacgtgtccgtggctagtaccacgtcttggtggtacgg

SEQ ID NO: 29839 - DNA, 592 bp, Homo sapiens
  misc_feature: GYAE6OF02IK84M.1.49.E05.1.454.CMB.1.raw
  modified_base (221)..(221): a, c, t, g, unknown or other
  misc_feature (221)..(221): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctnagtgatggtctccgtgcagtgcttctggttacattcttttccacctacggtatgattggttgagacgaggcccccggaggacggggtcttggacggtgggagtgggagtggagtcgacgtcccgttaacggaaactaaaacagtagtagtggagaagaagttccgaagggcgaaggagtacatacatacgaccgcggacacaactccgacgacgtacacgacctacagtaggaactggacggacgcctacgagatacgacgacgaccgacgactaacttatacgtcgacgagagtacgtaattacgtcgtacctacgttacggttccgtaggtccgttacgtaacccgtacgtacggttggtacggtacgg

SEQ ID NO: 29840 - DNA, 546 bp, Homo sapiens
  misc_feature: GYAE6OF02JSX3D.1.49.E05.1.454.CMB.1.raw
  modified_base (440)..(440): a, c, t, g, unknown or other
  misc_feature (440)..(440): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctggttacatcttttccacctacggtatgaattggttgagactaggcccccggagaggggcttgagtggagtgggatggatcgagacccgttacggaactaaacgagagtatggagagagttcgaggtcagagtacatcatcgacgcggacacatccacgagtacacgctacagtaggacgtgagacgcctacgagtntcgtagacgacgacgacctacttacgtacgtcgcgacgagagtagttacgttcgactacgtcgttcgtggtacgtacgtaaccgtacgtcgttaggtcggtaccgg

SEQ ID NO: 29841 - DNA, 691 bp, Homo sapiens
  misc_feature: GYAE6OF02H4DIE.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccactacggtatgaattggttgagtacagggtcccccggaggaggggtccttggaggtggagtgggatggatcaggaccctttacggaactaaaacgagagtataggagagtagttcgaggtacagagtcatcatctaccggcgtacacactaccaacgagtaacagacccgtaacagtagaacgtggaacggtagaccgttacgagtaactcgttacggaaccgtaccgaacccgggtaccctaaccgttttaacgttaaccgtacgggtacccggtaacggtaccggtaaacggttaacgtttttaacggttaccggtaaccgtttaacccggtacgggttttaccccgtacggggttttaccccgtttaaaacccggtaccggttaacccggtttttcgggttaccggggttaccgttaaccccgggggg

SEQ ID NO: 29842 - DNA, 576 bp, Homo sapiens
  misc_feature: GYAE6OF02GORM8.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgtaattggttgagacacgggcccccggaggaggggcttggaggtggagtgggagtggatcacgtcccgttaacggaaactaaaacagagtagtaggagagaagttcgagggcaggagtcatcatccacgcgacacactaccgacgacgtacacgactaccccagtacggaacgtggacggacgccgtacgacgtagtacgtacgacgacgaccggacctacgtttacttacgtcgacgtcgagtagtattagttcgactacgtcggtccgtggtcgtacgtaaccgtcgtcgttggtggtaccgg

SEQ ID NO: 29843 - DNA, 660 bp, Homo sapiens
  misc_feature: GYAE6OF02JZRK6.1.49.E05.1.454.CMB.1.raw
tcagacgagtgcgtcacgaccggtgctcgatttagagcgactagcaacacacaaaggggacccaaaaaccaacacccctccttgggagaatccctagatcacagctcctcaccatggacgggacctggagcatcctttcttgtggcagcagcaacaggtgcccactcccaggttcacctggtgcagtctggagctgagctgcagaagcctggggcctcagtgatggtctcctgcagtgcttctggttacatctttccactacgtatgattggttgagtacacggtcccccggaggacggggtctggagtgagtcgggagtggatcgtagcccgttaggaacgtaaacaggtagtacttgggaagaggtaaggttccggaggtacgaagagtacagtcgagtacgaccggtcggacacgactacccgaacggagtaaccgacgtacccgtaactaggtacggaacgttaggaacgggacgccgtacgaggtaaccttcgaacggacgacccgaacgggacctaaccgtttaagttaaccgtcggaacgtaccggacgttagtaccttttaggtcgaccttaacggttccgggttaacccgttcgggtaaccgttacggttaaaccccgacggtttaccgtttacggggcgggttaacccgg

SEQ ID NO: 29844 - DNA, 534 bp, Homo sapiens
  misc_feature: GYAE6OF02JC0NT.1.49.E05.1.454.CMB.1.raw
  modified_base (434)..(434): a, c, t, g, unknown or other
  misc_feature (434)..(434): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttgagtggatgggatggatcagcccttacggaactaaaacagagtatggagagaagttcagggcagagtcatcatcacgcggacacatccacgagtacagcctacatggaactgagagccgtacagatcngacgacacggccacgttattactgcgacgagagtattagttgacctacgttcggtaccttgggccttacggtaacccacggtctttacggtcgggtaccg

SEQ ID NO: 29845 - DNA, 724 bp, Homo sapiens
  misc_feature: GYAE6OF02JXTPK.1.49.E05.1.454.CMB.1.raw
  modified_base (185)..(185): a, c, t, g, unknown or other
  misc_feature (185)..(185): n is a, c, g, or t
  modified_base (402)..(402): a, c, t, g, unknown or other
  misc_feature (402)..(402): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccggtttaaaaaaccncctggtgcagtcgtggagctgagctgcagacgccgtgggcctgagtgagttcggtcctccgtgcgaggttgtcctttcgtggttactatttccttttacccaccgttacggttataggtaagtttggttagacgaccgtacgggccccggaggacggggtcttaggaggtggaggtgggagtggatcgaacgtcccggttaaacggaaactaaacgnggtagtagtaggaacgtaaggtacgttcggaagggacaaggtagtctatctagtccgaccggacggtacacgtactaccgaacggtacgtacgacgtaccgtaagtaacgtacggaacgtacggacggtaccgtaccgtacgagtacttacgtaggacccgaaccgacccgttaccttaacgtttaacgttaccgtacggtaccggtacgacggtagttaacgttttacgtacggtaaccgtttacggtaccgggtttacccgtacggttacccgtttaaccggaacccgttcccggtacggtttacgggtaccgggaccgg

SEQ ID NO: 29846 - DNA, 684 bp, Homo sapiens
  misc_feature: GYAE6OF02HNBF1.1.49.E05.1.454.CMB.1.raw
tcagacgagtgcgtcacgaccggtgctcgatttagagcgactagcaacgacacaaaggggacccaaaaaccacacccctccttcgggagaatcccctagatccacagctcctacaccatcggacgggacctggagcatccgttttcttggtggcagcagcaacaggtcgcccactcccaggttcacctcggtgcagtctggagctgaggctgcagaagcctggggcctcgagtgatggtctcctgcagtcgcttctggttacagttccttttaccaccttacgggtacttgtaactttggttagaggtacgtacgggcccccggaggacggggtcgttggaggtggagtgggagtagggagttcgaacgtccccgttaacggaactaaacgaggtaactagtaggaagtacgaacgttccgaagggacaggacgtacgacgtaccaattaccgacccggacggtaaccactaacgtacccgaaccggtacgtaaccgacgtacccttaacgaacgtacggaacgttgggaaggacggtaccgtacgaaggtactcgtacggaaccaccggaaccggtacctaacgtttacgttacgtcgccgtacgaggtagtactttaggtataccgttacgtcggttaccgtggtaccttacggtaaccgtcgtcgtttcggcggtacccgg

SEQ ID NO: 29847 - DNA, 609 bp, Homo sapiens
  misc_feature: GYAE6OF02HVL2J.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctggttacattcttttccacctacggtatgaattggttgagtacacggcccccggagaggggcttggagtggagtgggatggatcagccgttaacggaactaaacgagagtatggagagtaagtcgagggcagagtcatcatcgaccgacggacacgactaccacgacgtacacgacctaactacgtagaaaccgtggaagggacgccctagagtactcgtagaaccggaccaccgggaccctaacgtttacttaccgcggtaccgacggagtagtaacgtttacgttacggtaccttacggttcgggttacccgtacggtaccgttacgtaacccgtaccggttacgtttcgggtagggtacccgg

SEQ ID NO: 29848 - DNA, 566 bp, Homo sapiens
  misc_feature: GYAE6OF02G12RR.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggagtgggatgggatggatcacgccttacggaactaaacagagtagtggagagaagttcagggcagagtcatcatccaccgcggacacatccgacgacgtaacagtcctaacactggaactggaacggagccgtacagtactcaggaccgaccgaccggacctactttaagttactcggacgcgaagtagtattagtcggactacgtggttcccgtgggtcctaggttaacccgtaccggtcgtttacggtgggtacccg

SEQ ID NO: 29849 - DNA, 525 bp, Homo sapiens
  misc_feature: GYAE6OF02GNNRS.1.49.E05.1.454.CMB.1.raw
  modified_base (413)..(413): a, c, t, g, unknown or other
  misc_feature (413)..(413): n is a, c, g, or t
  modified_base (480)..(480): a, c, t, g, unknown or other
  misc_feature (480)..(480): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtattggttgagacaggcccccggaggagggggcttggagtggagtgggatggatcagccgttacggaactaaaacagagtagtggagagagtcaggcagagtcatcatcaccgcggacacactccacgagtacagacctanactggaactggagacgcctgagctctgacgacgacgacctacttactactgcgacgagagtattgtncacgtggtaccgtggtcgtacgtaccgacgtcttaggtcgtacgg

SEQ ID NO: 29850 - DNA, 646 bp, Homo sapiens
  misc_feature: GYAE6OF02GVMFQ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttactattttttccaccttacggtatgtaatttggttagagacacgggcccccggaggacggggtcgttggaggtggagtgggatggatcgacgcccgtaaggaactaaacagacgtagtaggagagaagtcgaggcagagtcatcatcgacgacgacacactccgaacgacgtaacgacgtacctaacgagtacggaacgtcggaacggacgtaccgtacgagtacgtacgtacgaccgaaccgaccggtacctaactttacgttaccgtacggaccggtacgaacgtaacgtacgtttacgttcggtacgttaccggtttcgggttacccgtcggtaccgttaacggttaacccgtaccggttaccggtttcgggtacggggtaccctaaccggggg

SEQ ID NO: 29851 - DNA, 554 bp, Homo sapiens
  misc_feature: GYAE6OF02J0UK5.1.49.E05.1.454.CMB.1.raw
  modified_base (450)..(450): a, c, t, g, unknown or other
  misc_feature (450)..(450): n is a, c, g, or t
  modified_base (481)..(481): a, c, t, g, unknown or other
  misc_feature (481)..(481): n is a, c, g, or t
  modified_base (485)..(485): a, c, t, g, unknown or other
  misc_feature (485)..(485): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctggttacagtcttttccaccttaggtactgaattggttgagacaggccccggaggagggcttgagtggatgggatggatcgagtcccgttacggaactaaaacagagtatgggagagtaagttccgagggtacaggagtcatcgatcaccgcgacacactcacgagtacagcctacagtaggaactggaggacgacctcgatacgtntacggacgacgaccgcgtaacttataccgtnccgngagacgtatttagtcgactcgttacggtccttggtacctacgtaacccgtagtcgttaggcggtaccgg

SEQ ID NO: 29852 - DNA, 708 bp, Homo sapiens
  misc_feature: GYAE6OF02JGCUN.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacggacctggagcattccttttcttggtggcagcagcaacaggtcgcccacctcccgaggttccaccgtggtgcagtcgtggagctgagctgcagaacgccgtggggcctcgagtgagtggtcctcctgcagtgcttcgtggttacattcttttccaccgttacggttatagtaagtttggttagagtacgaccggcccccggaggaggggtcttgaggtggagtgggagtggatcgacgtacccgttaaggaactaaaacgagtagtagtaggaagagtaacgtacggaggacagacgtacatcagtccgacgcggacactacctaccgaacggtacgtaacacggtacctaacgaacgtacggtaacctaggacggacgtacccgtacgaagtacctacggtacggaaccggaacccgtaaccgggacccgttaaactttaacgttaaccggtacgggacccgacggtaacggtacgttaagttttaccgttacggaacccgttaacggttccgggttacccgttagggtacctttaacccggtaaacccgtacccggtttcggtttacggggtaccgggtaacccggg

SEQ ID NO: 29853 - DNA, 631 bp, Homo sapiens
  misc_feature: GYAE6OF02F0VHG.1.49.E05.1.454.CMB.1.raw
  modified_base (360)..(360): a, c, t, g, unknown or other
  misc_feature (360)..(360): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttactatctttccacctatggtatgaattggttgagacaggcccccggaggaggggtcttggagtggagtggggatgggatcacgcccgttacggaactaaaacgagagtagnggagagaagttcgagggcagagtcactcactcgaccgcgacactactaccgagacgtacacgtacctacatacggaactggaaggtacgaccttacgacgtactacgaggaaccgaccgaccgggacccttaacgtttacttacgttaccgaccgggacgtaggtaacgtacgtttaacgttcggtaaccgttacccgttcgggttacccgttacgggtaccgtttaaccggtaacccgttaccggttaccggtttcgggttacccggggg

SEQ ID NO: 29854 - DNA, 620 bp, Homo sapiens
  misc_feature: GYAE6OF02JADXI.1.49.E05.1.454.CMB.1.raw
  modified_base (385)..(385): a, c, t, g, unknown or other
  misc_feature (385)..(385): n is a, c, g, or t
  modified_base (610)..(616): a, c, t, g, unknown or other
  misc_feature (610)..(616): n is a, c, g, or t
  modified_base (618)..(620): a, c, t, g, unknown or other
  misc_feature (618)..(620): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccactacggtatgaatggttgagacgacggccccggagaggggtcttggaggtggagtgggagtgggatcacgcccgtttaacggaaactaaaacgagtaacgtatggagaagagttcgagggcaagngtacgatacgataccgaaccgtacggacaccgtaactaccgaacgtaacgtaacacgacctacaacgtacggtaaccgtaggaacggtaacggtacctaccgtagtaacgtcgttacggaaccgaaccggaacccggtaccgttaaccgtttaaacgtttaacgttaccgggtaccgtaccgggaacgtaacgttaagtttaacgttcggtaaccgtttaaaccnnnnnnnannn

SEQ ID NO: 29855 - DNA, 669 bp, Homo sapiens
  misc_feature: GYAE6OF02G2KPM.1.49.E05.1.454.CMB.1.raw
  modified_base (472)..(472): a, c, t, g, unknown or other
  misc_feature (472)..(472): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgaattggttagagacgacggcccccggaggacggggtcttggaggtggagtgggagtggatcgacgtcccgttaacggaactaaaacgagtagtagtagggagtagaacgttacgagggacgaggagtacgatcagtaccgaccgcgacacactaccaacgacgtacgacgacctacgacgtacggaacgtaggaggtacnccgtacgaacgtacgttacgacgaaccggaaccggtacccgtacccgttaactttacgttaccgtacggtaccggacggtaaggtacgttaacgttttacgttacggtaccgttaccgtccgggttacccggtaggttacccgttaaccggttaacccgtaccggttaccggtttacgggtacgggttaaccccggg

SEQ ID NO: 29856 - DNA, 526 bp, Homo sapiens
  misc_feature: GYAE6OF02GAJ0X.1.49.E05.1.454.CMB.1.raw
  modified_base (510)..(510): a, c, t, g, unknown or other
  misc_feature (510)..(510): n is a, c, g, or t
  modified_base (519)..(519): a, c, t, g, unknown or other
  misc_feature (519)..(519): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggagtggatggggatgggatcagcccttacggaactaaaacgagagtatggagagaagttcgagggcagagtcatcatcacgcggacacatccagacgtacagacctacataggaacttggacggagcctcagatctgaaccgacacggcctacttattactgcgacgagagattagtgctacgtcggtcctggctcgtaaccncgtcttggnggtaccg

SEQ ID NO: 29857 - DNA, 530 bp, Homo sapiens
  misc_feature: GYAE6OF02HLVIZ.1.49.E05.1.454.CMB.1.raw
  modified_base (431)..(431): a, c, t, g, unknown or other
  misc_feature (431)..(431): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtgggatgggatggatcgagcccttacggaactaaaacagagtatggagagaagttccagggcagagtacgatcatcgaccgcgacacgataccacgagtacagcctacagtggaactgaggacncctcagatctagacgacacggccacttatactgcgacgagagtattatggactcgtacggtccgtggacctagtaacccgtacggtcttggcggtacgg

SEQ ID NO: 29858 - DNA, 519 bp, Homo sapiens
  misc_feature: GYAE6OF02GXOSJ.1.49.E05.1.454.CMB.1.raw
  modified_base (434)..(434): a, c, t, g, unknown or other
  misc_feature (434)..(434): n is a, c, g, or t
  modified_base (503)..(503): a, c, t, g, unknown or other
  misc_feature (503)..(503): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagacacgggcccccggaggagggggcttggagtggatgggatggatcagcccttacggaactaaaacagagtatggagagaagttacagggcagagtcatcatcaccgcggacacatccacgatacagcctacataggaactgaggagcctnagatctgacgacgacgccacttatactgcgacgagagtattatgactacgtggtcctggctcgtaaccncgtcttggtggtaccg

SEQ ID NO: 29859 - DNA, 568 bp, Homo sapiens
  misc_feature: GYAE6OF02H8J4N.1.49.E05.1.454.CMB.1.raw
  modified_base (504)..(504): a, c, t, g, unknown or other
  misc_feature (504)..(504): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtactgaattcggttgagtacacggcccccggagagggggcttggaggtggagtggggatgggatcagtcccttacggaactaaaacagagtatggagagaagttcagggcagagtacatcatacgaccgtacgacacatcccaacgaacgtacacgcctaacatacggaactgggaacgacgaccgtacgagattcgtagaaccgacgacgggacctacctttattacgtgaccgngagagatttacgtgactacgtcggtcctaggcttacggtaaccacgtcgtttcggtggtaccgg

SEQ ID NO: 29860 - DNA, 534 bp, Homo sapiens
  misc_feature: GYAE6OF02GOY9U.1.49.E05.1.454.CMB.1.raw
  modified_base (398)..(398): a, c, t, g, unknown or other
  misc_feature (398)..(398): n is a, c, g, or t
  modified_base (436)..(436): a, c, t, g, unknown or other
  misc_feature (436)..(436): n is a, c, g, or t
  modified_base (443)..(443): a, c, t, g, unknown or other
  misc_feature (443)..(443): n is a, c, g, or t
  modified_base (468)..(468): a, c, t, g, unknown or other
  misc_feature (468)..(468): n is a, c, g, or t
  modified_base (526)..(526): a, c, t, g, unknown or other
  misc_feature (526)..(526): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacacggcccccggagaggggcttggagtggatggggatggatcgagcccgttaacgggaactaaaacgagagtatggagagaagtccagggcagagtcatcatcaccgcgacacanccacgagtacagcctacatggaacctggacggagcctnagatcgngacgacaccggcctacttacttacngacgcgtagagattagtgcctacgtgggtcctggcttacgtaacccgacgtcgttggngggtaccg

SEQ ID NO: 29861 - DNA, 554 bp, Homo sapiens
  misc_feature: GYAE6OF02GTRW0.1.49.E05.1.454.CMB.1.raw
  modified_base (417)..(417): a, c, t, g, unknown or other
  misc_feature (417)..(417): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggagtgggagtgggatggatcaggcccttacggaactaaaacagagtatggagagaagttcagggcagagtcatcactcaccgcggacacatccgacgacgtacacgcctanacgtaggaactggaggagcctagagactctagaccgacgaccggtccctaacgttacttacgtcgacgacgagtacgtattagttcgactacgtcggtccgttggcttacggtaaccgacgtcgttggcggtaccgg

SEQ ID NO: 29862 - DNA, 584 bp, Homo sapiens
  misc_feature: GYAE6OF02HYM4R.1.49.E05.1.454.CMB.1.raw
  modified_base (396)..(396): a, c, t, g, unknown or other
  misc_feature (396)..(396): n is a, c, g, or t
  modified_base (399)..(399): a, c, t, g, unknown or other
  misc_feature (399)..(399): n is a, c, g, or t
  modified_base (439)..(439): a, c, t, g, unknown or other
  misc_feature (439)..(439): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttcgtggttacattccttttccacctacggtattgtaatttggttagagacgacgggcccccggaaggacgggggtcttggaggtgggagtgggagtggatcgacgtacccgttaacggaaacgtaaacgagagtagtaggagagtagtcgaggnagngacatcatcgaccgcgacacactccagagtacagtcctanacgtggaaacgtggagacgctacgacgtactcgaggaccgacgaccggacctacctttagtaccgtagccggacgagtacgtagtttagtcgacttacggtcgtcgttggtacttacgtaccgtacgttcgttggtcggtaccgg

SEQ ID NO: 29863 - DNA, 568 bp, Homo sapiens
  misc_feature: GYAE6OF02GU4SP.1.49.E05.1.454.CMB.1.raw
  modified_base (500)..(500): a, c, t, g, unknown or other
  misc_feature (500)..(500): n is a, c, g, or t
  modified_base (562)..(562): a, c, t, g, unknown or other
  misc_feature (562)..(562): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagtacacggcccccggaggacgggggcttggagtgggagtgggatggatcagcccttaacggaactaaaacagagtagtagggaggaagtacgtacggaggagagtagtacatacacaccgaccggacgacacactacgacgacgtaacacgtacactacgacgacgtaggaggacgtcctacgagtatcgagaccgacgaccgactacttacttcncgacgacgagtagttattagtcgtactcggtcgtcgtcgtctacgtaccgtcgtcgttcggngtccgg

SEQ ID NO: 29864 - DNA, 756 bp, Homo sapiens
  misc_feature: GYAE6OF02GPIW0.1.49.E05.1.454.CMB.1.raw
  modified_base (225)..(225): a, c, t, g, unknown or other
  misc_feature (225)..(225): n is a, c, g, or t
  modified_base (518)..(518): a, c, t, g, unknown or other
  misc_feature (518)..(518): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggccccagtagngtaggtcgtccttcgtcgacgtagtcgtcttcggttacgtactctttccctttaccctaaccggttaacgtagtaagttaggtttggtacgtaacgacggacccccggggcccggaaggggtacgggttcgtaggtaggtacggtagggtagggtaggtaggtacgacgtacccgttaacccggtaaaccggtaaaaacctaaaagacggtaagttaggagggtaagaaggttaaccgtacgggacggtacgaaggtacgactactactacgtaccgaccggacgtaaccaanccgtaccggaacgtacgtaagacctacctaagtaggaacctagggaacgggaagcccgttaccgaagtacgtctaggtacccgaaagtacccggaacccgtactttaacgtttaacgttaccgcggtaccgaaggacgtagttaacgtttacgtaccgaccgttacgggttccggttaccgtacggtaccgttaaccggtaaaccccgcggtttacggttcggggaccggtaacccgg

SEQ ID NO: 29865 - DNA, 671 bp, Homo sapiens
  misc_feature: GYAE6OF02IV8EN.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagccgtgggcctcagtgatggtctccgtgcagtgcttcgtggttacagttctttccacctacggtatgtagttggtgagacgacgggcccccggtaggacggggcttggaggtgggagtgggagtggatcgaccggtacccgttaacgggaaactaaaaacgaggtaagtaagtaggaaggaaggtaacggttaccgaagggtacgaaggacgtacacgtacacgtaccgaccggacggaaccaaccgtacgtacccgaacgtaacgtaccgtaacgacccgttaacaacgtacgggaacgtaggacggtacgccgtacgagtagtaccgtacggaacgaccgaccggaccttacgtttacttacgtacggaccgtacgaacgtagtaacgtttacgtcggtacctacgttcggtccgtacggtacgttaccggttaacccgcggttcgttacggtcggtaccgg

SEQ ID NO: 29866 - DNA, 651 bp, Homo sapiens
  misc_feature: GYAE6OF02IX8ZM.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagtacagggcccccggtaggacgggggtcttcggaggtgggagtggggagtggagtcgacgtcccgttaacggaaactaaaacgagagtaacgttggaagaagtaaggttaccgagggcaaggagtcatcactcgaccgcgacacactaccaacgacgtacacggtacctaactagtggtaaccgttaggaagggacgacccgtcgaaggacttcgtaggaacccgaaccgtaaccggacccgtaactttaacgttacctaggaccgtacgaacgtaggtaatttacgtcggtacctaaccgttcgggtttacccgtggtccttaccggttaaacccgaccggttaccggttcggtcgggtaccccggg

SEQ ID NO: 29867 - DNA, 514 bp, Homo sapiens
  misc_feature: GYAE6OF02GAXBT.1.49.E05.1.454.CMB.1.raw
  modified_base (508)..(508): a, c, t, g, unknown or other
  misc_feature (508)..(508): n is a, c, g, or t
tcagacgagtgcgtcacgaccggtgctcgatttagagcgactagcaacacacgaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccactacggtatgaattggttgagacaggcccccggagaggggcttgagtggatgggatggatcagcccttacggaactaaaacagagtatggagagaagttccgagggcagagtcgatcatcacgcggacacgatccgacgagtacagacctacatggaactgaggagcctacgagatctgacgacacggcctattatactgcgtcgagagattagtgctactggtactggctgtaacctcgctttcgnggtacg

SEQ ID NO: 29868 - DNA, 531 bp, Homo sapiens
  misc_feature: GYAE6OF02G8C05.1.49.E05.1.454.CMB.1.raw
  modified_base (383)..(383): a, c, t, g, unknown or other
  misc_feature (383)..(383): n is a, c, g, or t
  modified_base (397)..(397): a, c, t, g, unknown or other
  misc_feature (397)..(397): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (461)..(461): a, c, t, g, unknown or other
  misc_feature (461)..(461): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcctttccacctacggtatgaattggttgagacacggcccccggagagggggcttggagtggagtgggatggatcacgtcctacggaactaaacagagtatggagagaacgttcgaggcgagagtacatnatcacgcgacacanccagagtacagcctananagaactggagacgctganatcngaccgacacggctacttatacgtncgcgagagtattagtgctacgtcggttccgtaggtccttagtaacccgtacgtcgttcggtcgggtacgg

SEQ ID NO: 29869 - DNA, 563 bp, Homo sapiens
  misc_feature: GYAE6OF02GJ05N.1.49.E05.1.454.CMB.1.raw
  modified_base (546)..(546): a, c, t, g, unknown or other
  misc_feature (546)..(546): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccaccttacggtatgtaattggttgagacacgggcccccggaggaggggcttggagtggagtgggatggatcgagtcccttacggaactaaacagagtatggagagaagtcgaggcagagtcatcatccgaccgacgacacactaccgaacgagtacagacctacagtaggaacgtggaggacgcctacgagactcgtagaccgacgaccgacctaactttagttacctcggacgacgagagttattagttcgactacgtcggttccgtggtccgttacgtaacccncggtcgttggcggtacg

SEQ ID NO: 29870 - DNA, 775 bp, Homo sapiens
  misc_feature: GYAE6OF02J08PC.1.49.E05.1.454.CMB.1.raw
tcagacgagtgcgtcacgaccggtgctcgatttagagcgactagcaacacacaaaggggaccaaaaccaacacccctccttggagaatcccctacgatcacagctcctcaccatggacgggacctggagcatcctttcttggtggcagcagcaacaggtgcccactcccaggttcacctggtgcagtctggagctgagctgcagaagcctggggcctcgagtgatggtctcctgcagtgcttctggttacatctttccacttacggtatgtaattcggttgtagacacgggccccccggtaggtagggggcctttaggaggtggagttggggattagggatcgaggaccccgttagggaaaccttaaaacgacgagtaacgtagggtagagtaaacggttccgaagggacaggtacgtacaacgttaccaacgttccgacccggtacgggacaacgtactacccgtaacgaacgttaccgaaggtcccttaaacgacgtaacgggtaacctacgggtaagggtaaccgtcccgttaacgaggtacttaccggtaggtaaaccggaaccggaacccgggtccctaaaccggtttttaacgttaacccgttacgggacccggtaacggggtaacccggtaggttaaccgtttttaacgttaacgggtaccggttaacccggttaccggggtttcccgttaacggggggttaccctttaacggttaaacccccgttaacgggtttcccgtttacgggggttccgggttaacccccggg

SEQ ID NO: 29871 - DNA, 712 bp, Homo sapiens
  misc_feature: GYAE6OF02IDU47.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctccgtgcagtgcttctggttacattccttttccacctacggtatgaattggttgagtacacggcccccggaggaggggtccttggacggtgggacgtggggactgggactcgacggtccccgtttaacggaaacttaaaacgaggtaacggtagtagggaagaaggtaacggttccgaaggggtacaaggacgtacgaataccgaactaccgacccgggcggtaacacacgttacccgaacggaacgtacaacggtaccctaacgagttacggaactagggtaacggacgtacccgtacgaagtacgtgtaaccggaacgtaaccgaacccgggtccctaaacgtttacttaccggtacggaccggacggtaacggacgttaagtttacgttacgaacccgttacggtacgggttacccgtacgggtaccgttacggttaaaccccgtacggttaccggtttacgggtccgggtaacccggg

SEQ ID NO: 29872 - DNA, 561 bp, Homo sapiens
  misc_feature: GYAE6OF02IFNKT.1.49.E05.1.454.CMB.1.raw
  modified_base (219)..(219): a, c, t, g, unknown or other
  misc_feature (219)..(219): n is a, c, g, or t
  modified_base (550)..(550): a, c, t, g, unknown or other
  misc_feature (550)..(550): n is a, c, g, or t
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtgcccactcccaggttcacctggtgcagtctggagctgagctgcagaagcctggggcctnagtgatggtctcctgccagtgcttctggttacatcttttccacctacggtatgaattggttgagacagggcccccggagacgggggccttggaggtgggagtggggatggatcagcccttacggaactaaaacagagtatggagagaagtcagggcagagtcatcatcacgcgacacatccgagagtacagacctacataggaactcgaggagccgtcaagatcgtagacgacaccgggacctacttacttactgcgaccgagagtagtttaagttcggactacgttcggtaccgttgggtcctacggttaaacccacggtcctttcgggngggtacccggg

SEQ ID NO: 29873 - DNA, 615 bp, Homo sapiens
  misc_feature: GYAE6OF02GMVFR.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctgggcctcagtgatggtctcctgcagtgcttctggttacattcttttccacctacggtatgtaattggttgagacacggcccccggagaggggcttggagtgggagtgggatgggatcgacggtacccgttaacggaaactaaaacgagtaacgtagtggaagagaagttcgagggacgagagtcatcatccgacgcggacacgactaccgacgacgtacacgacctaacagtacggaacgtagaggacgcctacagatctagaccgacgacggtcctaactttaacttaccgtaggaccgacggagtagtacgttttagtacggtccttaacggttccggttaccgttcggtaccgtttaccggtaaacccgtaccggttaccgtttcgggtcggtaacccggg

SEQ ID NO: 29874 - DNA, 520 bp, Homo sapiens
  misc_feature: GYAE6OF02GE7NS.1.49.E05.1.454.CMB.1.raw
  modified_base (381)..(381): a, c, t, g, unknown or other
  misc_feature (381)..(381): n is a, c, g, or t
  modified_base (389)..(389): a, c, t, g, unknown or other
  misc_feature (389)..(389): n is a, c, g, or t
  modified_base (413)..(413): a, c, t, g, unknown or other
  misc_feature (413)..(413): n is a, c, g, or t
  modified_base (437)..(437): a, c, t, g, unknown or other
  misc_feature (437)..(437): n is a, c, g, or t
  modified_base (502)..(502): a, c, t, g, unknown or other
  misc_feature (502)..(502): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctaccggtatcgaaattggttgagacaggcccccggagagggggcttggagtggatgggatggatcagcccttacggaactaaaacagagtatggagagaagttccagggcagagtcatnatcaccgnggacacatcacgagtacagcctanatggaactgaggacgctcagatcngacgacgacggccacttattactgcgcagagattagtgacacgtcggtcctggcctagtaacccncgtacgtttgcggtaccg

SEQ ID NO: 29875 - DNA, 582 bp, Homo sapiens
  misc_feature: GYAE6OF02HV8Z9.1.49.E05.1.454.CMB.1.raw
  modified_base (252)..(252): a, c, t, g, unknown or other
  misc_feature (252)..(252): n is a, c, g, or t
  modified_base (409)..(409): a, c, t, g, unknown or other
  misc_feature (409)..(409): n is a, c, g, or t
  modified_base (431)..(431): a, c, t, g, unknown or other
  misc_feature (431)..(431): n is a, c, g, or t
  modified_base (559)..(559): a, c, t, g, unknown or other
  misc_feature (559)..(559): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacnttcttttccacctacggtatgaattggttgagacaggcccccggagaggggtcttggaggtgggagtgggatgggatcgacgtcccgttaacggaactaaaacgagacgtatgggagaagtaagttccgagggcagagtcatcatcgaccgcggacncatccacgagtacagtacctanacgtaggaacttggacggacgcctacagactctacggaccgacgaccggtacctaacgtttacttaccgtgccgacgagacgtattagtcgtaccgtactcgggttccgtggtacctacggtaacccncggtacgttgggtcggtacccgg

SEQ ID NO: 29876 - DNA, 566 bp, Homo sapiens
  misc_feature: GYAE6OF02F3ZTO.1.49.E05.1.454.CMB.1.raw
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
  modified_base (439)..(439): a, c, t, g, unknown or other
  misc_feature (439)..(439): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggggcctcagtgatggtctcctgcagtgcttctggttacatcttttccacctacggtatgaattggttgagacacggcccccggaggaggggcttggagtggatgggatggatcagcccttacggaactaaacagagtanggagagagttccgaggnagagtcatcatccgacgcgacacgactccacgagtacagcctacagtacggacgtggaggagcccgtanacgagttcgtaggaccgacgaccggtacctaacgtttacttaaccgtgcgacgaagagtagttagttcgactacgttcggttaccgtggacttcggtaaaccctacggtcctttggtcgggtaccgg

SEQ ID NO: 29877 - DNA, 578 bp, Homo sapiens
  misc_feature: GYAE6OF02GUL9O.1.49.E05.1.454.CMB.1.raw
  modified_base (492)..(492): a, c, t, g, unknown or other
  misc_feature (492)..(492): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgtaattggttgagacgaggtcccccggagacggggcttggagtggatggggatggatcgacgtcccttaacggaactaaaacgagagtagtggagagagttcgaggcagagtcatcatcacgcgaacacactccaacgacgtacacgtacctaacagtacggaactggaacggacgccctacagtactcgtgaaccgacgaccggcctaactttacgttacngtaccgacgagagtattagttcgactaccgttaggtccctgggtaccttacggtaacccctacggtacgttacgggtcggtaccgg

SEQ ID NO: 29878 - DNA, 606 bp, Homo sapiens
  misc_feature: GYAE6OF02HEFX4.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctggttacattcttttccacctacggtatgtaattggttgagacacgggcccccggaggacgggggcttggagtggagtgggatggatcgacgcccttacggaactaaacagagtatggagagagttcgagggacagagtcatcatcaccgcggacacactccaacgacgtacacgacctacagtaggaactggaaggacgcctagacgactcgtaggaccgtaaccgaccggtaccttaacgttacttaaccgtcggaccggacggtagtagttacgtttacgttcggtacctacggttacggttccgtcgggtaccgttacggttaaccccgacggttaccggttcgggttcggggtaccgg

SEQ ID NO: 29879 - DNA, 533 bp, Homo sapiens
  misc_feature: GYAE6OF02GPCD1.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggtgagacacggcccccggagaggggcttggagtggatgggatggatcagtcccttacggaactaaacagagtatggagagagtacgagggcagagtcatcatcacgcgacacataccacgagtacagcctacatggaactggaggacgcctcgatacgtctagacgacacggacctacttacttacgtcgcgacgagagtattacgtcgactacgtgtccgtgacgttacgtaaccgcgtcgttcggtggtaccg

SEQ ID NO: 29880 - DNA, 734 bp, Homo sapiens
  misc_feature: GYAE6OF02IVXDV.1.49.E05.1.454.CMB.1.raw
  modified_base (255)..(255): a, c, t, g, unknown or other
  misc_feature (255)..(255): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctccgtgcaggtgcttctggttacnttcgtttccacctacggtatgtaagttggttgagacgtacgggcccccggaaggtacggggtcttggagtgggtaagtgggatggtagtcaggaccccttaacggaaactaaaacgagtaagtacgtagggaagaagtaacgttccggaagggtacgaggtacgtacgtaagtaccaagtaccgaaccggacgaactacgtacttacccggaacggtacgttaacgacgtacctaacgtacgttaacgggaacttagggaacggtacgttacccgtacgtaaacggacgttacggtaacggtaacccgaacccggtaaccggtaacctaaccgttttaactaacccggttcgaccggtaccgaacggtaagttacctttaacggttcgtaaccggtaccgttacgggtacccgttacgggttaaccgttaccgggttaacccctaccggtttacggtttcgggtacccggtaacccggg

SEQ ID NO: 29881 - DNA, 510 bp, Homo sapiens
  misc_feature: GYAE6OF02G0J5F.1.49.E05.1.454.CMB.1.raw
  modified_base (408)..(408): a, c, t, g, unknown or other
  misc_feature (408)..(408): n is a, c, g, or t
  modified_base (503)..(503): a, c, t, g, unknown or other
  misc_feature (503)..(503): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccaggcagagtcatcatcacgcggacacatccacgagtacagcctanatggaacttgaggagcctcagatctgacgtacacggccaacttattactgacgcgagagattatgcactggtcctggctgtaaccacgctttggnggtaccg

SEQ ID NO: 29882 - DNA, 658 bp, Homo sapiens
  misc_feature: GYAE6OF02GRPNP.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacattctttccacttacggtatgtaattggttgagacacggcccccggagacgggggtcttggacggtggagtgggatggactcgacggtacccgttaacggaactaaaacgagtaacgtagtggaagtagaacgttaccgagggacagtacgtacagtactacgtccgacccggacggaccaacgtacgtacccgaacggtacggtaccgtacgaccttaacgtagtacggtaacgttaggacggacgtccgtacgagtacgttacgtaccggtaacgaccgtaccgggtacctaaccgtttacgtaccgtacggaccgtacggtacgtagtacgtttacgtcgtaccgtacgtcggttaccgtacggtacgtacggtaaccgtacggtcgttacgggtacggtaccgg

SEQ ID NO: 29883 - DNA, 600 bp, Homo sapiens
  misc_feature: GYAE6OF02H2MP7.1.49.E05.1.454.CMB.1.raw
  modified_base (244)..(244): a, c, t, g, unknown or other
  misc_feature (244)..(244): n is a, c, g, or t
  modified_base (299)..(299): a, c, t, g, unknown or other
  misc_feature (299)..(299): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgaaggtttcctgcaaggccttnaggatacaccttcactaggtatgctatacagttgggtgcgtccaggcccccgganaaacggtcttggacgttggagtgggatggaatcgagtcccttaacgggaaactaaaacgagtaagtataggagaggaagttccgagggtacagagtcatcatcaccgcgaacacataccgaacgagtaacaggaccctaacagtacggaactggaaggacgtaccctagaggacttcgtacggaccgacgaccgggacctaaccgttattacgtcgaccgtaccgaagacgtaactttagtcgactacgttcgggtcctaggtcctaaggtaacccgtcggtacgtttggtgggtacccgg

SEQ ID NO: 29884 - DNA, 512 bp, Homo sapiens
  misc_feature: GYAE6OF02F7YB8.1.49.E05.1.454.CMB.1.raw
  modified_base (348)..(348): a, c, t, g, unknown or other
  misc_feature (348)..(348): n is a, c, g, or t
  modified_base (462)..(462): a, c, t, g, unknown or other
  misc_feature (462)..(462): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggagtggagtgggatgggatcagcccttacggaactaaaacngagtatggagagagttccagggcagagtcatcatcgacgcgacacatccacgagtacagcctacataggaactgaggagcctcagatcgtgacgacacgccattatactgacgngagagattagtgctacgtggtcctggctgtaaccctgcgttggcggtacg

SEQ ID NO: 29885 - DNA, 564 bp, Homo sapiens
  misc_feature: GYAE6OF02JBQCM.1.49.E05.1.454.CMB.1.raw
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttcacctacggtatgaattggttgagtacacggccccggagaggggcttgagtggatgggatggatcgagccttacggaactaaacgagagtatggagtagaagttccgaggcagagtcgatcatcacggcgtacacataccacgatacagcctanangaactggagtaacgcctnagtntacngtacgacacgggcctaacgttatacctaggaccgtacgaaggactaagttacgttcgaacgtacgttgggtacccttagggtacgttccgtaaaccgtcggtacgttccgggagggtaacccgg

SEQ ID NO: 29886 - DNA, 698 bp, Homo sapiens
  misc_feature: GYAE6OF02J2D46.1.49.E05.1.454.CMB.1.raw
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacntctttccactacgtntgatgttgagcaggccccgagagggctgagtggactggatgggatcgaggtacccttacggaactaaacgagtagtagtcggagagaacgttccgagggcagagtctatcgtatcgaccgcggacacactcccgtaagacgtaacgtacgacccgttaacaacgttaggaacccgttagggaacgggtaaccgtccccgtaacgtacggtaacggtttaccgtacggaacccggaaccgtaaacccccggggtaccctaacgtttttaaacccgttaaccgttacggtaccgggaacgggtaacccgggtattaacggttttaaccggtttcggtaccttaaccggttacgggttcccgtaccggttaacgtttacccggttaaacccggtaccggtttaccgtttaacggggtccggggttaaccccggg

SEQ ID NO: 29887 - DNA, 688 bp, Homo sapiens
  misc_feature: GYAE6OF02HBUX5.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctcctgcagtcgtcttcgttggttactattccttttacccaccgttacggttattgtaattgggttagaggacgtacggacccccgggaggacgggggtccgttggaggttcgggaagtggggtagtgggactacgacggtacccgttaacgggaaactaaacgagagtataggagagtaacgttcgaggacgaggagtacgatacacgtacgaccggacggacacactaccgaacgacgtacgacgtaccctacaagtacggaacgttagggaacggaccgtaccgtacaaggtacctaccgtaggaaccgtaccgaccggtaccctaaccgtttaactttaccggacgaccgtaggtaacgagttacgtttaacgttcggacctaaccggttcggttaccgttacgggtacttaccggtaaacccgtcggtttaccgttagggtccgggtaacccgg

SEQ ID NO: 29888 - DNA, 555 bp, Homo sapiens
  misc_feature: GYAE6OF02FU7C9.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgaattggttgagacaggccccccggaggaggggcttggaggtggatggggagtggatcacgcccttacggaactaaacgagagtataggagagaacgttcgagggcagagtcatcatcacgacggacacatccgacgagtacagcctacatcggaactgaggagcctcgagactcgtagacgacacggcctacttacttacgtcgacgcgagagtattacgttcgactaccgtggttccgtggtccgtacggttaacccgacgtacgtttcgggtggtacccgg

SEQ ID NO: 29889 - DNA, 561 bp, Homo sapiens
  misc_feature: GYAE6OF02F34OQ.1.49.E05.1.454.CMB.1.raw
  modified_base (383)..(383): a, c, t, g, unknown or other
  misc_feature (383)..(383): n is a, c, g, or t
  modified_base (496)..(496): a, c, t, g, unknown or other
  misc_feature (496)..(496): n is a, c, g, or t
  modified_base (553)..(553): a, c, t, g, unknown or other
  misc_feature (553)..(553): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccactacggtatgtaattggttgagacgacggcccccggaggaggggtcttggacggtgggagtggggatggatcgacgtcccgtaacggaactaaaacagagtagtggagagtaagttcgaggnagagtcagtcagtccacgacggacaacgactccgaacgtacgtacgacgcctaacagtacggaacgtaggacggacgcctacgagatcgacgacgaccacggctacttatacncgacgcgagtagattagtgactacgtcggtcgtgcctacgtaaccgtcgtcgttggnggtaccgg

SEQ ID NO: 29890 - DNA, 549 bp, Homo sapiens
  misc_feature: GYAE6OF02F6THK.1.49.E05.1.454.CMB.1.raw
  modified_base (411)..(411): a, c, t, g, unknown or other
  misc_feature (411)..(411): n is a, c, g, or t
  modified_base (541)..(541): a, c, t, g, unknown or other
  misc_feature (541)..(541): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggggcctcagtgatggtctcctgcagtgcttctggttacattcttttccaccttacggtatgtaattggttgagacgacggtcccccggaggaggggcttggagtggatgggatgggatcagcccttacggaactaaacagagtataggagagtacgttcgagggcagagtcatcatcacgcgacacatcacgagacancctaacatggaactggaggacgccgtacagactcgtagacgacgaccgggtaccacgtttaacttacgtcgaccgacgagtagattagttgcctacgtcggtcgtcggactacggtaaccaggtcttggngggtaccg

SEQ ID NO: 29891 - DNA, 610 bp, Homo sapiens
  misc_feature: GYAE6OF02GUJ1G.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccactacggtatgtaattggttgagtacacggcccccggaggaggggcttggagtggagtggggatggatcgacgccgttacggaactaaacgagagtagtaggagagaagttccgaggcagagtcatcatcacgcggacacagtccaacgagtacagcctacagtaggaactgacggacgccgtacagtactcgtagaccggtacgaccggccctaacgtttacgttaaccgtacggaccgtcggtaagtacggttaacttttaacgttggtacccgtacgttaccgggttcccttcggggtacccttacggttaaacccctacggtcgtttacgggtccgggtaacccgg

SEQ ID NO: 29892 - DNA, 618 bp, Homo sapiens
  misc_feature: GYAE6OF02GR9JC.1.49.E05.1.454.CMB.1.raw
tcagacgagtgcgtcacgaccggtgctcgatttagagcgactagcaacacacaaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgtcttcgtggttacattcttttccacgtacggtatgtaattggttagagacgacggccccggtaggacggggcttggagtgggacgtggggagtggatcacggtccgttaacggaactaaaacgagaagtagtggagaaggaagttaccgagggcaggagtacagtacatccgacgcggaacacgaactccacgtacgtacacgacctaacgagtacggtactaggaggacgtccgtacagtactcgtacggaaccgacggtaccgaccctaacgttaacttacgtcggacggacgtacgagttacgttaagtcgaccgtacgtcggttccgtggtaccttacggtaacccgtacggttccgttgggtcggtacccgg

SEQ ID NO: 29893 - DNA, 632 bp, Homo sapiens
  misc_feature: GYAE6OF02IY6JJ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctggttacattctttccacctacggtatgtaattggttagagacacggcccccggaggaggggcttggagtggagtgggatggactcgagcccgttaacggaaactaaaacgagagtaagtgaacgagtaagttaccgaggacgagagtacatacagtacaccggcgaacactacgtaccgaacgacgtacgacgaccttaacgacgtacggaacgtaggacggacgacctagacgtactctacggaccgaacgtaccgggacctaacgtttaacgtaccgtcggaccgagaacgtacgttaagtttacgtcgtaaccgtcgttaccggtcccggttaggtcccgttaacggtaaccccgtaggttaccgttgggttaccgggaacccgg

SEQ ID NO: 29894 - DNA, 695 bp, Homo sapiens
  misc_feature: GYAE6OF02IKS5K.1.49.E05.1.454.CMB.1.raw
  modified_base (671)..(671): a, c, t, g, unknown or other
  misc_feature (671)..(671): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctccgtgcagtgtcttcgtggttactattccttttccaccgttacggtatgtaatttggttgagtacgaccggcccccgggtaggacggggtcttggaggttgggagtggggagtggagtccgacgtcccgttaacggaaaactaaaacgagtaagtagtacgggagtaaggtaacgttccggaagggcgaaggacgtacgtaattacgtacgtaccgtacccggacgaaccacgaccgttacccgaacgaacgtaccacgaccctaatacggtacgggtaaccagggtaacggacgtacccgttacgaggtaccgttgtacggaacccgacgtacccggtaacccttacgtttaacttacgcggaccgtacgtaagacgtttaacgtttacgtgtaaccctacggttcggttacccgtaggtcccttacggttaacccgngtttacgttccgggaggtacccgg

SEQ ID NO: 29895 - DNA, 616 bp, Homo sapiens
  misc_feature: GYAE6OF02IRL45.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagtacacggcccccggaggaggggcttggaggtggagtggggatgggatcgacgtcccgttaacggaactaaaacgagagtagtaggaagagtaagttccgaggcgagagtacatacatccgaccgcggaacacactacacgacgtacacgtcctaacgagtacggaacgtaggacggtaacgccctagaacgtctacgtacgtaaccgaccgaccggtaccctaactttaacgttacgcgtacggacgacggtagtacgtttagttcgaccttacggttacggtccgttaggtccgtacggtacccgtacggtcgttcgggtcggtacccgg

SEQ ID NO: 29896 - DNA, 579 bp, Homo sapiens
  misc_feature: GYAE6OF02HR21R.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttctggttacattcttttccaccttacggtatgaattggttgagacacggcccccggaggaggggtcttggaggtggagtgggatggatcgagtccttaaggaactaaacgagagtatggagagaagttcgaggtcagatcatcatccgaccgacgacacacgtaccacggatacaacgcctaacagttaggaacttaggacggacgtcctacgagactcgtagaacgtaccaaccggtacctaacttagtacctggacgacgagagtacgttatcggtacaacgttggttcctacgggtacttacggtaaaccctcggttcgttcggtcggtacccgg

SEQ ID NO: 29897 - DNA, 648 bp, Homo sapiens
  misc_feature: GYAE6OF02IKYTF.1.49.E05.1.454.CMB.1.raw
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtgcccactcccaggttcacctggtgcagtctggagctgagctgcagaagcctgggcctcagtgatggtctccgtgctagtcgcttctggttacattcttttccacctacggtatgaattggttgagtacaggcccccggagacggggcttggaggtggagtgggagtggatcgagtacccgttacggaactaaaagacgtaggtatagggagtagtaacggttccgagggtcaagagtacagtcacgtcaccggtacggacgactacgtcccgaacgacgtaccacgtacctacgacgtacggaacgttagacgggtacgccgtacaggacgttactcggtaacgaccgaaccggtacctaaccgtttaacgttacgttacggacgtacggaacggtagtaagtttacgttacggacctacgttcgggttacccttagggacccgttacggtaacccgtaccgggttacgttcggtacgggtacccggg

SEQ ID NO: 29898 - DNA, 707 bp, Homo sapiens
  misc_feature: GYAE6OF02I68UT.1.49.E05.1.454.CMB.1.raw
tcagacgagtgcgtcacgaccggtgctcgatttagagcgactagcaacacacaaagggacccaaaaccacaccctccttggagaatccctagatcacagctcctcaccatggacggacctggagcatccttttcttggtggcagcagcaacaggtgcccactcccaggttcacctggtgcagtctggagctgagctgcacgaagcctggggcctcagtgatggtctcctgcagtgcttcgtggttacattcttttccaccttacggtactgtaacttggttgagtacacgggcccccggtaggacggggtcttgaggtcggagtgggatggatcgacggtcccttaacggaacttaaaacgacggtaagtagtacggaagtaacggtaacgttccggaagggtcgaaggtacgtacgtactacgtacgtccgaacccggtacgaaccgtaccgtaacgttacccgaacggtacgtaacgaaccgtacctaacggtagtaacggtaacgttaggaacggtaccgtaccgtactaacggacttacgtaccggaaccgaacgtacccgtaaccgtaacttttaacgtaccgtacggtacccgaacggtaacgtagttaacgtttacgttacggtccctaacggttccggttacccggtggtaccgttaccggtaacccgtacggttcggttaccgggtcgggtaacccgg

SEQ ID NO: 29899 - DNA, 682 bp, Homo sapiens
  misc_feature: GYAE6OF02JAM19.1.49.E05.1.454.CMB.1.raw
  modified_base (288)..(288): a, c, t, g, unknown or other
  misc_feature (288)..(288): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagacncggccccggagaggggcttgagtggagtgggatggatcagcccttaggaactaaacagagtatagggagagaagttccgaggtcgagtagtcatcaatccaccgcggaacacactaccgacgaacgtaccgacgtaccttaacgacgtacgggaaacgttacggaaggggtaaccgtcccgttacgaaggtacgttccgtaaggaacccggtaccgaacccgggtacccttaaaccctttaacgttttaccgtacggaccggtaccggtaacgacggttaagttttaacgtttcggtacccttaacccggtttcggtttaaccccgttaggggttacccgttaccggttaaacccgtaccggttacccgtttacgggttacggggtaaccccgg

SEQ ID NO: 29900 - DNA, 738 bp, Homo sapiens
  misc_feature: GYAE6OF02J2SRX.1.49.E05.1.454.CMB.1.raw
  modified_base (197)..(197): a, c, t, g, unknown or other
  misc_feature (197)..(197): n is a, c, g, or t
tcagacgagtgcgtcacgaccggtgctcgatttagagcgactagcaacgacacaaaggggacccaaaaaccgacacccctccttgggagaatcccctagatcacagctcctcaccatggacgggacctggagcatcctttcttggtggcagcagcaacaggtgcccactcccaggttcaccgtggtgcagtctgganctgagctgcagagccgtggggcctcgagtgagtcggtctcctgaccagtcgtcttcgtggttactacttcctttaccaccgttacggtattcgtaacgttgggttagacgaccggaccgggcccccgggaggtacgggggtctttaggaggttggaggttaggggtacgtagggtactacgtacggtacccgttaacgggtaaactaaacgaggtacgtagtagggaaggtaggtaacgttcggaggacgagtacgtacacgtccgtacgtaccgaacccggtacggaaccgtaccgtaccgttaacccggtaaaccggtaacgtacccgaaccgtacccttaacgtaacggtacggtaaccgagggtaaccgggtacgacccgttagacgtacggtcgtaacggaccgaccgtaccgtacccgttaagtttaccgtaccggtacgaccgacgttaacggacttcgtttacgtcggccgttacgtccggtaccgtcggtacgttacccggaaccttacggtcgttacgggacggtacccgg

SEQ ID NO: 29901 - DNA, 672 bp, Homo sapiens
  misc_feature: GYAE6OF02JBUY8.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctggttacatcttttccacctacggtatgtaatttggttagagacgacgggcccccggagacggggtcttggaggtggaggtgggagtggtatcgacgtacccgttaacggaaactaaaacgaggaagttagtacggaagtaagtaacggttaccggagggacgaaggtaacgtacgaacgtaccacgtaccgacccggacggaaccaaccgtacgtacccgaacggtaacgtaacgaccgaccctaacgacgtacggtaacgtacggacggacgtccgtacgtacgacttcgtacggaccgaaccgaccgacctacgtttaacgttaccgtcggaccgacgtaagtagttacttagttacgacgtacgttcgggttaccgtaggtccgttaacggtaacccgtacgttccggttaggtacggtacccgg

SEQ ID NO: 29902 - DNA, 578 bp, Homo sapiens
  misc_feature: GYAE6OF02F6J01.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctggcagtgcttctggttacatctttcacctacggtatgaacttggttgagactaggcccccggagacggggcttgagtggatgggatggatcagcccttacggaactaaacagagtatggagagaagttccgagggtcagatcatcatccacgcgacacactccgaacgagtacacgcctaacgatacggaacttggaagacgacctacgacgatcgtagtaccgacgaccggaccaactttacgttacgtcggtccgacgacggagtaattacgtttggacttacgtcggttacccgtggaccgttacggtaacccgtaccgtcgtttacggtcgggtacccgg

SEQ ID NO: 29903 - DNA, 663 bp, Homo sapiens
  misc_feature: GYAE6OF02HPQ1X.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggttacatctttccacctacgtatgtattggtgagacgacggcccccggaggacggggtcttggaggtggagtgggagtggatcgacgtacccgttaacggtaaacctaaaaacgacgtaggtaacgtagggaagtaggtaagttaccgaaggggacaggtacgtacgaacttcgaactccgaacccggtaccgggaaccaacgtactacccgaacggtacgtaaccgagtaaccctacgtaacgtacggaaaccgttaggaacgggacgtcccgtacgaacgtactacgtacggaaccgaccgtaccggaccctaacgtttacgttacgtacgcgacgaagtacgttatttagtcgacgtacgtcggtccgttcggacgttacggtaaccctacggtccgttaggtcggtacccgg

SEQ ID NO: 29904 - DNA, 559 bp, Homo sapiens
  misc_feature: GYAE6OF02HSFP5.1.49.E05.1.454.CMB.1.raw
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttcgtggttacatccttttcacctacggtatgtaattggttgagtacaggcccccggagaggggcttgagtggagtggatggatcagccttagaactaaacagagtatggaagagaacgttcgagggacagagtacatacatcaccggcgaacacatccagagtacagacctacagtgaactggacgggacnccgtanaggattacgcggaacgtacaccggtccaatttactacgtgaccgtacgagtaggtatttaggtgcctaacgttcggtcccttagggccttacggaacctacggtctttgggtcggtaccgg

SEQ ID NO: 29905 - DNA, 602 bp, Homo sapiens
  misc_feature: GYAE6OF02G9BNP.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagtacagggcccccgggaggacgggggcttggagtggagtggggatgggatcgacgtcccgttaacggaaactaaaacgagtaacgtagtaggaagagaacgttccgagggcagagtcatcatcgacgcgacacatccagagtacagcctacagtaggaactaggacggacgcctacgagactcgtggaaccgacgaccggtaccctaactttacgttaccgcgccggacgacggtagtaatttacggttcgaccgttaccggttcggttccgtaggtccgtacgttaacccgcggtacgtttacggtcgggtacccgg

SEQ ID NO: 29906 - DNA, 630 bp, Homo sapiens
  misc_feature: GYAE6OF02I17RS.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcgagtgatggtctcctgcagtgcttctggttacatctttccacctacggtatgtaattggttagagtacgacggtccccccggaggacgggggtcttggaggtgggagtgggagtggactcgacgtacccgttaacggaactaaacgagagtagtaggagaggtaacgttacgagggcagtagtacatacgagtcgaccgcgacacgactccgacgacgtacacgacctacagtacgtaactgagacgcctacgagagtcgtacggacgtaccgacgggtacctaccgtttaacgttaccgtcggtaccggtacgaaggtacgtaagtttacgttcggtacctacgggttacggttccgttacggtacgttaccggttaaaccgtacggtccgtttagggtccggtaccggg

SEQ ID NO: 29907 - DNA, 784 bp, Homo sapiens
  misc_feature: GYAE6OF02JOKCI.1.49.E05.1.454.CMB.1.raw
tcagacgagtgcgtcacgaccggtgctcgatttagagcgactagcaacacacaaagggaccaaaaaccacacccctccttgggagaatccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatctttccacctacggtatgtaattggttgagtacgacggccccccggaggaacgggggtcgttggtacggtggagttaggggtacgtgggagttcgacgacccgttaacggaacttaaaacgacggtaaggtagtacgggaaggtaagtaaggtttacccgaagggtacgtaggtaagtacgaacgttacgtaacttacgaacccggaccggggtaacaaccgtaacgtacccgaaccggtaacggtaaccgtaacggtacccgttaaaccgtaacggttaacgggtaaaccgttagggaaacgggtaaccggtacccggttaaccgaacggtaacgttaccgtacgggtaaacccggtaaccgtaacccgggtacccgttaaccgttttaaaccgtttaaccgtacggtaaccgggtaccgtaaacgggtacggtaacgttttaacgtacggtaccttaacggttccgggttaccgtacgggtaccttaccggttaaacccgtcgttaaccggtttgggtaccggttaacccggg

SEQ ID NO: 29908 - DNA, 613 bp, Homo sapiens
  misc_feature: GYAE6OF02FO34F.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccactacggtatgaattggttgagacacggcccccggaggagggggcttggagtgggagtggggatggatcagcccgttacggaactaaacagagtataggagagaagttacgagggacagagtcatcatcaccgcgacacactccgacgagtacagtcctacagtacgaacttggaggacgcctacgaagtacttcgtacggaaccgaccgaccggtacctaccgttttaacgttaacctcggaccgtacgaaggtagtaacgttttaacgttcggaccgtacgtttccgggttcccgttagggtcccgttacggttaaacccgtaccggtcgtttaccgggtgggtaacccgg

SEQ ID NO: 29909 - DNA, 644 bp, Homo sapiens
  misc_feature: GYAE6OF02IOKQ9.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctccgtgcagtgcttctggttactattcttttccaccttacggtatgtattggttgagacgacggcccccggaggacggggtcttggaggtgggagtgggtagtggatcgacgtacccgttaacggaaaccgtaaaacgaaggtaaggttacgtagggaagtaaggtaacggttaccgagggacgaaggtaggtactaagtacctacgttccgaacccgggtcggaaccaccgactacccgaacgacgtaacacgacccttacagtaggaacgttggaggacgccgttacagaacttcgacgaacgaccgaccggaccctaacgtttacttacgtcgccgacgagagttaattgtcgtacctagttcggtccgttaggccttaacgtacctaccggtcgttgggtcggtaaccgg

SEQ ID NO: 29910 - DNA, 637 bp, Homo sapiens
  misc_feature: GYAE6OF02JHRKW.1.49.E05.1.454.CMB.1.raw
  modified_base (336)..(336): a, c, t, g, unknown or other
  misc_feature (336)..(336): n is a, c, g, or t
  modified_base (497)..(497): a, c, t, g, unknown or other
  misc_feature (497)..(497): n is a, c, g, or t
  modified_base (619)..(619): a, c, t, g, unknown or other
  misc_feature (619)..(619): n is a, c, g, or t
tcagacgagtgcgtcacgaccggtgctcgatttagagcgactagcaacacacaaaggggaccaaaaaccaacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgactggtctcctgcagtgcttctggttacatcttttccaccgtacggtaatcgtaatttggttgagacgacgggcccccggtaggacgggggtcttggacggtggacgtgggngttggatcgacgtccgttaacggaactaaaacgaggacgtagtaggaagaagtacgttacgagggacgtagagtcaagtcagtccgtacgcggaacaccgtactcaaccggaagtaccgacgaaccgtacgtaagtaacggtaaccgtaggaagggtaccncccggttacaaggtaccttgtaacggaaccgaacgtacccggaccgtaactttacgtacgtcgtacgagtacgtagtattacgtgacctacgttcggtccgttgtacggtcgtaaaccccgngttaccgtggcggtaccg

SEQ ID NO: 29911 - DNA, 634 bp, Homo sapiens
  misc_feature: GYAE6OF02GCMZH.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttgggtggcagcagcaacaggtgcccactcccaggttcacctggtgcagtctggagctgagctgcagaagccgtgggcctcgagtgatggtctccgtgcagtcgcttcgtggttacattctttccacctacggtatgtaattggttgagacgacggcccccgggaggacggggtcgttacggaggtgggagtgggagtgggatcgacgtacccgttaacggaaacctaaaacgagtaagtaacgtaggaaggagtaacggttaccgagggacgaagtgtacatacagtccgaccgcgacacacaccaacgacgtacacgacctacagtacgaacgttggaggactaccgcaagctacgtacgaaccgtaccgaccggacccttaacgttaacgttaccgtaggccgtaggaacgtagtaagtttacgtacggtactacgttcggtacgtcggtaccttacgtaacccgtacggtcgttacggtcgggtacccgg

SEQ ID NO: 29912 - DNA, 708 bp, Homo sapiens
  misc_feature: GYAE6OF02IXIXW.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcaccgtggtgcagtctggagctgagctgcagaacgccgtgggcctcgagtcgatggtctccgtgcagtcgtcttcgtggttactacttccttttacccaaccgttacggttattagtaagtttgggttagagtacgaccgggcccccggagggagggtcgttggacggtggtagtgggtagtgggtacgtacgacgtacccgttaacggaaactaaacgagtaacgtaggtagggaaggtaacggtaacggttaccggaagggacgtaacggtaagtaccgtaactaacgtaccgttacccgaacccgggaaccgggaaccaaccgtaacgtacccgaacggtacgtaaccgaccgtaccaacgtagtacggaacgtagggacgacgaccgtacgacgtactacgtacggaaccaccgacgtacctacgttatacgtacggcgacgtagattacgtttggtaactaccgtacgtccggtaccggtaggtaccggttacgtaacccgtcggtccgtttacgggaccgtaccggg

SEQ ID NO: 29913 - DNA, 741 bp, Homo sapiens
  misc_feature: GYAE6OF02I6FB9.1.49.E05.1.454.CMB.1.raw
  modified_base (185)..(185): a, c, t, g, unknown or other
  misc_feature (185)..(185): n is a, c, g, or t
  modified_base (245)..(245): a, c, t, g, unknown or other
  misc_feature (245)..(245): n is a, c, g, or t
  modified_base (311)..(311): a, c, t, g, unknown or other
  misc_feature (311)..(311): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtncagtctggagctgagctgcagaagccgtgggcctcgagtgatggtctcctgcagtgcttntgtacattctttcacctacggtatgtaattggttgagacacggccccgtggaggaggggtcttggnggtggagtgggactgggatcgaacgtccgttaacggaactaaaacgaggtagtagtacggaagagtaacgttaccgaaggcaaggtagtacgtataccgacgttaccgaccggtaccgggaacctaacgtacgtaccccgtaacggtaacgtaaccgtacgaccctaacgaacgttacggtaaacttagggaaacgggacgtaccccgtagaacggttactccggttaacgaaccgggtaaccgaacccgggtaacccttaaccgttttaaccgttaaaccggttcgggaacccgtacgggtaccgtaaaggtttaacgttttaacggttaacggtaccgttaccggtttaccggttacccgggtttaccgtaccggtttaaccggttaacccggtaaccggtttcccggtttagggttacccccggggg

SEQ ID NO: 29914 - DNA, 552 bp, Homo sapiens
  misc_feature: GYAE6OF02H45KU.1.49.E05.1.454.CMB.1.raw
  modified_base (352)..(352): a, c, t, g, unknown or other
  misc_feature (352)..(352): n is a, c, g, or t
  modified_base (385)..(385): a, c, t, g, unknown or other
  misc_feature (385)..(385): n is a, c, g, or t
  modified_base (424)..(424): a, c, t, g, unknown or other
  misc_feature (424)..(424): n is a, c, g, or t
  modified_base (443)..(443): a, c, t, g, unknown or other
  misc_feature (443)..(443): n is a, c, g, or t
  modified_base (450)..(450): a, c, t, g, unknown or other
  misc_feature (450)..(450): n is a, c, g, or t
  modified_base (489)..(489): a, c, t, g, unknown or other
  misc_feature (489)..(489): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctctgcagtgcttctggttacattcttttccacctacgtatgaattggttgagacgacgggcccccggaggagggtcttgacgtggagtgggatggatcgagcccgttaacggaactaaaacgngtaagtagtggagagaagttcgaggcagacgtnatcatcacgcgacacatccgaacgagtacacgacctaanagtacgaacttggaaggancccgtanagatcgtagacgacaccggacctaacttatacgtgacgngagagtattagtcgacgacgtgtacctggcttacggtaacctacggtactttcgggacggtcg

SEQ ID NO: 29915 - DNA, 610 bp, Homo sapiens
  misc_feature: GYAE6OF02H17AM.1.49.E05.1.454.CMB.1.raw
  modified_base (219)..(219): a, c, t, g, unknown or other
  misc_feature (219)..(219): n is a, c, g, or t
  modified_base (251)..(251): a, c, t, g, unknown or other
  misc_feature (251)..(251): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctnagtgatggtctcctgcagtgcttctggttacnttcttttccaccttacggtattgaattggttgagacacgggtcccccgggaggacgggggtcttggaggtgggagtgggatggatcacggacccgttaacggaactaaaacgagagtatgggagaagtaacgttcgagggacaggagtcatacagtccgaaccggcggaacacaacgtacccaacgaacgtaaccagaccctaagacgtaggaactaggtaaggacgtccctacgacgtatcgtacggaaccgaccgtaccgggaccctaccgtttaatccgtacggccgacgaagagtattagtgacctacgtcggtcctcgggcttacggtaaccctagtcgtttcggcggtaccgg

SEQ ID NO: 29916 - DNA, 555 bp, Homo sapiens
  misc_feature: GYAE6OF02HIGQ9.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatccttttccacctacggtatgaattggttgagacaggcccccggaggagggggcttggaggtggagtgggatggatcgagcccgttacggaaactaaacagagtatggagagaagttcgagggcagagtcatcatcacgcgacacatccaacgagtacacgacctacactaggaactagacggacgccgtacgagacttcgtacgacgaccgaccggacctacttaacttacctgacgacgaggagagtttagtcgatacgtcggtccttaggcttacgtaccgacgtcgttcggaggtccgg

SEQ ID NO: 29917 - DNA, 577 bp, Homo sapiens
  misc_feature: GYAE6OF02IBPBT.1.49.E05.1.454.CMB.1.raw
  modified_base (355)..(355): a, c, t, g, unknown or other
  misc_feature (355)..(355): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctgggcctcagtgatggtctcctgcagtgcttctggttacattcttttccaccttacggtatgaattggttgagacacggcccccggaggaggggcttggaggtggagtgggatggatcagcccttacggaactaaacagagtagnggagagagttcgaggcagagtcatcatcaccgcgacacactccgacgacgtaacgacgcctaacgacgtaggaaacgtgagggacgcctacgagtactcgacgaccgacgaccgtacctactttaacttacgtgtaccgcgaggtacgttacgttagttcgactacgttcggttccgtaggtccgttacggtaaccctacggttccgttggtcgggtaccgg

SEQ ID NO: 29918 - DNA, 573 bp, Homo sapiens
  misc_feature: GYAE6OF02G9PTO.1.49.E05.1.454.CMB.1.raw
  modified_base (479)..(479): a, c, t, g, unknown or other
  misc_feature (479)..(479): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagacacgggcccccggaggacgggggcttggaggtggagtggggagtggatcgacgtcccgttaaccggaactaaaacgaggtagtagtaggagagtaagttcgagggcgtagagtacatcactcgaccgcggacacactccgacgacgtacagtacctacgtagtacggaacgtggaggacgcctcgagactcgngaccgacgaccgcctacttattactcgcgacgagtagtactagtgacgtcgtcggtccgtgtcgttacggaaccgcgtcgttcggtcggtccgg

SEQ ID NO: 29919 - DNA, 630 bp, Homo sapiens
  misc_feature: GYAE6OF02H79PY.1.49.E05.1.454.CMB.1.raw
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtgcccactcccaggttcacctggtgtcagtctggagctgagctgcagagccgtgggcctcagtgatggtctcctgcagtgcttctggttacattccttttccaccttacggtatagtaattggttagagacgacggcccccggagacggggtcttggaggtggagtgggatggatcgacgtacccgttaacggaaactaaaacgagtaagtagtagggaagaagtaacggttacgaagggacaaggtacgtacaagtcacgtccgaccggacggacacgtactacccgacgtaacgtaacaacgcctaacgagtaggaaacgtggaaggacgtcctagagtactcgacggaaccgaccgaccgggtacctaacgtttaactacgtcggacgacgtaagacggttaattagtcgaactcgttacggttccgtaggtcgtaccgtaaccgtcgttcgtttgggcggttaccgg

SEQ ID NO: 29920 - DNA, 609 bp, Homo sapiens
  misc_feature: GYAE6OF02FO5Q0.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacaggcccccggagaggggcttgagtggatgggatggatcgagcccttacggaactaaaacagagtataggagagaagttcgagggcagagtacatcatcgaccgcggacacactccgaacgagtaacacgaccctaacagtacggaacttaggaggacgtccgtacgagacttacgtaggaccgaccgaaccgggaccctaacttttaacgttaacctcggaccggtacgaacgtacgtaattaacgtttcgaaccgttacggttcggtacccgttaggaccttacggtaaacccgtaaccggtcgtttacgggtgggtaacccgg

SEQ ID NO: 29921 - DNA, 625 bp, Homo sapiens
  misc_feature: GYAE6OF02H01RJ.1.49.E05.1.454.CMB.1.raw
  modified_base (195)..(195): a, c, t, g, unknown or other
  misc_feature (195)..(195): n is a, c, g, or t
  modified_base (275)..(275): a, c, t, g, unknown or other
  misc_feature (275)..(275): n is a, c, g, or t
tcagacgagtgcgtcacgaccggtgctcgatttagagcgactagcaacgacacaaaggggacccaaaaccgacacccctccttgggagaatcccctagatcacagctcctcaccatggacgggacctggagcatcttttctggtggcagcagcaacaggtgcccactcccaggttcaccgtggtgcagtctgganctgagctgcagacgccgtggggcctcagtgatggtctcctagcagtgcttcgtggttacattctttcctaccgtacggtntagtaattggttagagtacgacggacccccggaggacggggtcttaggtaggtaggagtagggtagtggtagtcgacggtcccgttaacgggaaacctaaacgagacgtagtaggagtaaggaacgttcgaagggacaaggtacgtacatacgtactaccgaccgacggacacgactaccacgacgtacacgacctaatacgtacggacgaggaacggtcgaccgttagagcttacgcgtacgacgaccggcctacttactcgtagtccgagaggtatagtttacgtacacgtacgtcggttccgtacggtaccgtcggtaaacccgtcgtacgttcggacggtaccggg

SEQ ID NO: 29922 - DNA, 598 bp, Homo sapiens
  misc_feature: GYAE6OF02J12XG.1.49.E05.1.454.CMB.1.raw
  modified_base (375)..(375): a, c, t, g, unknown or other
  misc_feature (375)..(375): n is a, c, g, or t
  modified_base (569)..(569): a, c, t, g, unknown or other
  misc_feature (569)..(569): n is a, c, g, or t
  modified_base (583)..(583): a, c, t, g, unknown or other
  misc_feature (583)..(583): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcgagagccgtgggcctcgagtgatggtctccgtgcagtgcttcgtagttacattcctttccaccgtacggtatgtaagttggttgagaccgtacgggccccggaggagggcttggaggtggagtgggtatggactcgacgtacccgttaaggaactaaaacgaggaaggtanacgggaagtaacggtacgttacgagggacaaggtacgtcaagtacacgtaccgacggccgacacgtacgtccgaacgacgtacacgtaccacagtcgaacgtgacggtcgacctagacgactcgtacgaccgacgtaccgtactagtttactaccgtcgacgtacgatacgtattaccggtcgactgtcgtcgngtaccgacgtaacncgtcgtgaccggtcg

SEQ ID NO: 29923 - DNA, 841 bp, Homo sapiens
  misc_feature: GYAE6OF02JNURG.1.49.E05.1.454.CMB.1.raw
  modified_base (244)..(244): a, c, t, g, unknown or other
  misc_feature (244)..(244): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctgggcctcgagtcgatggtctcctgcagtgcttntggttacagttctttccaccgtacggtatcgtaattggtgtacgacgacggcccccgggaggtacgggggtcgttacggaggttacgggagttcggggagttcggtaagtcgaacggtacccgttaacgggtaaactaaaacgagtaaggttaacgtagggtaaggaaggtaacggttaccggaagggtaccgtaaggtaaccggtacgtaacgttacgtaacgtacccggaaccggaccgggtaacctaaccgtaacgtaaccccgtaaaccgtaaagggtaacccgtaaacggtacccgttaacgaacggttaacgggaaaccttagggaaacgggttacccgtaccgttacgacgggtaccgttacgttacccgggaaccggtacccggaaaccggggtacccttaaccgtttaacgttaaccgtacggtacccgtaaccgggtaaggttaaccgtttaaggttttaaccgttccgggtaccggtttaaacggtttaccccgggttaccgttttaaccggggacccgttttaacccgggttaaacccgttccggtttaacccggtttacgggggttacccgggtaaccccgggg

SEQ ID NO: 29924 - DNA, 756 bp, Homo sapiens
  misc_feature: GYAE6OF02I8982.1.49.E05.1.454.CMB.1.raw
tcagacgagtgcgtcacgaccggtgctcgatttagagcgactagcaacacgacaaaggggacccaaaaaccacacccctccttgggagaactcccctagatcacagctcctcaccatggacgggacctggagcatcctttcttggtggcagcagcaacaggtgcccactcccaggttcacctggtgcagtctggagctgagctgcagagcgtggggctgagtgagtggtctccgtgcaggtcgtccttcgtggttacctacgttcctttccaccgttacggtagtacgtaagtttgggttacgacgtaccggaccgggtacccccgggtaagggtacgggggtaccgttggtacgggtcgggtacgggtaggggtaggtgggtacgtacggtacggtacccgttaacgggtaaaacgtaaaacggaggtaacggtaggtagggaacggtaaggtaacggttaccggaacgggtacgtaaggtacgtacgtactaccgtaacgtccggaaccgggtacgaaccgtaaccgtaacgtaccgtaacggtaacggtaacgtacggtacctaacgaacgtacggtaacgtacggaacggtaccgtacctacggtacgtacgtacgtacggaccgaccgaccggtacctaacgttacgtaccgtcggtacggtacgtaacgtagttacgttacgtcgtaccgtacgttcggtacgttaggtaccgtacggtaaccgtacggtcggttacgggtcggtaccgg

SEQ ID NO: 29925 - DNA, 654 bp, Homo sapiens
  misc_feature: GYAE6OF02IBMDJ.1.49.E05.1.454.CMB.1.raw
  modified_base (184)..(184): a, c, t, g, unknown or other
  misc_feature (184)..(184): n is a, c, g, or t
  modified_base (645)..(645): a, c, t, g, unknown or other
  misc_feature (645)..(645): n is a, c, g, or t
tcagacgagtgcgtcacgaccggtgctcgatttagagcgactagcaacacacaaagggggacccaaaaaccacacccctccttgggagaatcccctagatcacagctcctcaccatggacgggacctggagcatcctttctggtggcagcagcaacaggtgcccactcccaggttcacctggtncagtctggagctgagctgcagagcctggggcctcagtgatggtctcctgcagtgtcttcgtggttacattcctttaccaccgtacggtatgtaatttgggttgacgacgacggacccccggaggacggggtcttaggacggtggagtgggagtggtatcgacgtaccgttaacggaactaaacgagagtaagtagggacgaaggtaacgttaccgagggacaaggtacgtacagtccaagtccgaacccggtacggacaacctaacgtacccgaacggtaacgtaccacgacctaacgagtacggaacgtacggacggactcctacgacgactcgtacgaccgtacgaccggtacctactttacgttacgtcggaccgtagacgtacggtatttacggtcgaaccgtaccgttcggtacccgtggtaccgttaacggtacccgacggtcggtttaccgggnggtacccgg

SEQ ID NO: 29926 - DNA, 624 bp, Homo sapiens
  misc_feature: GYAE6OF02HOHHI.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttcacctacgtatgtattggttgagacgaggcccccggagacggggtcttggaggtggagtggatggatcgagtcccttaacggaactaaaacgagagtagtggaagagtaagttaccgagggtacagtagtacgatacagtacaccggacgacacgactcgacgacgtacacgactacagtagaactaggacggagcctacgagactcgacgaacgaccgaccggtacctaacgtttaacgttacgtacgaccggtacgtaacggtacgtaagtttacgttacggaccgtaacggttccggttacccggttacgggtaccgttaccggtaaacccgtaccggttcgtttacgggtcgggtaaccccgg

SEQ ID NO: 29927 - DNA, 589 bp, Homo sapiens
  misc_feature: GYAE6OF02I2KH5.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctccgtgcagtgcttctggttacattctttccacctacggtatgtaattggttgagacgacggccccggaggaggggtcttggaggtggagtggggatgggagtacgacgtacccgttaacggaaactaaaacgagaagtagtaggaaggaagtaacgttcgagggcgagagtcatcactcgaccgacggacacacgtaccacgagtacacgtaccagacgtcggaacgtaggaggacgtcctacgacgtatacgtcggaacgacgaccggacctacttacttacgtcgacgacgagtagtattagtcgactacgtcggtccgtggtacgttacgtaaccgacgtcgtcggtggtaccgg

SEQ ID NO: 29928 - DNA, 581 bp, Homo sapiens
  misc_feature: GYAE6OF02IZJEL.1.49.E05.1.454.CMB.1.raw
  modified_base (561)..(561): a, c, t, g, unknown or other
  misc_feature (561)..(561): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagtacacgggtcccccggagacgggggtcttggaggtggagtgggattgggatcgagtcccgttaacggaactaaaacgagacgtaagtggaagagtaagttccgagggacgaggagtcagtcagtaccgaccggcgaacacatccgacgagtacacgacctacaatggactgaggacgcctagacgatacgtacggacgaccacggaccctaagttacttactcggacgaccgagagtatttagtcgacgtccgtggtcctaggtcttacggtaaccncggtcttcgggtggtaccgg

SEQ ID NO: 29929 - DNA, 568 bp, Homo sapiens
  misc_feature: GYAE6OF02HXEEP.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatgggacgggacccggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgaattggttgagacaggcccccggagagggtcttggagtggagtgggatggatcgacgcccgttaacggaactaaaacagaagtataggagagaagttccgagggacagagtcatacatccgaccgcggacaacatacccacgatacagcctacataggaactaggaggacgcctcgagatcgtagaccgacaccggacctacttattacctggcgacgagagagtttaatcggcttacgttcggtccgttaggtcctacggtaaccctacgtcctttacggtcgggactaccggg

SEQ ID NO: 29930 - DNA, 679 bp, Homo sapiens
  misc_feature: GYAE6OF02H8T2D.1.49.E05.1.454.CMB.1.raw
  modified_base (293)..(293): a, c, t, g, unknown or other
  misc_feature (293)..(293): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttcgtggttacattcttttccaccttacggtatgtaagttggttgagtacncgggcccccggaggacggggcttcggaggttggagtggggtatcggatcgacggtcccgttaacggaaacgtaaaacgagtaagtagtagggaagtaagtacggttaccgagggacaaggtagtacgattacacgtaccgaccgtacggaacaacgtacgtaccgaacggtacgttaccacgtacccgtaactaacgtacggtaacgttaggaacggacgtcccgtacgaacgtaactccgtacggaaccgaaccgtaccggtaccttaacgtttaacgttaacgtccggtacgacgtaaggtacgtaactttacggtcgtaccgtacgttacggttccgtacggtcgtttacgaacccgtcggtcggtttacggcggtaacccgg

SEQ ID NO: 29931 - DNA, 600 bp, Homo sapiens
  misc_feature: GYAE6OF02HG416.1.49.E05.1.454.CMB.1.raw
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctnagtgatggtctctgcagtgcttntggttacattctttccacctacggtatgtaattggttgagtacacgggcccccggaggagggggccttggaggtgggagtgggagtggatcgacgtcccgttaacggaactaaaacgagagtagtaggagagaagttacgagggcaggagtcatcatcgaccgacggacacacgtccacggacgtacgacgacctacgaagtacgggtaacgtaggtaggacgtccgtacgagacgttacgtacgggaccgacggaccggaccttaactttacgttacgtcggcgacgagacgtatttacgtcgcctacgtcggttccgtggtcttacggtaaccgaccggtcttagggcggtaccgg

SEQ ID NO: 29932 - DNA, 628 bp, Homo sapiens
  misc_feature: GYAE6OF02HL4CY.1.49.E05.1.454.CMB.1.raw
  modified_base (552)..(552): a, c, t, g, unknown or other
  misc_feature (552)..(552): n is a, c, g, or t
  modified_base (589)..(589): a, c, t, g, unknown or other
  misc_feature (589)..(589): n is a, c, g, or t
tcagacgagtgcgtcacgaccggtgctcgatttagagcgactagcaacacgacaaaggggacccaaaaaccacacccctccttgggacgaatcccctagatcacagctcctcaccatggacgggacctggagcatcctttctggtggcagcagcaacaggtgtcccactcccgaggttctaaccgtggtcgcagtctggagctgagctgcgagagccgtgggcctcagtgatcggtctcctgcagtcgcttcgtggttactacttccgttttacctaacccgttacggttaatcgtaagtttggttagagtacgacggcccccgggaggacggggtctaggagggtaggacgtgggagtgggtactccgacgtaccgttaacggaaactaaacgagtagtagaggaagtacggtaacgttccgaggacaggtacgtacatcacacgacccgacgactactacaccgacgacgtacacgactacgagtacggtaacgaggacgacgtaccagacgacgtcgacgaccgtacgaccgtacctacgttactacgngacgacgagagtacgtagtcgctaccgtcgttaccgnggtacctacggtaccgtacggtcgttacggcgtacccgg

SEQ ID NO: 29933 - DNA, 643 bp, Homo sapiens
  misc_feature: GYAE6OF02HEHK1.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattccttttccaccttacggtatgaatttggttgagacaggccccccggaggacgggggcttggaggtggagtggggagtggatcaggcccttaacggaactaaaacgaggagtatagggagaggaagttcgagggcaggagtcatcatcgaccggcgacacgactccgacgacgtacgacgacctacagtacggaactaggaaggacgtacctcgaagacttacgaggtaaccgacgaccgggaccttaaccgtttacgttaacgtcggaccgtaccggaagtacgtacgttttaacgttacggaccgtaacgtttccgggttacccgttagggttaccgttaccgttaaccccggtacggttccggtttacgggtccgggttaacccggg

SEQ ID NO: 29934 - DNA, 631 bp, Homo sapiens
  misc_feature: GYAE6OF02G94LA.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcgagtgatggtctcctgcagtgcttctggttacattcttttccaccgtacggtatagtaattggttgagtacgacggcccccggaggacggggtcttggaggtggagtgggagtggatcgacgcccgttaacgaactaaacgagagtatggagagtagtcgaggcagagtcatcatccgacgacgacacacaccgacgacgtacgacgcctaacgagtaggaactggaacggacgcctacgaacgtactcgtacgaaccgtaccgaccggaccttaacgtttaaccgttacgtcggtaccgacggaaggtacgttaagtttacgttacgtaccgttaaccggttccgggttaccgttcgggtaccgttaacggtaaccccgtaccggttacggtttcgggtacggtacccggg

SEQ ID NO: 29935 - DNA, 707 bp, Homo sapiens
  misc_feature: GYAE6OF02F480R.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttcgtggttacattctttccactacggtatgtaattggttgagtacacggccccggaggacggggtcttggaggtggtagtgggagtggatcgaggtcccttaacggaaacttaaaacgagtaacgttaagtagggaacgtaaggtaacggtttaccggacgggacgtaagaggtactagttacgtactacgaccggtacggaacacgtacgtaccgaacggacgtacacgtacctaacgagtacgggtaacgtaggtacggaccgaccgtacgtaacgacttacggtaccgaacggacccggtaaccggaccccgttaaagtttaccgttaacgtacggtaccggtagaaccgggttagtaaccgttttacgtacggttacccgttacgttaccggttaccgtacggttaccggttaccgttaacccgtaccggtttaccggtttacgggtacgggtaacccgg

SEQ ID NO: 29936 - DNA, 548 bp, Homo sapiens
  misc_feature: GYAE6OF02FZTX5.1.49.E05.1.454.CMB.1.raw
  modified_base (244)..(244): a, c, t, g, unknown or other
  misc_feature (244)..(244): n is a, c, g, or t
  modified_base (395)..(395): a, c, t, g, unknown or other
  misc_feature (395)..(395): n is a, c, g, or t
  modified_base (439)..(439): a, c, t, g, unknown or other
  misc_feature (439)..(439): n is a, c, g, or t
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (466)..(466): a, c, t, g, unknown or other
  misc_feature (466)..(466): n is a, c, g, or t
  modified_base (486)..(486): a, c, t, g, unknown or other
  misc_feature (486)..(486): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttntggttacattctttccacctacggtatgtaattggttgagtacgacggccccgggaggacggggcttggaggtggagtgggatggatcgagtacccgttaaggaactaaaacgagagtagagggagaggaagttccgaagggcaggacgtntatcatccgaccggacgacacactccaacgagtaccagacctanagtaggaactgaggacncngagatcgngacgacaccgcacttatacngcgagagtagattagtcgctacgtcgtacgtagtctacggtaaccacgtcgtcggtcggtcg

SEQ ID NO: 29937 - DNA, 676 bp, Homo sapiens
  misc_feature: GYAE6OF02HJG3W.1.49.E05.1.454.CMB.1.raw
  modified_base (249)..(249): a, c, t, g, unknown or other
  misc_feature (249)..(249): n is a, c, g, or t
tcagacgagtgcgtcacgaccggtgctcgatttagagcgactagcaacacacaaaggggacccaaaaaccacacccctccttgggagaatcccctagatcacagctcctcaccatggacggacctggagcatccttttcttggtggcagcagcaacaggtgcccactcccaggttcacctggtgcagtctggagctgagctgcagagcctgggcctcagtgatggtctcgtgcagtgcttctggttacntctttccactacgtatgagttcgtgagacacggccccggagtagggtcttgaggtggagtgggatggacgtcgtacggtacccgttaacggaaacttaaacgaacgtaggtaactgggaagtaggtaacgttcgaagggtcgaagacgtctaacgtactaagtccgtaccggtccgggtaactacgactacccgaacggtacgtaaccgtaacggtccttaacgacgtaacggaacgttacggacggtaacgccctaagaacggtactacggacggtaaccgaacgtacccggtaaccttaacgtttaacttaccggtacgtacgaccggtaatacggttacgtttacgtacggtacgttacgtccgggttaccctacgggttcttaaccggtacccacggtttaccttacggttacgggtacccgg

SEQ ID NO: 29938 - DNA, 545 bp, Homo sapiens
  misc_feature: GYAE6OF02IIM30.1.49.E05.1.454.CMB.1.raw
  modified_base (440)..(440): a, c, t, g, unknown or other
  misc_feature (440)..(440): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttctggttacatcttttccacctacggtatgaattggttgagacacggcccccggagagggggcttggagtgggatggggatgggatcacgcccttacggaactaaaacgagagtatggagagaagttcagggcagagcatcatcaccgcgacacatccgaacgacgtacagcctacagtacggaactggaggagcctanagatcgtagacgcacggacctacttacttacgcgacgacgagagtatttagtgactacgttgtcccgtggtcctaggtaacccacggtccgttggtggtacccgg

SEQ ID NO: 29939 - DNA, 665 bp, Homo sapiens
  misc_feature: GYAE6OF02J1ULW.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctcggttacattcctttccaccgtacggtatgtaattggttgacgacgacgggccccggaggacggggtcttggacgtggagtcgggtagtgggactcgtacgacccgttaacggaactaaacgagtacgtagtggagagtacgtacgaggacgagtagtacatcagtacgacgacgtacacgacgtccgaacgtacgtacacgtacctaacgtaggacgggtaactagggaacggcgtaaccgtcgaaacggtcttaccggaacgtacccggacccgtaaccgggtaacccttagtttaaccgttacgttacggaccggtaacgacggttaagttctttaacggtcgtaccgtacggttacccggttaccggtagtacccgttacgaacccggttaccgtcggtttcgggacggttacccgg

SEQ ID NO: 29940 - DNA, 569 bp, Homo sapiens
  misc_feature: GYAE6OF02FSQJD.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacacggcccccggagagggggcttgaggtggagtgggatggatcgagtcccttaggaactaaaacagagtatggagagaagttcaggcagagtcatcatcacgcgacacatccacgagtacagcctaacagtacggaactggaggacgacctcgagtactcgtacgaacggaccgacggacctaccgtttactacgtcgacgtcggagtatagttattcggactacgtcggttacccgttgggtccttacggtaaacccgtccgtacggttcggtcgggtacccgg

SEQ ID NO: 29941 - DNA, 813 bp, Homo sapiens
  misc_feature: GYAE6OF02FMQ4K.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccactacggtatgtaattggttgagacgacggcccccggaggacggggtcttggaggtggagtggggagtggatcgaacgtcccgttaacggaaacctaaaacgaggtaagtagtagggaagtaaggtaacggttaccggaaggggacgaaggtacggttacgaagttaccgtaacgtacccgaacccgggtaccggaaccgtaacctaaccgtaccccgtaaaccggtaaacggttaacccgtaaccggtaaccccgttaaccgaacggttaaccgggtaaacggttacgggaacggggtaccgtacccggtaacgtaacggtaccgttaccggtaaccggtaacccggtaacccgtaacccggggtaaccctttaaccgttttaaaccgtttaccgtacgggtaccgggtaaccggtaaggttaacgttaacgttttacggttcggaaccgtttacccggttaccggggttccggttaccgggttaccgttaaccccggttaaaccggtaccggtttacccgggttttaggggtacccgggttaaccccgggg

SEQ ID NO: 29942 - DNA, 692 bp, Homo sapiens
  misc_feature: GYAE6OF02IZ46B.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcgagaagcctggggcctcgagtgagtggtctccgtgcagtgtcttcgtggttacattcctttaccaccgttacggtatgtaacgttggttgacgacgacggaccccggaggacggggtcttggagtggagtggatggatcacgtcccgttaacggaaactaaaacgagtaagtagtagggaagtaagtaacggttaccgagggacgaaggtacgtacgtaataccgtaacgttaccgaaccggaccggtaactaaaccgtacgttaaccccgaaccgggtaacggttaacccgaaccgggtacccttaaaccgagttaaccgggaaacgttacggaaccggtacgacccgttacgagtaacgtcgtacggaaccgtacgaacggtaccctaacgttaacttacgcgacgtacgaagtagtaacttagtacgtctaccgttggtccgttaggacgttacgtaaccgtcgtacggtttcggtacggtacgg

SEQ ID NO: 29943 - DNA, 722 bp, Homo sapiens
  misc_feature: GYAE6OF02IIL6G.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcctaggttcacctggtgcagtctggagctgagctgacagaacgccgtgggccctgagtgattggtctcctgcagtcgcttcgtaggttacattctttccacttacgtatgattggtagagtacgtacgggccccggaggtacggggtctttacggaggttagggagtcggggaagtggaacgtcgtaacgtacccgttaacgaaaactaaacgaggagtaggttacggagaaggtaacgttaccggaggtacgaaggtatacaataccgtactaccgaaccgcgaacctactaacgtacccgaaacggaacgttacgaacgtacccgtaaactacgtaacgggaacgttaggaacggtaccgtacccgtaagtacgtaccgttgtaaccgacccggtaaaccgtaccggtaaccgttaaccgtttactaaccggttacggaccgtacgtaacgggtactaagttttcgtaacggaccgttaccggtacgggttacccgttacgggtactaccggtaaacccgtaccggtttccgttggggtaacccgtaccggg

SEQ ID NO: 29944 - DNA, 616 bp, Homo sapiens
  misc_feature: GYAE6OF02JG45X.1.49.E05.1.454.CMB.1.raw
  modified_base (442)..(442): a, c, t, g, unknown or other
  misc_feature (442)..(442): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccaccttacggtatgaattggttgagacaggcccccggaggaggggcttggaggtggagtggggatggatcacggtccttacggaaactaaacgagagtagtaggacgagtaagttccgaggcgagacgtcgatcatccgacgacggacacagtccacgacgtacagcctaacagtacggaanggacggtacacctcagtactcgtacggacgaccgaccggtaccctaactttacgttacctggtaccgacgtaacggtataacgtttagttacggacctaacgttcgggttacccgtacgggttaccttaacgggttaaccctaccggtccggttttaggaccggggttacccgg

SEQ ID NO: 29945 - DNA, 620 bp, Homo sapiens
  misc_feature: GYAE6OF02JD3OP.1.49.E05.1.454.CMB.1.raw
  modified_base (556)..(556): a, c, t, g, unknown or other
  misc_feature (556)..(556): n is a, c, g, or t
  modified_base (584)..(584): a, c, t, g, unknown or other
  misc_feature (584)..(584): n is a, c, g, or t
  modified_base (612)..(612): a, c, t, g, unknown or other
  misc_feature (612)..(612): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctggttactattcgttttccaccttacggtatgaattggttagagactacggcccccggagaggggcttgaggtggagtgggtatgggatcgacgtcccgttaaggaactaaaacgagtaacgtagtaggaaggtaagtaacggttccgaagggtaccaggaacgtacgaatacgaactcgaaccgacgggaacaacgactacccgaacggtacgtaaccaggtaccctaacgagttacgaacgttacggaggtacgccgtacaggtacgtctaggaccacgaccgactactttaagtacgcgtaccgacgaangtaattagtcggtactacgtcgttacgngtcgtacgtaacctaccgtcgttacggnggtaccgg

SEQ ID NO: 29946 - DNA, 614 bp, Homo sapiens
  misc_feature: GYAE6OF02ISHAE.1.49.E05.1.454.CMB.1.raw
  modified_base (540)..(540): a, c, t, g, unknown or other
  misc_feature (540)..(540): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggttacattctttccacctacggtatgtaattggtgagacgacggccccggaggaggggtcgttggaggtgggagtggggagtggatcgacgtacccgttaacggaaactaaaacgagagtaagtagggaagtaaggtaacgttccgaagggacgaaggacgtacagtcaacgtaccgaccgacggaacaccgaatcccgaacgtacgtaaccgacgtaccctagaacgtaggaacgtaggacgggacgcctacgagactcgtacgaccgacgaacggcctaatttacgttacncgtacgcgaagagtattacgtgacctacgttgtccgtggtactacgtaaccgcggtcggttaggtcggtaccgg

SEQ ID NO: 29947 - DNA, 574 bp, Homo sapiens
  misc_feature: GYAE6OF02JD79G.1.49.E05.1.454.CMB.1.raw
  modified_base (466)..(466): a, c, t, g, unknown or other
  misc_feature (466)..(466): n is a, c, g, or t
  modified_base (501)..(501): a, c, t, g, unknown or other
  misc_feature (501)..(501): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagacacggcccccggaggaggggcttggagtggagtgggatggatcgagtaccgtacggaactaaaacgaagagtataggagagaagttacgagggacagagtacatacactccaccgcggaacacgtactaccgaacgaacgtacacgacctaacacgtagaacgtaggacggagccagagnttcgtagaacgacgaaccgtctacgttattaccgngacggcgaagtacgtattagtcgactagtccgtcgtcggtactacgtaaccgacgtacgttcggtcggtaccg

SEQ ID NO: 29948 - DNA, 773 bp, Homo sapiens
  misc_feature: GYAE6OF02J1HWX.1.49.E05.1.454.CMB.1.raw
tcagacgagtgcgtcacgaccggtgctcgatttagagcgactagcaacacacaaagggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctgggcctcagtgatggtctcctgcagtgcttctggttacattcttttaccacctacggttatgtaacgttggttagagacacgggcccccggaggaggggcttggaggttggacgtgggagtggactacgacgtcccgttacggaactaaaacgaggtacgtagttaggagtaggtaacgttccgagggtacgagtacgggtactaagtaccgtaagtacccgtaacccggacgggtaaaccgaaccgtaacgtacccgtaaaccgggttaacggaaccccgtaacgggtaacccttaacccggtataccgggtaaacggttacgggaacgggttaccgacccgttacgtaggtaaccgtttaccgtacggtaaaccggtaccgtaacccggggtaacctttaaccgttttaacgtttaaccggttacgggttaccgggaccggttaaacggtacggttaagtttttaccggttacggtaccgttaaccgtttggggttaccccgtaggttaccgtttaccggtaaaccgtaccccgtgggtttttacgggacgggtaccccgg

SEQ ID NO: 29949 - DNA, 606 bp, Homo sapiens
  misc_feature: GYAE6OF02G6PQ5.1.49.E05.1.454.CMB.1.raw
  modified_base (472)..(472): a, c, t, g, unknown or other
  misc_feature (472)..(472): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacacgggcccccggagacggggtcttggacgttggagtgggagtggatcgacgtaccccgttaacggaaactaaaaccgagtaacgtaagtagggaagtaagaacgttacgagggacagagtacatcatccgaccgcggacacacaccgacgagtaacagcctacacgtacggaacttcggaaggacnccgtacagtactcgtagaccgacgaccggcctaacgttacttacgtcgacgaccgtaagtcgtaattacgtcgtaccgtacgttcggtaccctggtaccgtacgtacccgtacggtcgttcggtacggtaccgg

SEQ ID NO: 29950 - DNA, 805 bp, Homo sapiens
  misc_feature: GYAE6OF02F63DG.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagctgggctcagtgatggtctcctgcagtgcttctggttacattctttccaccgttacggtattacgtaatttcggttgaagtacgacgggacccccgggaggacgggggtcttggaggtacggagtgggagtggatcgacgtacccgttaacggaaacttaaaaccgaggtaagtacgtagggtaaggtaagaacggtttaccgagggacgtaacggtagtacgaagtacaacgttaccgaccggtaccggaactacgaaccgttaccgaaccgtaacggtaacgaccgtaccctaacgtaacgtacgggtaaccgttacgggaacggtacgtacccgttacgtaacggtaacttaccgtacggtaacccggtaacccggtaacccgggttaccctaaacgtttttaaccgttaaccggttaccggtaaccggttaacggtaacgggtaacgttaacgttttaaacggttccggttaaccggtaaaccgttttacccggggttaccccggtttacgggttaacccggtttaaccgggtttaaaaccccggtacccgggtttacccggtttttacgggggttacccgggttaacccgggg

SEQ ID NO: 29951 - DNA, 577 bp, Homo sapiens
  misc_feature: GYAE6OF02F04P8.1.49.E05.1.454.CMB.1.raw
  modified_base (395)..(395): a, c, t, g, unknown or other
  misc_feature (395)..(395): n is a, c, g, or t
  modified_base (433)..(433): a, c, t, g, unknown or other
  misc_feature (433)..(433): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgctagtgtccttcgtggttacattcttttcccaccttacggtatgtaattggttgagacacggccccggagaggggcttggagtggagtgggagtggatcgacgtccgttacggaactaaaacgagagtagtaggagagtacgttacgagggcaggacgtnatcatcgacgcggacacactaccagacgtacagtccanagtgtaacgtaggagacgcctagagtatctagaaccgacgaacggtcctaactttagtacctggaccaggagtagtacttagttcgtactacggtcgttccgtaggtccttacggtaacccgtaggtcgttaggtcggtaccgg

SEQ ID NO: 29952 - DNA, 559 bp, Homo sapiens
  misc_feature: GYAE6OF02GZ3C8.1.49.E05.1.454.CMB.1.raw
  modified_base (367)..(367): a, c, t, g, unknown or other
  misc_feature (367)..(367): n is a, c, g, or t
  modified_base (402)..(402): a, c, t, g, unknown or other
  misc_feature (402)..(402): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctggttacatcttttccacctacggtatgaattggttgagacaggcccccggagaggggcttgagtggatgggatggatcagccttacggaactaaacagagtatggagagaagtcaggcagagnatcatcacgcgacacatccagagtacagtacctanagtcggaactggagacgccncagactcnggacacgaccgcctaacttacttactacggcgaccgaggacgttatttacgttcggtacctaacgttcggtcccggttaggtcccgttacggtaacccgtaccggtccggtttagggtcgggtacccgg

SEQ ID NO: 29953 - DNA, 734 bp, Homo sapiens
  misc_feature: GYAE6OF02HJYOZ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctagcagtgcttcgtggttacagttcttttccacctaccggtatgtaattggttgagacgacggcccccggagagggggtccttaggacggtggagtgggacgtggagtcgacgtcccttaacggaacgtaaaaacgacggtagtaagtagggaagtaacggaacgtttaccgagggtaccgaaggtagtactaagtccgaacgtccgaaccgggtaccggacaaccgtaacgttaccgaaccgtaacgtaaccgacgtaccctaacgagtacgggaacttaggaaggacggtaccctacgaaggtacccttacggacgtaacccggaaccggaaccgggtaccctaaccttttaaacgttaccggttaccgggtccgtacccggtaagggaacgtaacgttttaacgttccggtacgttaaccggttccggttacccggttcgggtaccgtttaaccggtaacccgtaccggtttacggttacgggtcgggtaacccggg

SEQ ID NO: 29954 - DNA, 751 bp, Homo sapiens
  misc_feature: GYAE6OF02IWBK7.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggttacattcttttccaccttacggtatgtaattggttgagacgacgggcccccggaggaggggcttggagtgggagtgggagtggatcgacgtcccgttaacggaactaaaacgagtaagtacgtagggaagtaacggtaacggttccgagggactaggacgtacgattacaacgttccgaaccggtcggaaccgactacgttacccgaaaccggtagtaacccgtacggaacccttaaccgtagtacgggtaaacgttcgggaacggtacgaccccgttacgaggtaccttaccgtacggtaaccgacccgtaaaccggtcccgttaacgttttaaaccgtttaaccggtcggtacccggtaacggtaaggtaaccggttaagtttttaacggttcggtacccgttaacgggttccgggtttaccccggtacgggttacccgtttaaccggtaaaccccgtacccgggtttaccgtttcgggggttaccgggtaacccccggg

SEQ ID NO: 29955 - DNA, 632 bp, Homo sapiens
  misc_feature: GYAE6OF02G54SM.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcctttccacctacggtatgtaagttggttgagacgacggtccccggaggacgggtcttggaggtggagtggggatggatcgacgtacccgttaacggtaactaaaacgagagtagtaggagtaggtaagttaccgagggacaggagtacatacatacaccggcgacacgactaccgagacgtacacgactaacagtacggaactggaggacgtccgtacaagtactacgtacggaaccgacgaaccggtacctaacgtttaagttacgtacggacgtacggagtacgttagtttacgttggtaccgtaccggttccggtacccgttaggtaccgttacggtaacccgtacggttaccgtttccgggtagggtacccgg

SEQ ID NO: 29956 - DNA, 667 bp, Homo sapiens
  misc_feature: GYAE6OF02H8T7Q.1.49.E05.1.454.CMB.1.raw
tcagacgagtgcgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccgacctacggtatgtaattggttgagacgacggccccggaggagggcttgagtggagtgggatggatcaggtacccttaacggaaactaaaacgagaggtaagtaggagaagtaggttccgagggacagaggtcaagtacataccgaaccggtcggaacacgtacgccgaaggacgtaacacgtacctaactagtacggaaacgttggaggaaccgtccgtacgaaggtaacgttccgtaagggaacccgaaccgacccgggtaaccttaacccgtttaagttaaccgtcggaccgacgttaaaggaccgttaaagtttacgttacggaccgttacgtacccggttacggtcccggtacgttaaccggtaaaccccgtacgggttcgtttaccgggttcgggaacccgg

SEQ ID NO: 29957 - DNA, 624 bp, Homo sapiens
  misc_feature: GYAE6OF02JK55R.1.49.E05.1.454.CMB.1.raw
  modified_base (390)..(390): a, c, t, g, unknown or other
  misc_feature (390)..(390): n is a, c, g, or t
  modified_base (517)..(517): a, c, t, g, unknown or other
  misc_feature (517)..(517): n is a, c, g, or t
tcagacgagtgcgtcacgaccggtgctcgatttagagcgactagcaacacacaaaggggacccaaaaccaacacccctcccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagtacaggcccccggagacggggcttgaggtggagtgggagtggatcgagtcccgttacggaactaaaacgagaagtagtaggagtagaagttcgaggcaggacgtnagtcagttccaaccgtcggaaccacgtactaccgaacgtagtaccagccctaacgagtaggaacgttggaacggtacgtacctcgagtacgtctaggaccgaccgacggtcctaacgttacgttacncggtaccgtacgaaggtagttaacgttagttacggactaacggttccggtaacccgttgggtaccttacggtaacccgtacggttcgtttacgggtcgggtacccgg

SEQ ID NO: 29958 - DNA, 608 bp, Homo sapiens
  misc_feature: GYAE6OF02GGWEB.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctgtacatctttccactacggtatgtaattggttgagacgacgggcccccggtaggacggggtcttggagtgggagtgggatggatcgagcccgttacggaactaaacagagtatggacgagtagtccgagggacgagagtcatcatccgacgacgacacataccgacgagtacacgacctacgtagtacggaacgttggacggtacgaccctacgacgtactacgtacggaaccgaaccgaccggtaccctaacgtttacttacgtcggaccgacggtagtacgtatttaacgtggtacctaccggtcggttaccgtcgggtacgttccggaaccgttaccggtcgttacgggtcggtacccgg

SEQ ID NO: 29959 - DNA, 712 bp, Homo sapiens
  misc_feature: GYAE6OF02G0GH1.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctccgtgcagtgcttctggttactatctttccacctacggtatgtattggttgagacgacggccccggaggacggggcttggaggtggagtgggagtggatcgacgtaccgttaacggaaactaaaaccgtagagttaacgtagggaacgtaaggtaacggttaccggaagggtacgaagtaacgtactaagtactacgtaccgaacccggtaccgggaacaacgtaccgtacccgaacggtaacgttaaccgaacgtaccctaacgaacgtacgggaacgttacggacgggtaacgtccctacgaacgtacgttaccgtaggtaaaccgaccgaaccggtaccctaacgtttaacgtttaccgacggtaccgacggtaacgtaagttagtttaacgtttggaccgttaacggttccggttacccgttacgggttaccgttaacggtaacccgtaaccggtcgtttacgggacggttaccgg

SEQ ID NO: 29960 - DNA, 642 bp, Homo sapiens
  misc_feature: GYAE6OF02G0O78.1.49.E05.1.454.CMB.1.raw
  modified_base (367)..(367): a, c, t, g, unknown or other
  misc_feature (367)..(367): n is a, c, g, or t
tcagacgagtgcgtcacgaccggtgctcgattttagagcgactagcaacacacaaagggggaccccaaaaaccacaccccctccttggggagaatccccctagatcacagctcctcaccatggacggggacctggagcatcctttttcttggtggcagcagcaacaggtgccccactccccaggttcacctggtgcagtctggagctgagctgcagaagcctgggggcctcagtgatggtctcctgcagtgcttctggttacattctttttccaccttacggtattgaattgttgagactaggcccccggagaggggtctgagtcggagtgggatggatcgacgtcccttacggaaactaaaaccgngtacgtacgtaggagagtaagttccgaggtcagtagtcgatacgacgtccacggcgacacgtactaccgacgagtaccgacgaccttaacgagtacggtacgtacggtacggtacgtcctacgagtacgttacgttacggaaccgtaccgaccggtaccctacgtttacgttacggtccgacgtaccgacggtagtacttttaacgtcgtaccttacgttccggtaccgttcggtccgttacggtaccctacggtacgttcgggtacggtaccgg

SEQ ID NO: 29961 - DNA, 576 bp, Homo sapiens
  misc_feature: GYAE6OF02GG5VE.1.49.E05.1.454.CMB.1.raw
  modified_base (418)..(418): a, c, t, g, unknown or other
  misc_feature (418)..(418): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacacgggcccccggaggacgggggcttggagtgggatgggatggatcagcccttacggaactaaaacagagtatggagagaagttccagggcagagtcatacatcaccgcgacacataccacgagtacagcctanacgtaggaactgaggacgcctacgagtacgtctacggaccgaacgaccggtacctaacgtttaacttaccgtagaccgtacgagtagtactttagtcggtacctacgtcggttcccgtaggtacgttacgtaacccgacgtcgttcggtcggtaccgg

SEQ ID NO: 29962 - DNA, 510 bp, Homo sapiens
  misc_feature: GYAE6OF02FG4RY.1.49.E05.1.454.CMB.1.raw
  modified_base (347)..(347): a, c, t, g, unknown or other
  misc_feature (347)..(347): n is a, c, g, or t
  modified_base (428)..(428): a, c, t, g, unknown or other
  misc_feature (428)..(428): n is a, c, g, or t
  modified_base (473)..(473): a, c, t, g, unknown or other
  misc_feature (473)..(473): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggtcccccggagagggggcttgaggtggatgggatggatcagcccttacggaactaaaacngagtatggagagaagttccagggcagagtcatcatcaccgcgacacatcacgatacagcctacatggaactgaggagcctnagatctgacacacgccacttatactagcgcagagattagttgacncgtggtcctaggctgtaaccgagtcttggtgtaccgg

SEQ ID NO: 29963 - DNA, 629 bp, Homo sapiens
  misc_feature: GYAE6OF02F8YA3.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggttacatctttccactacggtatgtaattggttgagtacgacggcccccggaggaggggtccttggaggtgggatggggatggatcgagcccgttaacggaactaaacgagacgtatagggagagaacgttcgaaggcagagtcatcatcacgcgacacacaccacgtactacgagtccctaagacgtacgaacgtacggaggacgcctacgagtactacgtaggtaaccgaccgtacccgggacctaacgtttacttaaccgtacggtaccgtacgaaggtacgttaagttacgttacggtaccgtaacggttccggttaccgttcgggttaccggttacggtaacccgtaccgggtacgtttaccgggtgggtaccccgg

SEQ ID NO: 29964 - DNA, 597 bp, Homo sapiens
  misc_feature: GYAE6OF02H2D1D.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctggttacattctttccacctacggtatgaattggttgagacacggcccccggagaggggtcttggaggtggagtgggatgggatcgacgtcccgttaacggaactaaaacgagagtagtaggagagtaagttcgagggcagagtcatcatacgaccgcgacacactaccgacgacgtacgacgacctacacgtagaacgtaggaggacgcctacgagactcgtagacgacgacggtacctaccccgtttattaccgtacgacgacgagtagtagtttacgtacgtaccgtacgttggttacccgtaggtaccgttacggtaacccgtacggtaccgtttacggtcgggtaccgg

SEQ ID NO: 29965 - DNA, 617 bp, Homo sapiens
  misc_feature: GYAE6OF02GMY23.1.49.E05.1.454.CMB.1.raw
  modified_base (444)..(444): a, c, t, g, unknown or other
  misc_feature (444)..(444): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctgggcctcagtgatggtctcctgcagtgcttcgtggttacattccttttcccaccgttacggttatgtaagttggttagagaccgaggcccccggaggaggggcttggagtgggatgggatggatcgacgcccttaacggaactaaacgagagtagtaggagagaagttaccgagggacaggagtacatacagttcgaccgacgacacactaccgacgtacgacgacgccgtanagtacggaacgtggacggacgccgtacacgtacgtacgtaggaacgacccgaccggtacctaacgtttacgttacgtcgacgtacgaagtagtaagtttagtcggtcctaacggttcggtcctaggtaccgttacgtaaacccggccgttcggtttacgggacggttacccgg

SEQ ID NO: 29966 - DNA, 534 bp, Homo sapiens
  misc_feature: GYAE6OF02HAT0H.1.49.E05.1.454.CMB.1.raw
  modified_base (407)..(407): a, c, t, g, unknown or other
  misc_feature (407)..(407): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggccccggagaggggcttgagtggatgggatggatcagccttacgggaactaaaacgagagtatggagagagttccagggcagagcatcatcacgcggacacatccacgagtacagcctanacgtagaacttggacggacgcctacagatcgtcgacgacgaccgtccactttatactgacgcgacgtagtattacgtgctacgtggtcctggcttaccggtaacgaccgtcgttacggtcggtaccg

SEQ ID NO: 29967 - DNA, 542 bp, Homo sapiens
  misc_feature: GYAE6OF02F7IS7.1.49.E05.1.454.CMB.1.raw
  modified_base (508)..(508): a, c, t, g, unknown or other
  misc_feature (508)..(508): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccgttaacggaactaaaacgagagtataggagagaagttcgaggcagagtcatcatcaccgcgacacactccacgagtacagacctaacagtaggaactagaggacgcctacagatctagaccgacgaccggcctaacttacttactcgacgacgagagtaattagtgctacgtcggttccnggtctacgtaacccgacgtcgttaggtggtaccg

SEQ ID NO: 29968 - DNA, 750 bp, Homo sapiens
  misc_feature: GYAE6OF02JSLMY.1.49.E05.1.454.CMB.1.raw
  modified_base (239)..(239): a, c, t, g, unknown or other
  misc_feature (239)..(239): n is a, c, g, or t
tcagacgagtgcgtcacgaccggtgctcgatttagagcgactagcaacgacacaaagggggacccaaaaaccgacacccctccttgggagaatcccctagatcacagctcctctaccatggacgggacctggagcatcctttctggtggcagcaggcaacaggtgcccactcccaggttcacctggtgcagtctggagctgtagctgcagaacgccgtgggggcctcagtcgatggtcncctgcagtcgcttctggttactacttcctttaccacttacggtatcgtaagttggttagacgtaccggtacgggccccggtaaggtaccgggggtcttggtaggttggagttgggaggtaggactcggacgtacccggttaaacgggtaaaccgtaaaacgtagggtaacgtaggtagggaaggtaacgggtaacgttaccgggacgggtacgaaggtacgtacacgtacgaccgtacgaccggaccggaacgaccgtaactacccgaccggtacgtaccaccgtaccctaagaccggtagaacgtacggaggaccgcgtacgagtaccgtacgtaccggtaccgaccggtaccggtacccgtaacgtttaaccgtacgtacggtaccggtaacgtaaggttacgttacggttttacgtacggtaaccggttaacggttccggttccggtacgggttacggtaacccggtaacccggttggttacccgggttagggtacccggtacccggg

SEQ ID NO: 29969 - DNA, 608 bp, Homo sapiens
  misc_feature: GYAE6OF02IGKV6.1.49.E05.1.454.CMB.1.raw
  modified_base (319)..(319): a, c, t, g, unknown or other
  misc_feature (319)..(319): n is a, c, g, or t
  modified_base (415)..(415): a, c, t, g, unknown or other
  misc_feature (415)..(415): n is a, c, g, or t
  modified_base (436)..(436): a, c, t, g, unknown or other
  misc_feature (436)..(436): n is a, c, g, or t
tcagacgagtgcgtcacgaccggtgctcgatttagagcgactagcaacaccaaggtggacccaaaaaccacacccctccttgggagaatcccctagatcacagctcctcaccatggacggtacctggagcatccttttcttggtggcagcagcaacaggtgcccactcccaggttcacctggtgcagtctggagctgagctgcagaagcctggggcctcagtgatggtctcctgcagtgcttctggttacatcttttcacctacggtatgaattggttgagacgtaggcccccggaggaggggcttggagtggatgggntggatcgaacgctggacaagtggtaaacaacaaaaaattcaactaaggaacgtttacgaggacagagtcaaccgtttaccagggtacacagtccgngacgattaactatagtagagntagagcgagctagagtactcgaagacgtaccggtactaggtacttagtttttcgcggtaccgtacccgttcggttaaggttcgggtacggttcgtaagtttacgttacggtcctttacgtaattttcggaaccgttccggtacggggtacccgtacgggtaccccgttcggg

SEQ ID NO: 29970 - DNA, 645 bp, Homo sapiens
  misc_feature: GYAE6OF02GZGNQ.1.49.E05.1.454.CMB.1.raw
  modified_base (309)..(309): a, c, t, g, unknown or other
  misc_feature (309)..(309): n is a, c, g, or t
  modified_base (412)..(412): a, c, t, g, unknown or other
  misc_feature (412)..(412): n is a, c, g, or t
  modified_base (606)..(606): a, c, t, g, unknown or other
  misc_feature (606)..(606): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgtcttcgtggttacatttcctttccaccgttacggtatgtaagtttggtgaggacacggccccgggaggngggcttggaggtggagtgggtagtggatcgacgtacccgttaacggaaactaaaacgaggtagtaacgtaggaagaggtaagtaccggagggcgaagacgtanaacgtctaactccgtaacggaccggaacacgtaaccgtacgaacggtaacgtacgaacgtcctaacgtaacgtacggaacttaggacggtacgaccgtagacgacgtctaacggaccgaccgtaccgtacctaacgtttacgtaccgtggccgtaacgagtacgtaatttacgtacgcgttacgtcggttaccnggtacgttacgtaaccgtcgtacggttcggacgtaccgg

SEQ ID NO: 29971 - DNA, 684 bp, Homo sapiens
  misc_feature: GYAE6OF02HOSVN.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtcgtggagctggagctgcagaagccgtggggcctcagtgatggtcctcctgcagtgcttcgtggttacattctttccaccgttacggtatgtaagttggttagacgacgacgggtaccccggaggacggggtcgttgaggtaggaggtgggagtggagtcgacgaccgttaacggaaactaaacgagagtagtaggagaagtaacgtcgagggacaggagtcatacactcgaccggaggaccaccactaccgaacgacgtaacgacgtacccgtaacaacggttacggaacgttaggaacggacgtacccgtagaacgtacgtaccgtacggaaccgaccgaacccggtaccttaacgttttacgttaaccggtacggaccggtacgtaaacggtagtaacgttttacggtaggtacccttaacggttaccggttcccgtagggttacccttaaccgggttaaccgaccggtttcggtttacgggcgggtacccgg

SEQ ID NO: 29972 - DNA, 655 bp, Homo sapiens
  misc_feature: GYAE6OF02IDR8G.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctggttacattcttttccacctacggtatgtagttggttgagacgacgggacccccggaggacggggtcttggaggtggagtgggatgggatcgacgacccgttaacggaactaaacgagtagtagtggagaggtaacgttcgagggcaaggtagtacatcagtacaccggacggacacactaccgagacgtacacgacctacgagtacggtaacgtgaaggacgcctagaacgactcgtacgaccggacgaccggtacctaacgtttacgttaaccgtcggaccgaccggaaggtacgttaacgttttaacggtcggttaaccgtacggttaccgggttacccgttacgggttaccgtttaccggtaaacccgtaccgggtttacccggtttgggtacccggggtaaccggg

SEQ ID NO: 29973 - DNA, 754 bp, Homo sapiens
  misc_feature: GYAE6OF02J2JTD.1.49.E05.1.454.CMB.1.raw
  modified_base (214)..(214): a, c, t, g, unknown or other
  misc_feature (214)..(214): n is a, c, g, or t
tcagacgagtgcgtcacgaccggtgctcgatttagagcgactagcaacacacaaaggggacccaaaaccacaccctccttgggagaatccctagatcacagctcctcaccatggacgggacctggagcatcctttcttggtggcagcagcaacaggtgccactcccaggttcacctggtgcagtctggagctgagctgcagagcctggggcctnagtgatggtctcctgctagtgcttctggttactatccttttccacctacggtactgtaattgggtttgagactacgggcccccggaggagggggtctttggacggtggagtggggacgtgggactcgacggtcccgttaaccggaaactaaaaccaggtaagtagtcggggtagaaggtaacggtttaccggaggggactaacggagttccgtaagtaccaacgttaccgaaccggtaccggggaacctacccgtaactaccccgtaacggtaaccgtacgaaccggtacccttaacgagtacgggtaaccgttacggagggtaacccggtaccctacgtaacggtacgttaccgtacgggaaacccggtacccggtaaccggggcccttaaaccgttttaacgttacccggtcggtaccgggttaacgggaacgttacgttacgtttacggtcccgtacggttacggttccggttacggacggttacccgttaacggaacccggttccggtttcggtacgggttcggttaaccccgggg

SEQ ID NO: 29974 - DNA, 667 bp, Homo sapiens
  misc_feature: GYAE6OF02GVQLY.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctccgtgcagtgcttcgtggttacattctttccacctacggtatgtaattggttgagacgacgggcccccggaggacggggcttggaggtcggagtgggtagtggatcgacgtacccgttaacggaaacgtaaacgagtagtagtggaagagaaggttacagggacgagagtcatcatcgaccgcggacacactaccgacgtacgtacgacgtacctacgaagtacgggtaacgtagggacggtacggtacccgtacgaacgtacgttaccaacggaacccggtaaccgaccgggtacccttaaccgtttaacgtttaaccgttacggaccggacggtaaggacgttagtttacggtgtaccgttacggtaccgggtttccgttagggtaccgttacggtaaccccgttacggttcggtttcggtacgggtacccggg

SEQ ID NO: 29975 - DNA, 767 bp, Homo sapiens
  misc_feature: GYAE6OF02F6LQ0.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttcgtggttacattccttttccaccgttacggtatgtaatttgggttgagtacgacgggacccccggaggacgggggtcttggaggtggagtggggagtggatcgacggtcccgtttaacggaaacttaaaacgaggtaagtaagtagggaagaaggtaacgttaccgaggggtacgaaggtacgtactactctaacgtacgaaccggtacggacgaacgacgtaccgaaccgtaacgtaacgacgtaccgtaaccgtaacgtacggtaacgttacggacgggtacggtacccgtacgtacggtacgttacgtacggtaaccggaaccaacccggggggggggggtaacccttaaccggttttaaccgtttaaccgtacggtaccggtaccgggtaacggtacgttaacgtttaacggttacgttaccgtaaccggttaccgggtttacccggttaccgggttaccggttaccggttaaccccggttaaccggttaccggtttacgggttacgggttaaccccggg

SEQ ID NO: 29976 - DNA, 592 bp, Homo sapiens
  misc_feature: GYAE6OF02G5WML.1.49.E05.1.454.CMB.1.raw
  modified_base (415)..(415): a, c, t, g, unknown or other
  misc_feature (415)..(415): n is a, c, g, or t
  modified_base (460)..(460): a, c, t, g, unknown or other
  misc_feature (460)..(460): n is a, c, g, or t
  modified_base (526)..(526): a, c, t, g, unknown or other
  misc_feature (526)..(526): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgagttggtctcctgcgtagtgtcctttcgtggttactcttccttttccaccgttacggttatgtaagtttggttagagacgacgggccccgggaggcggggtcgttggaggtcgggagtaggggagtggagtcgacgtacccgttaacggaactaaacgagtagtagaggagagtagtcgaggcagagtanatacagtccgaccgacgacactacgacacgacgtacacgtcctanacgtacgaacgtggacggctccgacgacgtatcgtacgacgacgaccgtacctacgttacgtacgngcgagagagttatacgtgacgtcgtcggtcgtaggtcttacgtacctcggtcgttggcggtaccgg

SEQ ID NO: 29977 - DNA, 661 bp, Homo sapiens
  misc_feature: GYAE6OF02G8FLU.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgtcttctggttactattccttttccaccgttacggtatgtaagttggtagagacgacggcccccgggaggacggggtcttggaggtggagtgggagtggatcgacgtacccgttaacggaaactaaaacgagagtagtaggagagtaacgttcgaggcgagtagtacatacactacgaccgacgaccactactaccgacgacgtaccacgacctaacgacgtacggaacgtaggacggacgtccgtacgaagtacttaccgacggaaccgaccgtaccgtacctaacgtttaacgttacgtacgaccggacgtaaggtacgtaagtttacgtcggtaccgtaacggttccggttaccgttacgggtacctttaaccggttaacccgtacgggttaccgtttacgggtaccgggtacccggg

SEQ ID NO: 29978 - DNA, 678 bp, Homo sapiens
  misc_feature: GYAE6OF02IW33O.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtcctcctgcgagtgtccttcgtaggttactacttcctttttacccaccgttaccggtaattaggtaagtttcggtttagaggtaccgaccgggccccccggagggacgggggtcgttaggtagggtgggacggttggggagtgggactcgaccggtaccccgttaacgggaaactaaaacgaggtagtaagtagggaagaagtaacggtaccgaagggcaaggtagtctatacagtacccgaccggacgaccaacctagtaccgaacgtagtaccacgacctaacgagtacgggaaacttaggaacggtacgaccgtacgagactcgtacggacgtaccgaccgacctaaccttagttacgtacgacgacgaggattagttacgtagtaccgtcggtcggtccgtcgggtacctacgggtacccgtacggtcgttcgggaggtacccgg

SEQ ID NO: 29979 - DNA, 607 bp, Homo sapiens
  misc_feature: GYAE6OF02FZPEX.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggttacattcttttccaccgttacggtatgtaattggttgagacacggcccccggaggacggggcttggagtggatcgggatggatcgagtcccgttaacggaactaaaacgagtaagtagtagggagacgtaagttccgaagggcaggtagtcatcacgtcgaccgcgacacactccgacgagtacgacgacctacacgtacggaacgttggaacggtacgccgtacgagtactacgtcgaacgtacgaccggacctacttaagttacgtaggaccgacggtacgtagtattacggttagaccgtacgttcggtaccgttggcttacggtaaccgtacggtcgtttagggcggtaaccgg

SEQ ID NO: 29980 - DNA, 664 bp, Homo sapiens
  misc_feature: GYAE6OF02H5PZX.1.49.E05.1.454.CMB.1.raw
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttctggttacattcttttccactacgtatgaattggtgagacacggccccggagacggggtcttggacgtggagtgggatggactcgacgcccgttaaggaactaaaacgagagtacgtaggagaagtaacgttccgaagggactaagacggtactagtacaacgttaccgaacccggaccggtaacgaacctacgtaccccgaaacggtacggtaacctacggacccttaacgacggttaacggaacttcggaaggaacgtccgtaacgaagtactacgtaggaaccgaacggaaccggtacctaacgtttaacttaaccgtggaaccggtcgaagtacgtaagttttacgtcgacctacggttacggttacctagggtaccttacggtaaacccgtacggtacgttcggtacgggtaacccgg

SEQ ID NO: 29981 - DNA, 741 bp, Homo sapiens
  misc_feature: GYAE6OF02IP8W1.1.49.E05.1.454.CMB.1.raw
  modified_base (598)..(598): a, c, t, g, unknown or other
  misc_feature (598)..(598): n is a, c, g, or t
  modified_base (718)..(718): a, c, t, g, unknown or other
  misc_feature (718)..(718): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttgggtggcagcagcaacgaggtcgccccacctcccgaaggtttccaccgttgggtcgctagtcgtagggacgcgtgagtctgaccgaaggacggtccggtcggggtccctgtaggtgtacgtcggttcctcgtgcgtagtcgtcgttgtacgttactctttccttacgacgttagttagtaggtagtttggacgaacggtaccggtccgggacccgggtaggtacggggtcttagggtagggtcggtaggtacgggtagtacgacgtaccggaacccggttaaccggttaaacggaaaactaaggtaacggtaggtacggtaaggaacggttaaccggtacggtacggacggtacgtaacgtagtaacctacgtaccgaccggtaccgacccggacgtaaccacggtaaaccgaccgtagtaaaccgactaccgtacgttaacggaggtaaccggnggttaacgcggttacacgtagtacgtaccgacgtaacgggacctaccgtaacttacttagcgtacgaggcgtaagtgtattagtcgtcgtacggtcgttcgcgtaccgtcgtaaccggtntcggtacgggtcgacgtcccggg

SEQ ID NO: 29982 - DNA, 792 bp, Homo sapiens
  misc_feature: GYAE6OF02IIK6C.1.49.E05.1.454.CMB.1.raw
  modified_base (278)..(278): a, c, t, g, unknown or other
  misc_feature (278)..(278): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttgggtggcagcagcaacaggtgcccactcccaggttcacctggtgcagtctggagctgagctgcagagccgtgggcctcagtgagtggtctcctgctagtcgcttcgtggttactactcctttccacgttacggtangtaagttggttgagtacgacggccccggtaggagggtcgttggaaggtcggtagtgggatggactccgaggtacccgttaaggaaactaaaacgacgtaagtaacgtagggacgaacggtaacgtaccggaggtacgacgtacgtacgtacgtacgacgtacgaacccggtacgggaaccaacgaccgtaaccgtaaaccggtacggtaaacgtaccgtacctaacgacgggttacggaaacgttacgggaaaccggtaccggttaccaacgggttacgtacgtaacggttaccggaaacccgggtacccggaacccgggttaacctttaaccgggtttaacctttaacccggtacggtaccgggtaaccgttaaccggggttaagttaccgttttaacgggtaacccgtccggtttaaaccgggttccgggttaaccgtttaccggttaacggtttaacccggttaaccgtacccgggtttacggtttaccgggggtacggttaacccggggg

SEQ ID NO: 29983 - DNA, 617 bp, Homo sapiens
  misc_feature: GYAE6OF02GMCLD.1.49.E05.1.454.CMB.1.raw
  modified_base (352)..(352): a, c, t, g, unknown or other
  misc_feature (352)..(352): n is a, c, g, or t
  modified_base (414)..(414): a, c, t, g, unknown or other
  misc_feature (414)..(414): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagacacgggccccggagaggggcttggagtggatgggatggatcacgtcccgttaacggaactaaaaccngtagtagtgggaatagaagttccgagggacaggacgtacatacatccgaaccgcggacacanccaacgagtacagcctaacataggaactggacgacgccctagacgtactcgtacgaaccgaccgtaccgggacctaacgttaacttaccgtacggaccgtacggagtacggtaacttttaggttcggacctaacggttcggttacccgtgggtacccgttacggttaacccgtacggtaccgtttacgggtccgggtaaccgg

SEQ ID NO: 29984 - DNA, 626 bp, Homo sapiens
  misc_feature: GYAE6OF02HB1UJ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgtcttcgtggttacattctttccaccttacggtatgtaattggttgagacgacggccccggagaggggtctggaggtggagtgggatggagtcgacgtccgttaacggaactaaacgagagtagtggaagagtaagtcgaggacgagagtcatacagtccgaccgcgaaccacacgttaccgaacgtacgtaccgacgtacccgtacgaacgtggtaacgtaggaacgggacgtcctacgacgtacgtaccgtacggaaccgaccggtaccgaccttaacgtttaccttacgtcggaccgtgaacgtagtagtttacgttcggtacgtacgtcggttaccgtacggtccttacggtacccgtacgttccgttgggtacggtcccgg

SEQ ID NO: 29985 - DNA, 641 bp, Homo sapiens
  misc_feature: GYAE6OF02G77H8.1.49.E05.1.454.CMB.1.raw
  modified_base (357)..(357): a, c, t, g, unknown or other
  misc_feature (357)..(357): n is a, c, g, or t
  modified_base (441)..(441): a, c, t, g, unknown or other
  misc_feature (441)..(441): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccaccttacggtatgaattggtgaggacacgggcccccggaggaggggcttggaggtcggagtgggatgggatcgacgccgttacggaactaaaacgngtagtagtggagagaacgttcgagggacaggagtcatacacgtcgaccgcgggaacacgactaccgaacgacgtacacgccaanacgtacggaactggaaggtaccgcctacgaacgtcgttacgtacggaaccgtaccgaaccgtaccctaacgtttaacttacgtcggaccgtacggaacggtacgtaagtttacgttcgtacccgtacggttaccggtcccgttacgggtaccttaccggttaaacccgtccggttacggtttcgggtacgggtacccggg

SEQ ID NO: 29986 - DNA, 578 bp, Homo sapiens
  misc_feature: GYAE6OF02H8WNB.1.49.E05.1.454.CMB.1.raw
  modified_base (512)..(512): a, c, t, g, unknown or other
  misc_feature (512)..(512): n is a, c, g, or t
  modified_base (545)..(545): a, c, t, g, unknown or other
  misc_feature (545)..(545): n is a, c, g, or t
  modified_base (570)..(570): a, c, t, g, unknown or other
  misc_feature (570)..(570): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggggcctcagtgatggtctcctgcagtgcttctggttacattccttttccacctacggtatgtaattggttgagacagggcccccggagaggggcttggagtggagtgggatggatcacgccttaacggaaactaaaacgaggtaagtagtagggaagagaaaggttcgagggacaggtagtacatcatccaaccgcggacaacgtactaccgacgtacgtacacgtacctaacagtacggaacttgacggtacggcctacgagtactcgtacgacgacgaccgacctaacttattacncggtacgcgacgagtattatgactagtcggtcnggtacgtcgtaaccgtgtcggttgnggtaccgg

SEQ ID NO: 29987 - DNA, 551 bp, Homo sapiens
  misc_feature: GYAE6OF02FZYE8.1.49.E05.1.454.CMB.1.raw
  modified_base (385)..(385): a, c, t, g, unknown or other
  misc_feature (385)..(385): n is a, c, g, or t
  modified_base (422)..(422): a, c, t, g, unknown or other
  misc_feature (422)..(422): n is a, c, g, or t
  modified_base (516)..(516): a, c, t, g, unknown or other
  misc_feature (516)..(516): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccaccttacggtatgaattggttgagacaggcccccggaggaggggcttggaggtggagtggggatggatcgagtcccgttacggaactaaaacgagagtataggagagaagtcgagggcagagtnatcatcaccgcgacacactccagacgtacagacctanagtggaactggaaggacgcctacagtactcgtagaccgacgaccgcctacttagtacgtcgcgacgagagtattagttcgctacgtcggttcgnggtacctggtaacccacgtcgttgggtggtaccgg

SEQ ID NO: 29988 - DNA, 649 bp, Homo sapiens
  misc_feature: GYAE6OF02HZ2YF.1.49.E05.1.454.CMB.1.raw
  modified_base (218)..(218): a, c, t, g, unknown or other
  misc_feature (218)..(218): n is a, c, g, or t
  modified_base (307)..(307): a, c, t, g, unknown or other
  misc_feature (307)..(307): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctgggcctnagtgatggtctccgtgcagtgcttcgtggttacagttccttttccaccgttacggtattgaagttggttgagtacgacggacccccggnggacggggtcttggaggtggagtgggatgggatcgaggtcccgttacggaactaaacgagagtatggagagtagttacgaggcagagtcatcatcaccggacgacacacaccgacgaagtaccaagacctacgacgtaggaacgtacggaaggacgacctacgacgtacgtacgtacggaccgaccgaaccgggtaccctaacgtttaacgttaccggtcgacggtaccgaagtacgttaactttacggttcggaaccgttacggttaccgggttacccgtacgggtttaccgtaccggttaaacccgtaacccgggtcgtttcgggtaccgggtaacccgg

SEQ ID NO: 29989 - DNA, 621 bp, Homo sapiens
  misc_feature: GYAE6OF02ICSHG.1.49.E05.1.454.CMB.1.raw
  modified_base (426)..(426): a, c, t, g, unknown or other
  misc_feature (426)..(426): n is a, c, g, or t
  modified_base (550)..(550): a, c, t, g, unknown or other
  misc_feature (550)..(550): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcaggtgagtggtctccgtgccaggtcgcttcgtggttactattccttttccacctacggtatgtaagttggttagagaccgacggcccccggagtacgggggtcttggagtggtaagtgggtatgggactacgacgtacccgttaacggaaacgtaaaacgaggtaagtacgtaggaacgaaggtaacgtcgaagggacagacgtnatagactacgaccgacgacacgactacgaacgtagtactacgaccttaacgagtacgaactagggacgaacgaccgtacaagtcgtagtacgaacgaccgaccgctaacgttattacgcgacgngagacgtacgttagtcgactggttacgtccgaggttctaacggtaaccgtaggtcgttcggaggtaaccgg

SEQ ID NO: 29990 - DNA, 618 bp, Homo sapiens
  misc_feature: GYAE6OF02JW7YH.1.49.E05.1.454.CMB.1.raw
  modified_base (251)..(251): a, c, t, g, unknown or other
  misc_feature (251)..(251): n is a, c, g, or t
  modified_base (278)..(278): a, c, t, g, unknown or other
  misc_feature (278)..(278): n is a, c, g, or t
  modified_base (386)..(386): a, c, t, g, unknown or other
  misc_feature (386)..(386): n is a, c, g, or t
tcagacgagtgcgtcacgaccggtgctcgatttagagcgactagcaacacacaaagggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcgagtgatggtctcctgcagtgcttctggttacnttctttccactacgtatgtattggttnagtacgacgggtcccccggaggacggggtcttggaacggtggaggtgggagtggactcacgtccgttaacggaactaaacgagagtagtggagagtacgttcgagggnagacgtcactcatcgaccgtcggacacactcgacggagtacacgtcctacagtacgacgtaggtacggacgtcccgtagacgtacgttacgacggaaccgacccgacggtacccgtaaccttagttaccgtacgacggaccgagtacgtagtttaacggcttacggacgttccgggtcgtcggtacggttaccgtaaaccggtccgtacggttacgggtcgggtaacccggg

SEQ ID NO: 29991 - DNA, 613 bp, Homo sapiens
  misc_feature: GYAE6OF02GZDPL.1.49.E05.1.454.CMB.1.raw
  modified_base (286)..(286): a, c, t, g, unknown or other
  misc_feature (286)..(286): n is a, c, g, or t
  modified_base (414)..(414): a, c, t, g, unknown or other
  misc_feature (414)..(414): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacnggccccggagaggggcttggagtggagtgggatggatcagcccgttacggaactaaaacagagtatggagagtagtacgaggcagagtcatcatcgaccgcggacacactccaacgagacagacctanagtcgaactggacggacgtcctacgagtacgtctacggaaccgaccgtaccgggcccttaacgtttaacgttaccgtacgaccgggtacgaggtacgtaagtttacgtttaacggcccgttaacggtccgggtttaccgtaccgggttccgttaacggttaaccccgaccgggttccgtttagggtcgggtaccccggg

SEQ ID NO: 29992 - DNA, 864 bp, Homo sapiens
  misc_feature: GYAE6OF02I7RHV.1.49.E05.1.454.CMB.1.raw
  modified_base (187)..(187): a, c, t, g, unknown or other
  misc_feature (187)..(187): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtcgcccactcccaggttccaccgtggtncagtctggagctgacgctgcgagaacgccgtggggccctcgagtaggacgttcggtcctccgtgcgaggttcgtaccgtttcgtagggttaacctactttccttttaccccgtaaccgttacgggttatacggttaagtttcgggttaggacggtaccggaaccgggtaccccggtaagggtacggggttcggttaggacgggtaggggtacggttaggggtacgtacggggtaactacccggtaaccggtaaccccgttaaaccggaaaaaccgttaaaacgaaggtaacgtaaggtaacgggtaagggtaaacggtaaccggttacggaacggggtacgtaaggtacgttacgaacgtaacccgtaactacccgggaacccggtaacgggtaaccctaaacccgtacccggtaacgtaccccgggtaaagggtaaccgtaacccgggtaaccctaacggtaaacggtacgggtaaccggtacgggtaagggacccctaccgaccggtaacggtactaccgggtaaaccggaccgaacccgtaaccggtaccgttacttaaacgttccggtcggacgacggtagtacgtttactacggtcctaccggttccgtacggtcccggttaccgtaagttacccggtaaaccgtcggttacgggttcggtacggtaccggg

SEQ ID NO: 29993 - DNA, 705 bp, Homo sapiens
  misc_feature: GYAE6OF02IG8Y7.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcaggtgagtggtcctcctgcagtgcttcgtggttactattctttccacctacggtatagtaattggttagagtacgacgggaccccggaggacgggggtcttaggaggtgggagtggggagtggactcgacggtacccgttaacggaaaccgtaaaacgtaggtaagtagtagggaagaacggtaacggttaccgaagggtacgtaggtacgtaccaagtaccaacgtacccgaacccggaccggtaaccgacctacgtaacccgaaacggtaacgtaaccgaacgtaccctaacgtagtacggtaacgtacggacggaccgtcctacgacgtaactcgtacggaccggaccgtaccgggtaccttaacgtttaacgttaccgtacggaccgtacgtaaggtagttacgtttagtcgacgtacggttaccggttccgtacggtacgttaacggtaccgtaccggtacgttcgggcggtaacccgg

SEQ ID NO: 29994 - DNA, 707 bp, Homo sapiens
  misc_feature: GYAE6OF02F5NBL.1.49.E05.1.454.CMB.1.raw
  modified_base (414)..(414): a, c, t, g, unknown or other
  misc_feature (414)..(414): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcagtgatggtctcctgcagtgcttctggttacattctttccaccgttacggtactgtaagttggttagagacgacgggccccggaggagggccgttggagtggacgtggggagtggatcgacgtacccgttaacggtaaacctaaacgacggtagtagtagggaagacgtaagttaccgagggacaggtacgtanacgtacgactaccgaccgacggacctaacgtactaaccgaacggtacgttaacgaccgtaccctaacgtaacggtaacggtaacgttacgggaacggtaccggtaccctacgtacgtacttaccgtacggaacccggtaacggacccgtaccgtaaccgtttaacgttaaccgtcggtaaccggacgtaacggtagttacgtttacgtcggtacggttaccgtaccgggttccgtaccggttacggttaacccgttaaccggaaccggttcggttcgggtagggtaacccggg

SEQ ID NO: 29995 - DNA, 654 bp, Homo sapiens
  misc_feature: GYAE6OF02FYEQ5.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgtcttctggttactattctttccaccttacggtatgtaattggttgagacgacggccccgggagacggggtcgttggaggtggagtgggagtggagtcgacggtacccgttaacggaaactaaaacgagagtagtaggaagtagacgttcgaggacgagagtacatacagtaccgacgacgacacactaccgaacgacgtacgacgtacctaacgtaacgtacggaacgttaggaacggacgtcccgacgacgtacgtccgtacggaaccgaccgtaaccgggtacctaaccgttttactaacgtccgtacggacgtaaggtagtacgtttagttcggaaccgttacggttaccggttaccgttacggtaccgttaaccggtaaccgtaccggttacgttttgggccgggtaccgg

SEQ ID NO: 29996 - DNA, 927 bp, Homo sapiens
  misc_feature: GYAE6OF02GEFKT.1.49.E05.1.454.CMB.1.raw
tcagacgagtgcgtcacgaccggtgctcgatttagagcgactagcaacggacgaacaaaggggacccaaaaccactacccgtcccttgggaggaaactccctaggaatccacagctctcaccattcggaccgggacctggacgcagtcccttttccttggtggccacggcaagtcgaacgtaggtcgcccacgttccccaaggttccaacccgttgggttgttcacgttccgtgggagcgtcggacgccttcgcgagaagccgtcggggacctcgagttagatcggtcctcctgcagtcgtctcgtggtacacgttcgtttccaccgtacggtacgtgtaacttcggttacgaggtacgtacggtcccccggtaggtacggggtccgtttacggaacggttcggaacgttcggggtaacgttcgggtactccggtaccggtaccccggtttaacggaaaccgtttaaaacggacggtaacggttaaggttacggggaaggtaaggtaaacggtttcccgtaacggggtacaaacggtacgtaaccgtaacttaaccgaacgttaccggaacccggacggggaacctaaccgtaacgtaaccccggtaacggttaaccgtaaccgacggttaaccccgtttaaacgtaaccgttacgggtaaaccgttacgggaacggtaaccggaccccgttaacggaacggttaccgttcccggttaacggtaaccggttaccgggaacccgggtacccgtaaccgttttaaacggtttaaccgcggtaaccgggtaaccgtaacggtacggttaacgtttacgggtttaccggaccggttaacccgtttacgggttaccccgtaggggttacccttaccgggtttaaacccgttaccggtttaccgggtttaccgggtttcccgggtaaccccgg

SEQ ID NO: 29997 - DNA, 593 bp, Homo sapiens
  misc_feature: GYAE6OF02GSXGL.1.49.E05.1.454.CMB.1.raw
  modified_base (446)..(446): a, c, t, g, unknown or other
  misc_feature (446)..(446): n is a, c, g, or t
  modified_base (585)..(585): a, c, t, g, unknown or other
  misc_feature (585)..(585): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtcctcctgcagtgtcttcgtggttacattcttttccactacggtatgtagtttggtgagtacgacgggcccccggaggtacggggtcttaggacggtagggagtcggggtagtgggatcgacgtacccgttaacggaaactaaaacgagagtagtggaagtagtacgtcgaggcagagtcatcatccgacgcgacacactacgagacgtacagacctanagtacgaacgtggacggacgaccgtagacgtctacgagaaccgacgaccgactaactttactacgcgacgacgagtagtaatttagtcgactacggttcggtcgttacggtcgtaccgtaccgtacgtcgtttacgggnggtaccgg

SEQ ID NO: 29998 - DNA, 721 bp, Homo sapiens
  misc_feature: GYAE6OF02JKHAH.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagaagccgtggggcctcgagtgagtggtctcctgcagtgtcttctggttacattcctttccaccgttacggtatagtaattggttagagtaccgacggacccccggaggacggggtcgttcggaggtggaggtggagtggagtacgacgtacccgttaacggaaactaaacgagtagtagtgggaacgtagtaacgttacgaggacgtaggacgtcaacgtacgtacgtaccgaccgtaccggaacctactaaccgccgaaacggtacgtaaccgaccgtaacgtaacgtaggtacgggtaacgtacggaacgggtactacccgtagtaacgtacttacgtaccggaacgaacccgaccggtaacccgttaacctttaagttaccgtacgacggtaccggaaggttacgttaacgtttaggttaccgtacgttaaccgggttccggttaccggttcggtaccgtttaaccggtaacccttaccgggttaccggtttacgggtaccgggttaacccggg

SEQ ID NO: 29999 - DNA, 647 bp, Homo sapiens
  misc_feature: GYAE6OF02FQLJE.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtgggcctcgagtgatggtctcctgctagtcgcttctggttactattctttccacgtacgtatgtaagttggtgagacgacggccccggaggacggggtcttggaggtggagtgggagtggatcgtacgtaccgttaacggaacgtaaacagaagtagtacggagagtaaggttcgaggacgagagtacgatacagtaccgacgcgaccacgactaccgaacgtacgtacgacgtaccctacgaacgtacggtaacggtgaacggacgtaccgtaccgagtacgtcgtacgaaccgtaacgaccgtacctaacgtttacgttaccgtcgtcgacgtaagtagtaacgtttacgttaacgaccgttacggtacgttccggtttacggtaccgttaccggtaaacccgtaccgggtcggttacgggtacggtacccggg

SEQ ID NO: 30000 - DNA, 640 bp, Homo sapiens
  misc_feature: GYAE6OF02GTEMO.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccactacgtatgtaattggttgagtacgacggcccccggaggaggggtcttggaggtggagtgggagtggatcgacgtcccttaacggaaactaaaacgagaagtagtaggaagagtacgttaccgaggacgaggtacgtacgagtactacgtccgaaccggccggtaacaccgtactacccgaacgtacggtaacgacgtacctacgtagacggtaacgtggaacggtacgacccgtagacgtacgtcgtacggaaccgtaaccgtaccggtacctaacgttttaacgtaccgtcggccgacgtacgaggttacttagtcgtcctaacgtccgttaccgtggtacctaccggtaaccgacgttcgttacggtcggtaccgg

SEQ ID NO: 30001 - DNA, 590 bp, Homo sapiens
  misc_feature: GYAE6OF02H58HN.1.49.E05.1.454.CMB.1.raw
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtgcccactcccaggttcacctggtgcagtctggagctgagctgcagagcctggggcctcagtgatggtctccgtgcagtgcttctggttacattcttttccactacggtatgaattggttgagactacgggcccccggtagacgggggctttcgaggtggatgggatggatcgagcccgttaggaaactaaacagagtatggagagaagttccgaagggcaaggacgtcatcagtcaccggcgacacactccgacgagtacacgacctacatacggaactggacggacgtcctagagtactcgtaggaaccgacgaccgggcctaactttagttaacctggtacgcggtaacgagttactttaagtcgacctacgtcgggttaccgtggtcgttacgtaacccgtacggtcgtttacgggtggtaacccgg

SEQ ID NO: 30002 - DNA, 665 bp, Homo sapiens
  misc_feature: GYAE6OF02F7RBG.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctggttacattctttccaccgttacgtatgtaattggttgagacgacggcccccggagagggggtcttggaggtggagtggggatgggatcgacgtcccgttaacggaaactaaacgagagtagtggagagacgttcgagggcaagagtcatcgaatccgaaccggccggaacaccgtactacccgaacggtacgaccaacgtaccctacgaagtacggaacttcgggaacggacgtacccgtacgaagtaccgttacgtacggaccgaacgacccggtaccgtacctttaaagttccgtacggtaccggtaccgaaggtacgttaacgttaacgtttcggaacccgttacgttccgggttacccgtagggtaccttacggttaaacccgaccggtttccgtttagggacccgggttaaccgg

SEQ ID NO: 30003 - DNA, 653 bp, Homo sapiens
  misc_feature: GYAE6OF02HKEO6.1.49.E05.1.454.CMB.1.raw
  modified_base (570)..(570): a, c, t, g, unknown or other
  misc_feature (570)..(570): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctccgtgcagtgcttctggttactacttccttttccaaccgttacggtattacgtaagtttggttagaagtaacgacgggcccccggaaggacggggtcgttaggaggtggaagtgggtagtcggatacgacgtaccgttaacggaaacgttaaaacgagtagtaagtggaacgaagtaacgttaccgaggacaaggtagtcaatacgactaccgaacccggacggaaccaacgactaacccgaacggtaacgtaacgaccgtacctaacgaagtacgaacgttagacggaacgtcctacgatagcgtagaccgaacgacgtacctacgttacgttaacngaccgagtacgagtagtttaatcggacgtacgtacggttcgtggtacctacggtaacccgaccgttcgttagggtgtacccgg

SEQ ID NO: 30004 - DNA, 623 bp, Homo sapiens
  misc_feature: GYAE6OF02HA9BY.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctcctgcagtgtcttcgtggttacattctttccaccgtacggtatgtaagttggttagacgacgacggcccccggaggtacggggtcttggacggtggtagtgggagtggatacgacgtacccgttaacggaactaaacgtagagtagtaggagagtaacgtcgaggacgaggagtacatcacgtcgaccgacgacacgactaccgacgacgtacgacgtacctaacgtacgtaggtaacgtaggacggaccgtacctacgacgtacgtacgtacggaaccgacgacccggtaccttaacgttacttacgtcgaccgtacgagacgtattacgtcgacgtacggtcggttaccgtaggtacttaccggtacctacggtcgttggtcggtaccgg

SEQ ID NO: 30005 - DNA, 865 bp, Homo sapiens
  misc_feature: GYAE6OF02HTPFQ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagccgtggggcctcgagtgatggtctctgcagtgcttctggttacattccttttaccaccgttacggtattcgtaattggttagagacgtacgggcccccggaggacggggccgttggacggtagggtagtaggggtacgtgggtaactccgaacggtaccccgtttaaacggaaaaccgttaaaaacgaaggtaacggttaaagtaggggaaaggtaaacggtaaaggtttacccggaaggggtaccgaaagggtaacggttaaccgtaaagttcgtaaacgtaccggtaacccgggaccggggaacctaaccgtaaacgttaccccgaaacgggtaacgtaaccgaaccggtacccttaaacgtacggttaccgggaaacgttacgggaacgggtaccggtaccctaaccgaacggtaaccttaccggttacggtaaacccggaaccggaacccgggtacccttaaacccgtttagtttaacccggttccggacccgggtaacgggtaacggtaggtttaaacgttttaacgggttacggttacccgttaaccgggtttccgggttaccccggtttacgggttaaccccgtttaaccgggttaaacccccggtaacccggtttacggttttaccggggtacgggggttaaccccggg

SEQ ID NO: 30006 - DNA, 694 bp, Homo sapiens
  misc_feature: GYAE6OF02I1RTR.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtggggcctcagtgatggtcctccgtgctagtgcttcgtaggttacattcctttccaccgtacggtatggtaattggttagagaccgacggacccccggaggtaacggggtcgttaggacggtgggaacgtggggaactgggtactacgacgtacccgttaacggaaactaaaaccgaggtaagtagtagggaagtaacggtaacgttaccgaagggactaaggtaacgttacacgtacgaactaccgaaccggtacgaaccaacgtaccgaaccgaacgaacgtaaccgacgtacctaacgagtacgggaactggacggtacgtacacgtagactcgtacgaacgacgaccgtaccgtaacttacgttaccgcggccggtaagaacggtattaacgttaggttaccgtaaccgtaggtacccggttacgtacggttaccttaaccggtaaccgtacgtcggttaccgggtcgtaacccggg

SEQ ID NO: 30007 - DNA, 691 bp, Homo sapiens
  misc_feature: GYAE6OF02G9KCG.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctcctgcagtgcttctggttacattccttttccacgttacggtatacgtaattggtgagacgtacggcccccggaggacggggtcttggaggtggagtgggatggatcgacgtacccgttaacggaaactaaaacgaggagtagtaggagtagaacgttccgaggacaggtagtctagtacagtccgaaccgcggtaacacgtactacccgaacggtacgtacgacgaccctaacgacgtacggaaccgttagggaacgggtacgacccgtacgaacgtaacttacgtacggaaccgtacccggaaccggtaccctaacgtttaaccgttaacgtaccggtaccgggacgtaacggtacgtaacgttttacggtaccgtaccgtaacggtttccgggtcccgtttaggacccgtttaacggtaaacccgttacggttaccgttacgggtcggggtaacccgg

SEQ ID NO: 30008 - DNA, 670 bp, Homo sapiens
  misc_feature: GYAE6OF02GHZTL.1.49.E05.1.454.CMB.1.raw
tcagacgagtgcgtcacgaccggtgctcgatttagagcgactagcaacacacaaaggggacccaaaaaaccacacccctccttgggagaatcccctagatcacacgctcctcaccatggacgggacctggagcatccttttcttggtggcagcagcaacaggtgcccactcccaggttcacctggtgcagtctggagctgagctgcagaagccgtgggcctcgagtgagtggtctccgtgcagtcgtcttcgtggttactacttctttccaccgttacgtatagtagttggttagacgtacgccgggaccccggaggtacgggtcgttggaggtggagtggggagtggatcgacgtacccgtaacggaactaaagagtaagtagtaggagtacgtaacgtcgaggcgagtagtcatcagtaccgacgacgtaacacgactaccaacggtactacgacgacctacgacgtacgaacgtggacggacgtaccgtgtaacgtacttacgtacgggaaccgacgtacccggtaccttaacgtttaacgtaccgtcggaaccggtacggtaacgtagttagttttaacggtcggtaaccttaccggttcggttaccggttacgtacggttacccgttaaaccggtcggttacgggtttcgggtaccggggtccgg

SEQ ID NO: 30009 - DNA, 586 bp, Homo sapiens
  misc_feature: GYAE6OF02JM2RF.1.49.E05.1.454.CMB.1.raw
  modified_base (358)..(358): a, c, t, g, unknown or other
  misc_feature (358)..(358): n is a, c, g, or t
  modified_base (442)..(442): a, c, t, g, unknown or other
  misc_feature (442)..(442): n is a, c, g, or t
  modified_base (454)..(454): a, c, t, g, unknown or other
  misc_feature (454)..(454): n is a, c, g, or t
  modified_base (521)..(521): a, c, t, g, unknown or other
  misc_feature (521)..(521): n is a, c, g, or t
tcagacgagtgcgtcacgaccggtgctcgatttagagcgactagcaacacacaaaggggacccaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcgagtgatggtctcctgcagtcgcttctggttacattcgtttccaccgtacgtatcgaattggtgagtacacggcccccggagacggggtcttggacggtggagttgggatgggactcgacgccgttacggaactaaacgngagtacgtggagtagacgtcgtaagggcaggagtactagtacatcgtaccgcgggacacgactaccacggaataccgagcctanacgtagtaacgngtaggacgtccacgagacttcgaggtaaccacgaccggcctaacgttatccgtagtaccggctaagngtaacgttgtcgcgtacgttcggccgttggaccttacggtacctaccgtcgttgggacgtaccgg

SEQ ID NO: 30010 - DNA, 781 bp, Homo sapiens
  misc_feature: GYAE6OF02I7O93.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagacgccgtgggcctcagtgagtggtcctccgtgacctagtcgtctttcgtggttacctacgttcctttacccgaaccgttacggttattaggttaagtttcgggttagaacggtaccgacgggtcccccgggagggtacggggtcgttaggtacgggttggtaacggtgggtaggtcggtacgtaccgtaccggttacccgttaacgggtaaacgtaaacgtaggtaggtaacgtagggacggtaagtacgttacggaggacgtaggtacgtactagtacctacgtaccggaccgtacggaccaaccgtacgtacccgaaacggtaccgtaccgtaaccgtacctacggtaacggtaccggaacggttaacggacggtacgtaacccgttacgaacgtaccgtacgtaccggaacccgtaccgtaaccggtaccttaaccgttacgttaccgcggtaacggaccgagtacgtttaacgttacggtccgtacgttaccgggttaccggtaccggttaggtacccgttaaccggttaaccggtccgggtttaccgttacgggtacccgggtaacccggg

SEQ ID NO: 30011 - DNA, 661 bp, Homo sapiens
  misc_feature: GYAE6OF02IGHI9.1.49.E05.1.454.CMB.1.raw
  modified_base (247)..(247): a, c, t, g, unknown or other
  misc_feature (247)..(247): n is a, c, g, or t
tcagacgagtgcgtcacgaccggtgctcgatttagagcgactagcaacacacaaaggggacccaaaaaccacacccctccttgggagaatccctagatcacagctcctcaccatggacgggacctggagcatcctttcttggtggcagcagcaacaggtgcccactcccaggttcacctggtgcagtctggagctgagctgcagagctgggcctcagtgatggtctctgcagtgcttcgtggttacnttcctttccaccgttaggtactgtaacgttggttgacgtacgtcggccccggtaggacgggtcgttggagtggacgtggagtggtactcgacggtcccgttaaggaaaccgtaaacgacgtaaggtacgtagggaacggtagtaacggttacccggtagggtacgaacggtacgtacgtaactacgtacgtaccgaccggacgtaacacctacgtaccgtaacgtacgtaacgacgtaccgttaactacggtaggtaactcgggaacgtacgccctagtacgacttcgagaccgaccgaccgtactaccgtttaataccgtgtccgtagacgtaagtgtttacgtacggtacctacgttacggtccgttacggtccgtaaccggttacctccggtacgtttcggacgtacccgg

SEQ ID NO: 30012 - DNA, 580 bp, Homo sapiens
  misc_feature: GYAE6OF02GD542.1.49.E05.1.454.CMB.1.raw
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
  modified_base (375)..(375): a, c, t, g, unknown or other
  misc_feature (375)..(375): n is a, c, g, or t
  modified_base (434)..(434): a, c, t, g, unknown or other
  misc_feature (434)..(434): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagccgtggggcctcgagtgatggtcctcctgcagtgcttctggttacatctttccactacgtatgtattgtgagacncggccccggagngggtcttgagtggagtgggatggatcgagtcccgttaagaactaaacgagagtatggagagacgttcgaggcagagtcancatcacgcgacacactaccgacgagtacacgcctacgagtcggaacgtgagacgcctanacgtatcgtacgaaccgaccgtacggaccctacgtttacttaccgtggccgtacgaaggtagttatttacgttcgaccgttaccggttcggtaccgtaggttcctaacggttaacccgtacggtcgtttacggggtcggtacccgg

SEQ ID NO: 30013 - DNA, 761 bp, Homo sapiens
  misc_feature: GYAE6OF02HPFZ3.1.49.E05.1.454.CMB.1.raw
  modified_base (195)..(195): a, c, t, g, unknown or other
  misc_feature (195)..(195): n is a, c, g, or t
  modified_base (406)..(406): a, c, t, g, unknown or other
  misc_feature (406)..(406): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctgganctgagctgcagaagcctgggcctcagtgatggtctcctgcagtgcttcgtggttacattccttttccaccgttacggtatgtaattggttgacgacgacgggcccccggaggaggggtcttggacgttggagtgggagtggatcgacgtcccgttaacggaaactaaacgagtagtagtggagtagaagttcgaggacaggtagtacgtanactatccgaaccggtaccggaacaccgtaacgtacccgaacgtacggttaaccgaacggaccctaagaacgttacggaaacgttcgggaacgggtaaccgtacccgtacgtaacggtaacttacgggttaaccggaaaccggtacccgaaccggggttaaccccttaacggttttaaaccgttacccggttaacggtacccggacgggttaacgggtaacgtttaacggttttaaccggttacggttaaccggttacccggttacgggtttaccccgttaggggttacccggtttaaccggtaaacccggttaccgggtttacggtttaccggggtacgggtttaacccccgggg

SEQ ID NO: 30014 - DNA, 722 bp, Homo sapiens
  misc_feature: GYAE6OF02IXFXR.1.49.E05.1.454.CMB.1.raw
  modified_base (243)..(243): a, c, t, g, unknown or other
  misc_feature (243)..(243): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtgcagcagcaacaggtcgcccacctcccaggttccaccgtggtgcagtctggagctgagctgcagaacgccgtgggcctcgagtgagtggtctcctgcngtgtcttcgtggttacacttcctttccaccgttacggttatagtaagtttggttgagaccgtaccgggccccggtaggtacgggtcgttaggaggtaggaggttagggagttagggactcgacgtaccgtaacggtaaacgtaaacgagtacggtagtagggaagtaaggtaacgttccggagggacgaaggtacgtacgacttacgtactacccgaccgggaccggaacctaaccgtaacgtacccggaacggtaaccgtaccgtaacgacccgtaaacgacggtacggtaaaccgtagggaacggaccgtacccgtaagtaacggtcgttaccgtaacggaacccgaaccggtaccgttaaccctaacgtttaacgttaacgccggacggacgtaagtacgttaagttaccgttcggtaactccggttcggtaccgtacggttacacggttaccgacgtcggttcgggacgtccggg

SEQ ID NO: 30015 - DNA, 781 bp, Homo sapiens
  misc_feature: GYAE6OF02JAT9N.1.49.E05.1.454.CMB.1.raw
tcagacgagtgcgtcacgaccggtgctcgatttagagcgactagcaacaccaaggtggacccaaaaaccaacacccctcccttgggagaatcccctagatcacagctcctcacccatggacgggacctggagcatccttttcttggtggcagcagcaacaggtgcccactcccaggttcacctggtgcagtctggagctgagctgcagaagccgtgggcctcagtgagtggtctcctgcagtgcttactggttactattctttccactacggtattgaagttggttgagacgtacgggacccccggaggagggggtccgttagaggtgggacggtaggggtaagtcgggaacttaccggaacggttaccccgttaaccgggtaaacctaaaaaaccggtaggtaacggttaagtacgggggtaaagtaacgggtaaacggtttacccggaacggggtactaaagggtacgttacgtaaacgttccaaccgtttacccggaaacccggtaccggggaaacctaacccgtaaccgttaccccggaaacgggtaaccgtaaccgtaaccggtacccttaaacgaacgttaacgggtaaccgtaagggaaccggacggtacccgtacgtaacgtagtccgttacggaaccggtaacgacccggtacctaaccttacggttaacacgacggtacgtaacggagttaagttacttacggaccgtaccgttgggtcccgttagaccgttaaccggttaaccgaccgttgtttacggtcgggtaacccg

SEQ ID NO: 30016 - DNA, 697 bp, Homo sapiens
  misc_feature: GYAE6OF02IX55I.1.49.E05.1.454.CMB.1.raw
  modified_base (351)..(351): a, c, t, g, unknown or other
  misc_feature (351)..(351): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctggttacattcctttccacctacggtatgaattggttgagacacggccccggagacggggcttggaggtggagtgggagtggatcgacgcccgttaaggaactaaaanagagtagaggagaggtagtaccgaggcaggagatatcaagtccgaccgacggtacaactacgtacccgaacgtacggtaaccacggtaccctaacgaagtacgggaaaccttgggaaccgggtacgacccgttaccgaacgggtacttaccgaacgggtaaccgaacccgtaacccggggtacccttaaacgtttaccgttttaaaccggcgggtacccggaacgggtaacgttacgtaacggttttacgtttaccggacttaaacggtttccggggtaccctttagggtacccgtttaacggttaaccccgtacccgggttggttttacgggtccgggtaaccgg

SEQ ID NO: 30017 - DNA, 590 bp, Homo sapiens
  misc_feature: GYAE6OF02F5N4W.1.49.E05.1.454.CMB.1.raw
  modified_base (582)..(582): a, c, t, g, unknown or other
  misc_feature (582)..(582): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggtacatcttttccacctacggtatgaattggttgagacaggcccccggagagggggcttggagtggagtggggatgggatcgacgtacccgttaacgggaaacttaaaacgaggaagtagtagggaggagtaacgttaccgaggggaccaggagtcagtcatccacggcggaaccacactccacggtatacagccctacagtacggaacgttggacggacgccctacgagtactacgtacggacgaccgaaccggacctaactttacttacgtcggcgaccgagagtatttagtcgacttacgtcgtccgtggtctacggtacccacgtcgttggnggtaccgg

SEQ ID NO: 30018 - DNA, 758 bp, Homo sapiens
  misc_feature: GYAE6OF02H1QE7.1.49.E05.1.454.CMB.1.raw
  modified_base (257)..(257): a, c, t, g, unknown or other
  misc_feature (257)..(257): n is a, c, g, or t
tcagacgagtgcgtcacgaccggtgctcgatttagagcgactagcaacacacaaagggaccaaaaaccacaccctccttggagaatccctagatcacagctcctcaccatggacgggacctggagcatccttttcttggtggcagcagcaacaggtgcccacctcccaggtcacctggtgcagtctggagctggagctgcagaacgccgtggggcctcgagtgagtggtctcctgctagtcgtcttcgtcggttacncgtttccttttcctaccgtaacggttattagtaacgttgggttagagtacgacgggtaccccggaggacgggtccttggaggtcgggtaaggtgggtacgtgggtacgttacacggtacccgtttaaacggaaacgtaaaaacgtggtaacgtaggttaggaagtaaggaacggttacggaacggggactaacgggagtacgtaagtaaccgtacgtacccgggtaaccgacggaaccgtaaccgtaacgttaacccgaacgtaacggtaaaccgaccgtaccttaaaccgtaggttaacgggtaaacgttccggtaaacggaaccgtacccgttaacgaggtaaccgtaccggtacgaaaccgacccgtaaaccgaccgttaacttttaaacggtaccctacggaccggtaacgagtaacggtttacttaacgtcgtaacggtcttacggttaccctggtaccgtaacggttaccacgggttcttacgggtgtaacccgg

SEQ ID NO: 30019 - DNA, 632 bp, Homo sapiens
  misc_feature: GYAE6OF02JKG5P.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcaggtgcttctggttacatcttttccacctacggtatgattggttgagtcaggcccccggagaggggcttgagtcggatgggagtggatcgacgtccgttaacggaactaaaaccgagaagtagtacggagaagtaagtttaccggagggacgaaggagtacatactagttaccgaccggacggacacgtacgtacccaacggtaacgtaaccgtacgtacccgtaactaacgtaggtaaaccgtaggagggtacgaccctgacgtactcgtagaccgaccgaccgtaccgtacgttacttacgtcggacgacgacgtacgttatacgttcgagtaccgttacggtccgttaggaccttacggtaacccctaggtccgttagggtccggtaacccgg

SEQ ID NO: 30020 - DNA, 664 bp, Homo sapiens
  misc_feature: GYAE6OF02GXZ34.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatcggtctcctgcagtcgtcttcgtggttactattccttttccaccgttacggtattgtaagttggttagagtaccgacgggacccccggtaggtacggggtcttggaggttcgggaggttgggattgggactacgaaccggtacccgttaaacggtaaaaccgtaaaaacgaaggtaagttaagtagggaaaggtaacggtaacggttaccgaaggggacaggtacgtacactacgagtaccgaccggacgacacgtacgtacccgaacgtacgtacacgtacctaacgacgtacggaacgtagaacgggacgtacctagacgtacgtaccgtagacgacgtaccggaccttacgttactacgtcgacgagacgtagtacgttagtcgacgtacgttcgtccgtagtcgtacgtaaccgtcgtcgttacggtcggtacg

SEQ ID NO: 30021 - DNA, 688 bp, Homo sapiens
  misc_feature: GYAE6OF02G9P9X.1.49.E05.1.454.CMB.1.raw
  modified_base (660)..(660): a, c, t, g, unknown or other
  misc_feature (660)..(660): n is a, c, g, or t
tcagacgagtgcgtcacgaccggtgctcgatttagagcgactagcaacaccaaggtggacccaaaaaccacacccctccttgggagaatcccctagatcacagctccctcaccatggacgggacctggagcatccttttcttggtggcagcagcaacaggtgcccactcccaggttcacctggtgcagtctggagctgagctgcagaagcctggggcctcagtgatggtctccgtgcagtgcttctggttacattctttccacctacggtatagtaagttggttgagtacgcggacccccggagtacggggcgttaggaggtggagtgggactgggatccgacggtcccgttaacggaaactaaaacgagacgtagtgggaagagtaaggttaccgaggacgaaggacggtactaagtcgtacgtaccgaccggcggaacaacgtactacccgaacgtacgtaactaacgctaacgaggttacggaacgttaggaacgggtacgcccgtagaagtacgtacgtacggaaccgaacccggacccgggtaccctaaccgttttacgtttacccggtaggtaccccggtaagaaccggtagtacgtttttacgtacgggaccttacggtcggttacccgttcggtacgtaaccggttaacccncgggtaccgttttggggacggtacccgg

SEQ ID NO: 30022 - DNA, 883 bp, Homo sapiens
  misc_feature: GYAE6OF02JTIKY.1.49.E05.1.454.CMB.1.raw
  modified_base (847)..(847): a, c, t, g, unknown or other
  misc_feature (847)..(847): n is a, c, g, or t
tcagacgagtgcgtcacgaccggtgctcgatttagagcgactagcaacacacaaagggaccaaaaccaacaccctcctggagaatcccctagatcacagctcctcaccatggacgggacctggagcatccttttcttggtggcagcagcaacaggtcgcccacctcccgaggttcaccgtggtgcagtcgtggagctgagctgcagaacgccgtgggcctcagtcgagtggtctcctagtcgagtcgtccttcgttcggttactactttccgttttcccaaccgttacggttagttagtaaacgtttgggttacggtaaggtacccggaaccgggtccccgggtaacggggtaaggggtccgttttaggggaacggtgggtacggtaggggtaaggttcggtactaccgtacggttacccggttaaaacgggtaaaacctaaaaccggtaaggttaaaccggttacggttaaacggggtaaacggtaacggggttaaaaccggttttacccgggtaagggggaaacccttaagggttaaccggtttaccgtaaaacgtttaccggtaaacccggttaacccgggttaacccgggaacccgggttaaacccgtacccgggttaaaccctttaacccggaaccgggtttaaacccgggtaaacccggttacgtaacccgttaaacggtacgtaacgggtaaccgtaacgggtaacggtacgttaacccgtacggtacgtaacgttaccggttaacgacccgtaaccggtacccgtaaccgttacttaacgttacgttaccggacgttacgtaacgtacgtaattacgtacgtcgtacgtcggttaccgnggtacttaccgaacgtcgtcggtttggaccgtacgg

SEQ ID NO: 30023 - DNA, 770 bp, Homo sapiens
  misc_feature: GYAE6OF02JU680.1.49.E05.1.454.CMB.1.raw
tcagacgagtgcgtcacgaccggtgctcgatttagagcgactagcaacacacaaaggggaccaaaaccacacccctccttggagaatccctagatcacagctcctcaccatgggacgggacctggagcatcctttcttggtggcagcagcaacaggtgcccactcccaggttcctacctggtcgcgagtctggagctgagctgacagaagccgtggggcctcgagtcgagtcggtctccgtgctagtcgcgtttctggttaccacttcgttttccaaccttacggttaactgttaaacgttcgggttagtaacgacgtaccgggacccccggtagggacgggggtcttacggaggttacgggtaggtacgggtagttcggggaacttaccggacggttaccccgttaaacggggtaaacgttaaaaacggacgtaaggtaacggtcgggtaacgggaacgtaaccggtttaccggaagggtacctaagggtacctaacgtacgtaactaccggttacgacccggaccgggtaaccaacgtaccgtaaccgtaacggtaacggtaccgacgtaacccgtaactaaacggtcggtaaacggttcggaaaggaccgtacccgtaacgtaacggtacttacgtaacggacccgaaccggaccgtaccgtacttaacggtaccgtacggcggtaacgagtacttaggtacttcggaacgtacttacggtccgaggttccaacggtaccgtacggtaccgtttggaccggtaccgg

SEQ ID NO: 30024 - DNA, 928 bp, Homo sapiens
  misc_feature: GYAE6OF02F54L4.1.49.E05.1.454.CMB.1.raw
  modified_base (154)..(154): a, c, t, g, unknown or other
  misc_feature (154)..(154): n is a, c, g, or t
  modified_base (415)..(415): a, c, t, g, unknown or other
  misc_feature (415)..(415): n is a, c, g, or t
tcagacgagtgcgtcacgaccggtgctcgatttagagcgactagcaacacacaaagggacccaaaaccacacccctccttgggagaatcccctagatcacagctcctcaccatggacgggacctggagcatccttttcttggtgcagcagcaanaggtgcccactcccgaggttccaccgtggtgaccagtctggacgctgagctgcagagccgtgggcctacagttgctcgggttcctaccgtgaccgtagttggccttttcgacgggtttacctatttcccgttttaccgtaaacccgttaacgggttactagttaaacggtttcgggttagtaaccggtaccgaaccggggacccccggggtaggtaacgggggggtctttacgggaaggttccggtaaggtacggggttanagggtacttacccggaacgttaacccgttaaacgggtaaaactaaaaaccgtgggtaaaacgttacgtaagggaaacggagttaaccgggttaacgacgggacttaggaaacggtcgtaaataccggtaactacccggaacggtaaccgggaccttaaaccgacgtttaacccccgtaaaggtaccggtaaacccaaacgggtacccctaaacgggttacgaacggttaaacggttaacggaccgggtactaacccggtactaaacggtcggaaccgttacggaaacccggttaacccgaccgggttaaccccttaaaacggttaacctttaaccggggaacccttagggggaacccgttaaggaacccggttttaatttaaccggtttaaacgacccgggttaaacccttacccgggggtttacgtttaaccccggggtacggtttaaacccttaaaccccgggtaacccgggttttcgtttaccggggggtttacccggttaccccggggg

SEQ ID NO: 30025 - DNA, 653 bp, Homo sapiens
  misc_feature: GYAE6OF02H0Y30.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatggtctcctgcagtgcttctggttacattctttccacctacggtatgaagttggttgagacgtacgggcccccgggaggacggggtccttggacggtggacgtggggatgggatcgaacgtacccgttaacggaaactaaaacgagaacgtagtggagagtaagtccgaagggacaggagtacatacgatcaaccggccggaacaaccgtactacccgaacgacgtaccgtacgacctaactagtacggaactaggaacggaccacccgtacgtacacgttcgacgaaccgaaccgaccggtaccgtaacttacgttaccgtagccgtacgaagtacgtagttacgtacggtactaccggtttacggtccgtacggttcgtaccggtaacccgtaccgggttcgtttaccgggacggttacccggg

SEQ ID NO: 30026 - DNA, 689 bp, Homo sapiens
  misc_feature: GYAE6OF02IVOOH.1.49.E05.1.454.CMB.1.raw
  modified_base (239)..(239): a, c, t, g, unknown or other
  misc_feature (239)..(239): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttgggtggcagcagcaacaggtgcccactcccaggttccacctggtgcagtctggagctgagctgcagagccgtgggcctgagtgtatcggtcctccgngcgagtgtcttcgtaggttactacttccttaccaccgttacggtatgtaagttggtgacgacgaccggcccggaggtacgggcttaggaggtggaggtgggtagtggtactacgacggtacccgttaacggaaactaaacgaggtacgtaagagggagtaacggtacgtacggaggacgaggtacgtacacgtacacgtaccgaccgacgaaccgactacgtaccgaacgacgtaacaccgacctacgaagtacgaacgtggaacggacctaccgtagacgtacgtacgtagaacccggaacgtaccgtaccgttaactttacgtaccgtacggaaccgtagaagtacggttaactttacggtacgtacccggtaccggttcgggttaccggtaggttaaccctaccgggtaacccgtaggttcccgggttggggtaacccgggtcccgg

SEQ ID NO: 30027 - DNA, 597 bp, Homo sapiens
  misc_feature: GYAE6OF02GAJ56.1.49.E05.1.454.CMB.1.raw
  modified_base (537)..(537): a, c, t, g, unknown or other
  misc_feature (537)..(537): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgccactcccaggttcacctggtgcagtctggagctgagctgcagaagcctggggcctcagtgatggtctcctgcagtgcttctggttacattctttccactacggtatgtaattggttgagacgacggcccccggaggaggggtcttggaggtggagtggggatggactacgacgtacccgttaacggaaacgtaaaacaggacgtagtaggagtaaggtaacgttacgagggcaaggacgtacagtactacgtccgaccggacgaaccacgactaccgaacgagtaccagacctacgagtacggaacgttggaacggcgcctagagtactacgtacgacgacaccggactacgttactacgtgcgacgagtagtnttagtcgtactacggttcgccgtcgtacgtacgtaccgacgttcggtcggtaggtaccgg

SEQ ID NO: 30028 - DNA, 878 bp, Homo sapiens
  misc_feature: GYAE6OF02F4TJ1.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatgggacgggacctggagcatccttttcttggtggcagcagcaacaggtgcccactcccaggttcacctggtgcagtctggagctgagctgcagaagcctggggcctcagtgatggtctcctgcagtgcttctggttacattccttttcccaccttacggtactgtaatttgggttagacgtaccgacgggtcccccggggaggtacggggggtccttagggtaggtcggggtagttgggggagtagggacttcgaacgtacccggtttaacgggaaacctaaaacgtaacggtaagttaacgtagggaacggaaggtaaacggtttaccggaacggggacctaagggtaccgtacgtacgttacgaacgttacccgaacccggcgggaaccctaaaccaccgttaccccgaacgggtaacgttaaccgaacgttaccccgtaaacgtacggttaacggggaaaccttacggggaacgggtaacccggtccccgtttaacggaacggttaaccgtttcccggaacggaaacccgggaacccgtaacccccggggtaacctttaacccggttttaaccgtttaaccggttaccggtaaacccgtacgggtaaaccgggttacgtttaaacccggttttagttaccgggtaacccgtttaaccggtttaccggggttacccctttagggggtaacccccgtttaacgttaaaacccccgggtacgtttacccgggttttccggggggttaaccggttaaccccgggg

SEQ ID NO: 30029 - DNA, 589 bp, Homo sapiens
  misc_feature: GYAE6OF02FLLCU.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttactattctttccactacgtatgtaattggtgagacgacggccccggagaggggcgttggagtggagtgggagtggactcgacgcccgttaacggaaactaaacgagtagtagtaggaagagtaacgttacgagggtacgagagtacatcgactccgaccgcggacacgactaccgacgacgtacacgtacctacgacgtacggaactacggaggacgtccgagagtactcgacgaccggaccgacgaccttacgttacgtacgtaggacgacgtagtagtacgttagtcgactacgtcggttcgtcggtctacggtaacctggtccgttggcgggtaccg

SEQ ID NO: 30030 - DNA, 799 bp, Homo sapiens
  misc_feature: GYAE6OF02G87V5.1.49.E05.1.454.CMB.1.raw
  modified_base (236)..(236): a, c, t, g, unknown or other
  misc_feature (236)..(236): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagaacgccgtggggcctcgagtgatggtctcgngcaggtcgtcttcgtaggttacctatttccttttacccaaccgttacgggttattacggtaagtttggttacgaggtaccgtaccgggcccccggggtaggcgggggttaccgtaggtacggtggggtacgtagggggacttagggtacttacggaccggttaaccccgtttaaaccgggaaaaccgttaaaaacggtacgggtaacggtttaaggtacgggggtaacggtaagggttaaccggtttaccgggaacgggtaccgaagggttaccggtacttacgtaccgtaaccgtacccgggaacccggttacggaacccgtactaaccggtacccctaacggaaccttacccgaacgtaccctaaccgtaacggtaacggtaaccgtaggaccggtacctcccgtaagtacggtaccttacggaaccgaccgtaacccgtaccggtaaccttacggttaactcggttacggccggaagtgtaccgttatacggtctaacgtacgttccgtaccgtgttaccgtaacggtacgtacccgtttacggtgttacgggtacccgg

SEQ ID NO: 30031 - DNA, 628 bp, Homo sapiens
  misc_feature: GYAE6OF02H6BYM.1.49.E05.1.454.CMB.1.raw
  modified_base (415)..(415): a, c, t, g, unknown or other
  misc_feature (415)..(415): n is a, c, g, or t
  modified_base (460)..(460): a, c, t, g, unknown or other
  misc_feature (460)..(460): n is a, c, g, or t
  modified_base (538)..(538): a, c, t, g, unknown or other
  misc_feature (538)..(538): n is a, c, g, or t
  modified_base (585)..(585): a, c, t, g, unknown or other
  misc_feature (585)..(585): n is a, c, g, or t
tcagacgagtgcgtcacgaccggtgctcgatttagagcgactagcaacacacaaaggggacccaaaaaccacacccctcttgggagaatccctagatcacagctcctcaccatggacgggacctggagcatcctttctggtggcagcagctaacaggtgcccatcccaggttcaccgtggtgcagtcgtcggagctgagctgcagagcctggggcctcgagtgagtggtactcctaggccagtcgtcttcgtggttacattcgttttccaccgttacggtatacgtaagtttcggttagagacgtacgggacccccggtaggacggggcctttaggacggtggagttgggatagggtactcgacggtacccttacggaaactaaacgagaagtgaggagagtaagtcgtaggganagcgtatatcactacgaccgtgaacactacgtaccacgataccgnacctacacgtaggaacgttcggaaggtacaccgtacgacgtagtaccgtagaaccgacgcgtacctacgttaatccgnggtaccgagaagtacgttaagttcgtcgtacctaggtaccgttacgnggtaccgtacggtaaccgtacgttacgtcggtagggtacccgg

SEQ ID NO: 30032 - DNA, 623 bp, Homo sapiens
  misc_feature: GYAE6OF02HQOOD.1.49.E05.1.454.CMB.1.raw
  modified_base (538)..(538): a, c, t, g, unknown or other
  misc_feature (538)..(538): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttcgtggttacattctttccacctacggtatgtaatttggttagagacgtacggcccccgggaggacggggtcgttggaggtggagtgggatggatccgacgtacccgttaacggaacctaaaacgagtaagtagtgggaagaggtacggttacgagggacaggtagtacatacgacgtccgaccggacgacacgactacccgagtaacgtaccgacgacctaacgagtacggaacgtaggacggacgccgtacgagactacgtacggaaccgaccgacggtacctacgttacttacncggcgacgagagtatttacgtcgacgtacgtcggttaccgtcggtaccttacggtaacccgtacggtcgttagggtcggtaccgg

SEQ ID NO: 30033 - DNA, 622 bp, Homo sapiens
  misc_feature: GYAE6OF02HGDYW.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattccttttccaccttacggtatgtaatttggttgagacgacgggccccccggaggtacgggggcttggaggtgggagtggggatgggatcgacggtaccccgttaacgggaaacctaaaacgaggtaagtaagtaggggaagaaggtaacggttaccgagggtcaggagtcatcatcacgaggacgacacactaccgacgtatacgacgtacctaacagtacggtaacgtaggaggacgccgtagacgtatcgtacggacgaccaccgggcctaactttacgtactcgacgaccgagacgtagttagtcggactacggttcggtccgtcggtaccgtaccgttaaccggaccgttcggttggtaccgggg

SEQ ID NO: 30034 - DNA, 645 bp, Homo sapiens
  misc_feature: GYAE6OF02GZXOV.1.49.E05.1.454.CMB.1.raw
  modified_base (453)..(453): a, c, t, g, unknown or other
  misc_feature (453)..(453): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgtatggtctcctgctagtcgcttcgtggttacattccttttccaccttacggtatgtaagtttggttgagacgacggcccccggaggacggggcgttggacggtggagtgggagtggatcgacgtcccgttaacggaaactaaacagaagtagtaggagagtaacgtcgaggacagacgtcatcactccgacggacgtacacacgtaccacgacgtacacgtcctaanacgtacggaacgtacggaacggacgtcctacgtagtacgtccgtacggaaccgaaccgtaccggacctttaaccgttacttaccggtggtaccgttaggacgtaaggttacttaaggttcggaccgtaacggttccggttaccgtacggtacttacggtaacccgtaggtacggttcggtacgggtacccgg

SEQ ID NO: 30035 - DNA, 749 bp, Homo sapiens
  misc_feature: GYAE6OF02FNE5X.1.49.E05.1.454.CMB.1.raw
tcagacgagtgcgtcacgaccggtgctcgatttagagcgactagcaacacacaaaggggacccaaaaaccacacccctccttgggagaatcccctagatcaccagctcctcaccatggacgggacctggagcatccttttcttgtggcagcagcaacaggtgcccactcccaggttcacctggtgcagtctggagctgagctgcagaagcctggggcctcgagtgatggtctcctgcagtgcttctggttacatctttccacctacggtatgtaattggttagagacacgggcccccgaggacggggtcttgagtggatgggatgggactcgagtccccgttaacgggaaacctaaaaccacggtaaggttagttaggggaacgtaaggtaaacggtttacccggaaggggtacctaacggtacggtaccaacgtttaccgaacgttacccgacccgggtacccgggaaacctaccgaaccgttaccccgaaaccggtacggttaaacccaaccgggttaccccttaaaccgaacggttaaccgggtaaaccgttaggaacgggtaccgtaccccgttaacgaacgtaaccgttaccgttacggaacccgtaaccggacccgggtaccctaaccgtttaacgtaaccttacggcgtaccggaacgtacgactttacgttacggcctaccgtacggtaccgtcggttaccgtaacggtaacccgtacggtacgttacggtcgggtaccgg

SEQ ID NO: 30036 - DNA, 775 bp, Homo sapiens
  misc_feature: GYAE6OF02IX5Y4.1.49.E05.1.454.CMB.1.raw
tcagacgagtgcgtcacgaccggtgctcgatttagagcgactagcaacacacaaaggggacccaaaaaaccacacccctccttgggagaatcccctagatcacagctcctcaccatggacgggacctggagcatccttttcttggtggcagcagcaacaggtgcccactcccaggttcaccgtggtgcagtctggagctgagctgcagaagccgtggggcctcgagtgacgtcggtcctccgtgcgagtcgcttcgtcggttactagttcctttaccgaccgtaccggttatcgtaagttggttacgacgtacgacgggccccggtagacgggggtccttaggacggtcggaagtcgggacgtacgggactaccggacgtaccccgttaacgggaaacctaaaacgacgtaacggttacgtacggggaaacgacggtaaacggtccggaagggtacgaaggtacgttacgaacgttaccgaacgttaccgaaccggtcgggaaccctaacgacgtaccgaccggtaacgtaaccgacggtaccctaacgtagtaccgggtaaacgtggtaaagggtcccgtacgtaaccgaagtaccgttacgtaacggaccgtaccggaccgggtaacctacgtttaacgttaccgcggtaccggtacgtaggacgttagtttaacggtcgttaaccggtaccgttacggggttacccttacggggtaccgttaccggttaaacccgacccgggtttcgtttaccgggggtacgtaaccccggg

SEQ ID NO: 30037 - DNA, 698 bp, Homo sapiens
  misc_feature: GYAE6OF02FN42L.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcctaggttcacctggtgcagtctggagctgagctgcagaagcctggggcctcagtgatggtctcctgcagtgcttctggttacattctttccaccttacggtatcgtaattgggttgagtacgacgggtccccccgggaggtaggggccgtttggaggtgggagtggggagtgggatcgacgacccgttaacggaaacgtaaaacacgaagtagtagggacgtaaggtaacgttccgagggacgtaggacgtacacgtacgacgtccgaaccggcggacaacgacctaccgaccgtaagtaacgacgtccgtaacacgtaaggtaaccggtgaacgggtacgcctacgagtacgtacgtaccggacgaaccgtaccgggtccgttacgttacgttaacggttcgttacggacgtacgggtaacggaacgggttaccgtaacgtacggtttaaccggtcggtacgggttaccgggtccggttaccggggaccggtaacggggtacccgtaccgggtacccgttaaccccgg

SEQ ID NO: 30038 - DNA, 519 bp, Homo sapiens
  misc_feature: GYAE6OF02ITDG7.1.49.E05.1.454.CMB.1.raw
  modified_base (346)..(346): a, c, t, g, unknown or other
  misc_feature (346)..(346): n is a, c, g, or t
  modified_base (401)..(401): a, c, t, g, unknown or other
  misc_feature (401)..(401): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
  modified_base (467)..(467): a, c, t, g, unknown or other
  misc_feature (467)..(467): n is a, c, g, or t
  modified_base (511)..(511): a, c, t, g, unknown or other
  misc_feature (511)..(511): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgtagacaggcccccggagaggggcttgagtggatgggatggatcagccgttacggaactaaaacngagtatggagagaacgttccagggcagagtcatcatcacgcggacacatccaganacagcctacatgaactgaggngcctcagatcgngacacacggcctattagtactgcgagacgagtnttagtgactacgtcggtcctaggctacgtaccacgtcttcgggnggtaccgg

SEQ ID NO: 30039 - DNA, 756 bp, Homo sapiens
  misc_feature: GYAE6OF02GDYXE.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgattggtctcctgcagtcgcttcgtggttacagttctttccacctacggtatgtattggtgagacgacggccccggaggacggggtcttaggacggtggagtggggagtggactcgacgtacccgttaacggaaacttaaaacgaggtaacgtaaggtagggaaggtaacgtaacggttccggagggacgtaacggtaacgtactaagttccaacgtacccgaacccggtacgggaccaacgtacgtacccgaacggtaacgtaccgaacggtacccctaacgacgttaccggggaacttacggggaaggtaaccgtcccgttacgaacggtacttaccgtaacggaacccggtaaccgtaacccgggtacccttaaaccgttttaacttaacccggtaggacccggtacgaagggttacgttaacgtttaaggttaccggtaccgttaccggttacgggttcccgttaccgggtactttaacccggaacccgttaccgggtacgttttaccgggggaccggttacccggg

SEQ ID NO: 30040 - DNA, 842 bp, Homo sapiens
  misc_feature: GYAE6OF02GY6XP.1.49.E05.1.454.CMB.1.raw
  modified_base (219)..(219): a, c, t, g, unknown or other
  misc_feature (219)..(219): n is a, c, g, or t
  modified_base (241)..(241): a, c, t, g, unknown or other
  misc_feature (241)..(241): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtgggcctnagtgatggtctccgtgcgagtntcgttctcggttactacttccttttccaaccgttacggtattacgttaagttggttacgaacgtacgaccgggcccccgggtaggtacgggggcgtttggacggtggtaggtacgggtagttaggacgttacgaaccggttaacccggtttaaaccgggaaacctttaaaaaccggtagggtaaacgtttaacggtaagggtaaacggtaaacggtaaccgggtttaaccggacggggtaaccgtaagggtacgttaacgtaacgttacgaaccgttacccggaacgtaccgggaaccaccgtacgtacccgacggtaaacgtaccgtaacggtaccttaacggaacgtacggggaaacttacgggaacgtacgttacccggtacgaacgtaccgtacgtaaccgggacgtaaccgtacccggtaaccgttaacgtttaacgttaacccggtggtaacccggtaccgtaaagggttgttaaaccgtttagttaacccgggttacgtaacccggtttccgggttaccgtttcgggttaacccggttaacggttaaccccgacgggtttacccgggtttaccgggtacgggtttaccccgggg

SEQ ID NO: 30041 - DNA, 557 bp, Homo sapiens
  misc_feature: GYAE6OF02JA35H.1.49.E05.1.454.CMB.1.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (509)..(509): a, c, t, g, unknown or other
  misc_feature (509)..(509): n is a, c, g, or t
tcagacgagtgcgtcacgaccggtgctcgatttagagcgactagcaacacacaaaggggacccaaaaaccacacccctccttgggagaatccccctagatcacagctcctcaccatggacgggacctggagccatcctttttcttggtggcagcagcaacaggtgcccactcccaggttcacctggtgcagtctggagctgagctgcagaagcctgggcctnagtgagtgtcgtcgtgcngtgcttcgtgtacatctttccactacgtatgaattggttgtagacaggccccggagagggcgtgagtggagtggagtggagtacgagaccgttacggaactaaaacgagagtatagagagaagtacgaggacgagagtagagtacgatacgacgacgacgacgactacacgagtacagactacagtaggaacgtagagacgactacgagatacgtacgacgacgaccgaccgtaacttacgtacgtacgacgacgagagtagtatactnactacgtacggtaccgtacggtacgtaggtaaccgtacgtacgttacg

SEQ ID NO: 30042 - DNA, 820 bp, Homo sapiens
  misc_feature: GYAE6OF02ITTXU.1.49.E05.1.454.CMB.1.raw
  modified_base (262)..(262): a, c, t, g, unknown or other
  misc_feature (262)..(262): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttgggtggcagcagcaacaggtgcccactcccaggttcacctggtgcagtctggagctgagctgcagaacgccgtgggcctcgagtgagtcggtctcctgcagtcgtcttcgtggttaacnctttccttttacccaccgtacggttactaggttaagtttgggttagaacgtaccggtaccgggcccccggggtaaggtacgggggtcgttagggacggttagggaggtaggggtaagtcggtattaccggtaccggttaacccgttaaacgggtaaaactaaaacgtagggtaacggttaaggtacggggtaagtaaaggtaacggttaccgggaaagggtacgtaagggtaggtaccaagttaccgaacgtacccggaaccggtaccggaacctaactaacccggttaccgaaaccggtaaacggtaacccgtaccggaaacccgttaagaaccgggtacggtaaaaccgggtcggggaaccgacggttacccgacgtaacggtaccgtcgtaaacggtacccgaacgacccgtaacccttacgtttacgtaccggtgacccggtaatagggtaactttaggttacgttacggaccgtaacgggttccggttaccgttacgggtacccttaacggtaccccgggttacttacgggtttacgggtaccggtacccggg

SEQ ID NO: 30043 - DNA, 694 bp, Homo sapiens
  misc_feature: GYAE6OF02J0ZST.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctggcagaagccgtggggcctcagtgatggtctcctgcagtgcttctggttacattctttccaccgttacggttactgtaagttggttgagtacacgggccccggaggacggggtcttgaggtggagtgggagtggactcgacgtacccgttaacgggaactaaaacgagtagtacgtagggagacgtaagttcgaggacagtagtctactcgtactacgaccgacgacacacgtccgagtacgacgtacgcgttaacgacgtacggaaccttggtaacggaccgtccgtaacgtaggaccttacgtaccgggaacgacccgtaccggtacccttaacgtttaaccgttccgtacggtaaccggacggttaacggtagttaacgtttacggttccggtaaccttaccggttacggggttacccgttagggtaaccctttaacgggtaaacccggttaccggtttaccggttacggggtacggttaaccccgggg

SEQ ID NO: 30044 - DNA, 863 bp, Homo sapiens
  misc_feature: GYAE6OF02H8UC5.1.49.E05.1.454.CMB.1.raw
  modified_base (219)..(219): a, c, t, g, unknown or other
  misc_feature (219)..(219): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctnagtgatggtctctggcaggtcgtcttcgtggttactattccttttacctaccgttacggtattggtaattgggtttgagacgaacggcccccggaggacgggtcttggacggtggagtgggtagttaggacgtcgtacgtacccgttaaccggtaaaacgtaaaacgtagggtaacggtaagtagggtaaaggtaacggtaacggtttacccgaaggggtacgaacgggtacgtaccgtaacgttccgtaacggttaccgaacccgggtaacccggaaccgtaacctaacgtacccccgtaaaggaacgttaccggaaccggtacccgttaaaccgtacggtttaccggaaaccggtacgggtaaccggacgtaccccgttacgtaaccggtaacgttaccgtttaaccggggtaacccggacccggtaaaccgggtaccccttaaaccgttttaaaccggtttacccggttaaggtaccccgggttacgggaaaccggttaacgggttaaccgttttaacggttccgggttaacccttaccggtttaccggggttaaccccgtttcgggtttacccgtaaacccggggtttaacccgtacccggggttttacgttacccgggggttaccggttaaccccgggg

SEQ ID NO: 30045 - DNA, 698 bp, Homo sapiens
  misc_feature: GYAE6OF02JR1TK.1.49.E05.1.454.CMB.1.raw
  modified_base (188)..(188): a, c, t, g, unknown or other
  misc_feature (188)..(188): n is a, c, g, or t
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
tcagacgagtgcgtcacgaccggtgctcgatttagagcgactagcaacacacgaaagggacccaaaaaccacacccctccttcgggagaatcccctagatcacagctcctcaccatggacggacctgagcatcctttctggtggctagcagcaacagggttcgcccactcccaggtttacacctggtncgagtcgtggancagngtgtgcgagaccgtcggtcggccagtggacnggtcgtcctcgtcgacgtagtcgtcttcgtagttacgtacttcctttacctaccgttacggttagtacgttaggttcggttaggtacgacggtccggacccggagggtacgggtcgtaggtggtaggtaggtgggaattgggggaacttccgaaggtccccgtttaagggaactttaaaaacggacgtaaacggtaacgtaggggtaaagtacgggaaaggtttcccgaaaggggtccaagggtacgtacgaagttccaagttccgaaccgtcggacctacgaacttaccgaacgacgtaaccgagtaccctaagactacgggaaccttggaacggtgaccttagagtacgtacgtacgacgaccgacggtccaacgttactacgtgacgtcgagtacgtagtacgtcggtccgtacttcggtcctgggtacctaggtaccctaggcgttacggtggtaccgg

SEQ ID NO: 30046 - DNA, 745 bp, Homo sapiens
  misc_feature: GYAE6OF02IG00Q.1.49.E05.1.454.CMB.1.raw
  modified_base (161)..(161): a, c, t, g, unknown or other
  misc_feature (161)..(161): n is a, c, g, or t
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtncccactcccaggttcacctggtgcagtctgganctgagctgcaagacgccgtggggcctnagtgatggtctcgtgcagtcgtcttctggttacatttccttttccctaccgttacggtattgtaagttggttagacgacgacgggccccggaggtcggggtcttggaggtgggagtggggtatggactcgacgtacccgttaaggaaacttaaggacgtagtagtagggagtaaggtaacgttccggaagggtacgagtacgtaacgtacgtacgtaccgtaccgacccgggaccggtaaccctacgtaaccgtaccccggtaaacggtaaccggtaacgtaaccgtaccctaaggtaccggtaacggtaacgtcggtaaacggggctaaccccgtgtaacgacggttaccacggaacccggtaaccgacccggggtaacccttaacgtttaccttaaccggtcggtaccgtaacggtaaggttaacgttagtttaccggtaggttcccggtacgttccgggtaccgttacggtaccgttaccggtaacccggttagtttaccggttgggtacccggtaccggg

SEQ ID NO: 30047 - DNA, 557 bp, Homo sapiens
  misc_feature: GYAE6OF02JDOOJ.1.49.E05.1.454.CMB.1.raw
  modified_base (407)..(407): a, c, t, g, unknown or other
  misc_feature (407)..(407): n is a, c, g, or t
  modified_base (423)..(423): a, c, t, g, unknown or other
  misc_feature (423)..(423): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtggatgggatggatcagccttacggaactaaaacagagtatggagagaagttcagggcagagtcatcatcacgcggacacatccacgagtacagccanatgaactgagagcctnagactctcgacgacacgggcctaactttacgttaactcggacgtcgaagtacgtaattacgttcggacctacgttcgggtacccgttaggtccgtacggtaaacccgtacggtccgtttaggtcggggtacccg

SEQ ID NO: 30048 - DNA, 754 bp, Homo sapiens
  misc_feature: GYAE6OF02F5O75.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtcggggcctcgagtgagttcggtcctccgtggactaggttcgcctttcgtaggttactactttccgttttaccccaccgttacggtattagtaagtttgggttagaagaccgtaccgggaccccgggtaggacggggtcttagggaggtgggtagtggggagtcgggtataccgacgtacccgtaaaggtaaaactaaaacgagtaaggtagtagggaagtaaggtaaacgttaccggaagggtacgtaaggtacgtacgtaagtaccgaacgtaccggaacccgtacgggaacctaaccgtaacgtacccgacggtaacgtaaccaccggtacctaaacggtacgtaacggaacgtcggaacggtcgtacccgtagtaagtaccttaggtaccgaaccgtaaccgacccggtaaccttacgtttaacgttcgacgtaccggaacgtagtagtaacgtttaggttaacgtaccgttaacggttccggtacgttacggcgttaaccggtaacccgttacgtcggttacggtacggtaacccgg

SEQ ID NO: 30049 - DNA, 765 bp, Homo sapiens
  misc_feature: GYAE6OF02H49X7.1.49.E05.1.454.CMB.1.raw
  modified_base (195)..(195): a, c, t, g, unknown or other
  misc_feature (195)..(195): n is a, c, g, or t
  modified_base (593)..(593): a, c, t, g, unknown or other
  misc_feature (593)..(593): n is a, c, g, or t
tcagacgagtgcgtcacgaccggtgctcgatttagagcgactagcaacacacaaaggggacccaaaaaccacacccctccttgggagaatccctagatcacagctcctcaccatgggacgggacctggagcatccttttcttggtggcagcagcaacaggtgcccactcccaggttcacctggtgcagtctgganctgagctgcagaagccgtggggcctacgagtgatggtcctccgtgctagtcgtcttcgtcggttactctttccttttccctaaccgttacggtattacgtaagtttggttagacggtacggaccgggtcccccgggaggtacggggtacgttggaggttgggacggtgggagtggactcgacgtaccgttaacggaaaactaaaggaacgtagttaggagggaacgtaaggtaacgttacgggaacgggtacgtaacggtacgttacaacgtaccgtaacgttacccggaacccggcccgggtaacaccgtaaccgtaacccgaacggtaacgtaaacctaccggtaccctaacggaagttaaccgggaaacgtacgggtacggtaacgtccgttaanaacgtacgtacgtacggaacgacccgaccgggtaccttaacgttattaccgaggtaccgacgtaacgggagtttaaccgttagtacggttccgttacggtaccgggtttaccgacggttacgttaaccgggtaacccgttaccggttacgggtttcggacgggttacccggg

SEQ ID NO: 30050 - DNA, 804 bp, Homo sapiens
  misc_feature: GYAE6OF02F0F01.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttccacctggtgcagtctggagctgagctgcagaacgccgtgggcctcgagtgattggtctccagctagtgtccttcgtaggttactacttcctttacccaaccgttaacggtactaggttaagtttgggttagaacggtaaccggtaccgggacccccgggtagggtacgggggtcgttaggtagggtagggtacggtaggggtacgtaggtactaccgtaacgttaacccgtaaacggtaaaacgtaaaacgtaggtaagttaaggtaagggtaagtaacggttaaccggttcggaaacgggacgtaaggtaacgtacgtaacgtaaccgacttacccgggaaccggaccgtaaccgtaaaccaccgttaaccgaaccggtaacgtaacctaaccgtaccgtaacgtaacggtacggaaacgttaagggaccgtaccggtacctaacgacgtagttaaccgtacggaaccgtaccggtaaccgtaaccttacgttaactccggtacgaaccggtagtaaacggtagttaacgtttaccgtggtaaccgttacggtccggttaccggtacggtaaccgtttaacgggtaaccccttagggtaccggttacgggtacccggtaccgggg

SEQ ID NO: 30051 - DNA, 647 bp, Homo sapiens
  misc_feature: GYAE6OF02F5049.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtcctcctgcagtgcttctggttacattctttccaccttacggtatgtaattggttgagacgaccggccccccggtaggacgggggtcttggaggtcggtagtggggtatgggatcgacgtacccctttaacgggaaacctaaaacgacggtaaggtagtagggaagtaagtaacgttccgaagggcgaaggacgtacactacactccgacccgacggacctaaccgactacccgaacggtaacgtacgacgccctaacaggtacgtaacgtcgacggacgtaccgtcgacgtatcgtacgaccgaccgaccgggacctactttacttacgtcgacgtacgagtactagttacgttcgacctacgttcggttcccgtaggcctacggttaaccccgacgtcggttacggtcggtaccgg

SEQ ID NO: 30052 - DNA, 750 bp, Homo sapiens
  misc_feature: GYAE6OF02IREPU.1.49.E05.1.454.CMB.1.raw
tcagacgagtgcgtcacgaccggtgctcgatttagagcgactagcaacacacaaaggggacccaaaaaccacacccctcctttggagaatcccctagatcacagctcctcaccatggacggacctggagcatccttttcttggtggcagcagcaacaggtgcccactcccaggttcacctggtgcagtctggagctgagctgcagaagccgtggggcctcgagtgagtcggtctccgtgcagtgtacttctaggttactatttcctttaccaaccgttacggtatagtaagtttggttagagtacggaccggtcccccgggaaggtacggggcgttggtaggtggtaagtggggtaagtggaagtcgacggtaccgttaacggtaaactaaaacgtagacgtaagtagggaagtaagtaacggttccggaaggacgtaaggtacgtactagtacgtacgtaccggtaaccggaccggaactacgtaaccgtaccgaaccgaagtaaccgacggaaccttaacgaacgtacggtaaacgtaggtaacggacgtaccctaacgtaagtacgtttacgaacggtaaccggaacgacccggttacctaacgtttaaccgtttaacgtaccgtaaccgggagtaaacggtaacgttaacgtttaacggttacgtaaccgttacggttacgggttacccgttacggtccgttaaccggtaacccgttccggtaacggttcggtaccgggtaccggg

SEQ ID NO: 30053 - DNA, 748 bp, Homo sapiens
  misc_feature: GYAE6OF02H2RUD.1.49.E05.1.454.CMB.1.raw
  modified_base (238)..(238): a, c, t, g, unknown or other
  misc_feature (238)..(238): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtgcagcagcaacaggtgcccactcccaggttcacctggtgcagtctggagctgagctgacgagacgccgtgggacctgagtgagtggtctcgcgnagtgtcttgtacggtactactttccttttaccgaccgttacggtagttacgtaagtttgggttagacgtaacgacccggggcccccgggaaggacggggtccgttaggtagggttcggaggtgggaagttcggactcgacgtcccgtaaaggtaaactaacgtaggtagtacgtagggacgtaagtaccggttacgagggtacgaggtagtaccgtagtacgtacgtaccgacccggacggtaaccacgtaacccgacccgaacggtaacggtaccgaactccgtaaccgttaaggtacggtacgaccgggtaggccgttacccgtacgtacgtacttacgggacccgttaacggacccgtaccgtacccgttaacgtttaaccgttacgtggacccgttaacgggagttaaggttaccgtttacgttcggtacccttcgggtaaccgttcgtaccgggttaccggttaaccggtaaccttccgggttaccgttacgggtggtacccggg

SEQ ID NO: 30054 - DNA, 649 bp, Homo sapiens
  misc_feature: GYAE6OF02I1NHT.1.49.E05.1.454.CMB.1.raw
  modified_base (294)..(294): a, c, t, g, unknown or other
  misc_feature (294)..(294): n is a, c, g, or t
  modified_base (517)..(517): a, c, t, g, unknown or other
  misc_feature (517)..(517): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgccactcccaggttcacctggtgcagtctggagctgagctgcaggaagcctggggcctcgagtgactggtcctaccgtgccaggtgcttctggttactatcttttaccaccgttacgtatacgtaagttggttntagacacggccccggagacgggtctggtgtcggatcgggagtggagtcagtacctacggtaaactaaacgagtaagtatacggagaaggtaacgttaccggtaaggacgaaggtaggtacaacgtcgaagtaccgtaccggcggaaccaaacgtactaccgaacggtaagtaaccacggtacctaaccgacgttacggaaaccgttacggagggtaccgtacnccgtaagacgtcgtaacggacgaaccgtacggacctagttaacttacggcgtcgacgagtacgaagttcgtataccgaacgtggtccgtacgggtctaacgtaccggtaccgtcgttacggtggtaacccgg

SEQ ID NO: 30055 - DNA, 841 bp, Homo sapiens
  misc_feature: GYAE6OF02GC1BS.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtgggggcctcgaggtgagttgggtcctccgtgcgtagttcgtcctttcgtgggtttactacttcctttttcccaccgttaacggttattcgtaagtttgggttagacggtaaccgtaccggggtcccccgggaaggtacgggggtcctttagggacggttacgggtaaggttaggggtaacgttagggtaacgttaccggtaaccggtaccccgttaaacgggtaaaacctaaaacgaacggtaaggttaacggtagggtaacggtaaacggtaacggtttaccggaaggggtacgtaagggaacgtacgtaaacgttacgacgtacccggaaccggtacccgggaacctaaccgaaccgttacccgaaacgggtaaccgtaaccgaaccggtaccctaacgaacgttacgggaacgttcggaacgggtaccgtccgtaacgtaagtacgttccgtaacggaaccggtacccgtaccggtaacccttacgttttaacgtaccgtacggtacgacggtagtacgttacgtttaacggtcggtaaacccgttaccggttacggttcccgttacggtaccgtttaccggtaaccccgttaacggtccggtttcgggtaccgggtacccggg

SEQ ID NO: 30056 - DNA, 724 bp, Homo sapiens
  misc_feature: GYAE6OF02JQ33X.1.49.E05.1.454.CMB.1.raw
  modified_base (194)..(194): a, c, t, g, unknown or other
  misc_feature (194)..(194): n is a, c, g, or t
  modified_base (243)..(243): a, c, t, g, unknown or other
  misc_feature (243)..(243): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctgganctgagctgcagaagccgtgggcctcagtgatggtcctctgcagtgcttntaggttactacgttcctttaccaccgtacggttacttagtaagtttggtagacgtacgtacgggaccccggtaggacggggtcttaggacggtggaacggtgggtagtcggatacgaccgtaccgttaacggaaacgtaaacgtaggtagtaggtaggaaggaacgtaacggttcggaagggtaccgtaggtaacgtactacgtaccgtactccggtaaccggaccgaacgtaaccgtaaccgtaccgaaccggtaacgaaccgtaacgtaccgtaaacgtagtaacgggaaccgttaacggaacgggtaccgaccgttaacgaacggtaccgttacgtacggaaccgtaacccggaaccggtaccccgttaacgtttaacctttcggacgtaccgtagtaagacgtttagttacgtagaccttaggtaccgttcgtacggtacgttacgtaaccgtcggtacgttacggtcggtaaccgg

SEQ ID NO: 30057 - DNA, 682 bp, Homo sapiens
  misc_feature: GYAE6OF02IMPP6.1.49.E05.1.454.CMB.1.raw
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (533)..(533): a, c, t, g, unknown or other
  misc_feature (533)..(533): n is a, c, g, or t
  modified_base (547)..(547): a, c, t, g, unknown or other
  misc_feature (547)..(547): n is a, c, g, or t
  modified_base (564)..(564): a, c, t, g, unknown or other
  misc_feature (564)..(564): n is a, c, g, or t
  modified_base (570)..(570): a, c, t, g, unknown or other
  misc_feature (570)..(570): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctccgtgcagtgcttntcggttacnttccgttttccacgttacggtagtgtaagttcggttagaggtacgacgggtcccccggaggtacgggtcgttaggacgtgggagtgggatgggaacttcgacgtacccgtaacggaactaaaacgagtagtaagttacgggaataacggtaacggttccgaaggggtccgtaaggtaacgttacgcttaacgactaccgaccggacggaacttacacgtaccgaacgtacgactacgacctaacgcgtaacggattacggaagcgaccctagataccgtntaacggaccgaacnccggtacctacgtttanaaccgngaacccgagtacctaggtattttacgacggaccgttacgttacgggtacccgtagggtacccgtacggttaaaaccgtccgggtttaccggttgggtaccggtaccccgggg

SEQ ID NO: 30058 - DNA, 738 bp, Homo sapiens
  misc_feature: GYAE6OF02JY8WM.1.49.E05.1.454.CMB.1.raw
  modified_base (206)..(206): a, c, t, g, unknown or other
  misc_feature (206)..(206): n is a, c, g, or t
  modified_base (233)..(233): a, c, t, g, unknown or other
  misc_feature (233)..(233): n is a, c, g, or t
tcagacgagtgcgtcacgaccggtgctcgatttagagcgactagcaacacacaaagggacccaaaaaccacaccctccttgggagaatccctagatcacagctcctcaccatggacgggacctggagcatccttttcttggtggcagcagcaacaggtgcccactcccaggttcacctggtgcagtctggagctgagctgcagaancgtgggcctcagtgattggtctccgtncgtaggtgtctttccgtaggtttactactttaccttttccgacccgttaacgggtattaggtaaagttggtttaggaacgtaccggaaccgggacccccggttagggaacgggggtcgttacggtaggtacgtaggtgggtagtagggacttagacgtaccccgttaagggtaaaaccgttaaacgacggtaagtacgtaagggtacggaaagggttacgttaccggaagggtaccctagggtacgtaacgacgttacgactaccggccgtacggactaccggactccgaacgtacgttacaacgtccgaactggtaacgtaaccgttaggacgaacgtccgtagacgttctacgtacgaacgaacgtaccgacctaccgtttaagtacggtagaccggttacaagggtatactttacggtcgggtacctagggttaccgttaccggtagttcccgggttaacgtaaccccgggtagttaccggtttaggggtaccggtaaccgg

SEQ ID NO: 30059 - DNA, 682 bp, Homo sapiens
  misc_feature: GYAE6OF02HCRX5.1.49.E05.1.454.CMB.1.raw
tcagacgagtgcgtcacgaccggtgctcgatttagagcgactagcaacacacaaaggggacccaaaaaccacacccctccttgggagaatcccctagatcaccagctcctcaccatggacgggacctggagcatccttttcttggtggcagcagcaacaggtgcccactcccaggttcacctggtgcagtctggagctgagctgcagagccgtgggcctcgagtgatggtcctccgtgcagtcgtcttcgtaggttacagttccttttccaccgttacggttatgtaagttggttacgacgtacgaccgggacccccggtaggacggggtccttggaggtcggagtcgggatcgggatccgacggtacccgttaacggaaactaaaacgaggtacgtaagtgggaacgtacggtaacggttaccgagggtacgaaggtacgtacagtacgtacgtaccgacccggacgaaccacgacgtacccgaagacgtaacacgtacccttaagacgtacggtaaaccgtggaaacggcgaccttacgaacgtacttaccgacggtaaccaaccgtaccggaccttaagtttaacgtacgtacggtcgacgtagtacgtatttaacgttcgactacgtcggtacctcggtacgttaccgtaacccgtacgttcggttaggcgtaaccgg

SEQ ID NO: 30060 - DNA, 751 bp, Homo sapiens
  misc_feature: GYAE6OF02JY72C.1.49.E05.1.454.CMB.1.raw
  modified_base (239)..(239): a, c, t, g, unknown or other
  misc_feature (239)..(239): n is a, c, g, or t
  modified_base (390)..(390): a, c, t, g, unknown or other
  misc_feature (390)..(390): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttctggtggcagcagcaacaggtgccactcccaggttcacctggtgcagtctggagctgagctgcagagtcctggggcctcgagtgatggtctcctagcagtncttctggtactagtctttaccacctacggtatcgtaattcggttagacgacgtacgggcccccggaaggaggggtcttaggacgtggtaagtcggggacttagggacgtcgacggtacccgttaacggaaacgtaaaacgacggtagtagnggaacggtagaacggttcgaggcgacgagtacgatcgacgtacgaccggtacgtaccgaactacgtaaccgacgtaaacggtactacgtaccttaaaccgtagttaaccggggaaagttacgggaacggggtaactacccgtaacgaaccggtacgtacccgttagggaaacccggaaccggtacccggttaaccgtaaacccgtttaaccggttaaccggttaacggaccggacggtaaacggtaccgtaagttttaaccggtacggttaaccgttaacgggttacccggttaacccggttaggtaccgtttaacccggaaccggttaccggtaaccgttggggtcccggtaacccgggg

SEQ ID NO: 30061 - DNA, 617 bp, Homo sapiens
  misc_feature: GYAE6OF02GJCN9.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccactacggtatgtaattggttgagacacgggcccccggaggaggggtcttggagtggatgggatggatcgacgtcccgttaacggaactaaaacgagagtagtggagagtaacgttcgagggcagagtcatcatcacgcgacacataccacgagtacacgacctaacagtacggaactaggacggacggccttacgaacgtactcgtacggaaccgtaccgaccggtaccttaactttacgttaccgtacgaccgtacgtaagtagtaacgtttagttacgtaccttaccggttacggttacccgttgggtaccgttacggtaaccccgtacggttcgtttacgggtacgggtacccgg

SEQ ID NO: 30062 - DNA, 600 bp, Homo sapiens
  misc_feature: GYAE6OF02ILC24.1.49.E05.1.454.CMB.1.raw
  modified_base (401)..(401): a, c, t, g, unknown or other
  misc_feature (401)..(401): n is a, c, g, or t
  modified_base (443)..(443): a, c, t, g, unknown or other
  misc_feature (443)..(443): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctcctgcagtgcttcgtggttactattccttttccaccgttacggtatgtaatttggttgagacgacggcccccggagacggggtcttggagtggagtgggagtggatcacgtccgttaacggaactaaacgagtagtagtaggaagagtaagttaccgagggcagacgtanactacatccgaccgcgacactatccgaagagacacgacctanagtacggtaacgtggaaggcgcctacagatcgtagaaccgaccgaccggacctaacttacttacgtacgcgtacgagtacgtattacgtcgacctacggttccgtccgttagggtaccttacggtaaccgtacggtacgttagggtcgggtacccgg

SEQ ID NO: 30063 - DNA, 759 bp, Homo sapiens
  misc_feature: GYAE6OF02HRQ8Y.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtggggcctcgaggtgatggtctcctgcagtgtcttcgtggttactacttccttttccaaccgttacggtatagtaagttggttgagtacgacgggaccccggaggtacgggtcttggaggtgggtagtcgggagtggtactcgacgtacccgttaacggaaactaaaacgaggtaaggtaagtggaaggaaggtaacggttacgacgggacgaagtacgtactaatacgtacgtaccgaaccggacggaacaaccgaacgtacccgaacgtaacgtaaccgacgtaaccctacgtaggtacgggtaacctagggtaacggaccgtacccgtagaacggttaacgtcgttaacgggaacccgtaaccggaaacccgggttacccttaaacgttttaaccgtttaacggttccggaaccgggtacggtaacgggtaaccgtttagtttaaacggttcggaccgtttaaaccggtccgggttacccgttaaggttccggttaaccgtaaacccggttccgttaccgggttttcggtcccgggtaaccgg

SEQ ID NO: 30064 - DNA, 644 bp, Homo sapiens
  misc_feature: GYAE6OF02HZHQG.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggggcctcagtgatggtctcctgcagtgcttctggttacattctttccaccttacggtatagtaatttggtgagtaccgacgggcccccgggaggacgggggtcttaggaggtagggaggtgggagtggactcgacggtacccgttaacggaaaactaaaacgagtagtagtggaagaagtaagtcgaagggcaaggagtacatacacgtaccgaccggaccggaacaccactacccgaacggtagtacaacgaccctacgagtagaacgtgggaacggacgacctacgaacgtctagacgaccgaaccgtacgtacctacttacgttacgtcggaccgtagacgtagttatttacgtcggtacctacggttaccggtacgttcgggtaccttaacggtaacccgtacggttcgttacgggcggtaccgg

SEQ ID NO: 30065 - DNA, 824 bp, Homo sapiens
  misc_feature: GYAE6OF02HJEQI.1.49.E05.1.454.CMB.1.raw
tcagacgagtgcgtcacgaccggtgctcgatttagagcgactagcaacacgacaaaggggacccaaaaaccacacccctccttgggagaatcccctagatcacagctcctcaccatggacggacctggagcatccttttcttggtggcagcagcaacaggtgcccactcccaggttcaccgtggtgcagtcgtggagctgagctgacagaagccgtggggcctcagtgatggtctacgtgacagtgcttcgtaggttactattccgttttcccaaccgttacggtactagtaacgtttggttagaggtaccgacgggcccccggaaggacggggtcgttacggagggtagggacgtaggggagtagggtactcgacgtaccgttaacggaaactaaaacgaggtaacgtagtagggaaagaggtaacggttaccgaacgggaccgtaaggtacggtactaaacgtactaaccgtaaccggtacccggaacgaaccgtaaccgtaccgttaacccgaaccggtaacggttaaacccgaacgtacccgttaaacgtacggtaacgggtaaaccgttacgggaaacggtaccggaccgttaagacggtaacgtaaccgttacgggaaaccgaaccggtaaccgggtaacccttaaacgtttaacgttaaccgtaaaggtacccggttaaggaacgtaacgggttaaaccttttaagttaacccggtacgttaaccggtttcgggtaaccccggttacggttaaacccggttaccggttaaaaccctaaccggggtttccgttttaggggtacccgggttaacccggg

SEQ ID NO: 30066 - DNA, 697 bp, Homo sapiens
  misc_feature: GYAE6OF02IS8W7.1.49.E05.1.454.CMB.1.raw
  modified_base (193)..(193): a, c, t, g, unknown or other
  misc_feature (193)..(193): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggngctgagctgcagaagcctgggcctcagtgagtggtctacctgcctagtcgtcttctggttaccattccttttacccgaccttacggtagttacgtaagtttggttgagacgacggcccccggaggacggggtcgttggtaggtgggtagtgggagtggtatacgacgtccgttaacggaaaactaaacgaagtaagtagtaggaaggtagtaacgttcgagggacgtagacgttacaacgtcacgtacctaccggtacgaaccgacctataccgaacgtaagtacccacgtacctaacgaacggtacggtaacgttacgggaaacggtcggacctacgtaacgtattacgacgtaccggacgtaaccggaccgttaacgtttaacgttcggtacggtacccgaggtaacggtacgttacgttttagtccgtcggttaaccggttcgggtaccgtacggtaacgttaccgaacccgttcgggaacgtttgggccggtaacccggg

SEQ ID NO: 30067 - DNA, 652 bp, Homo sapiens
  misc_feature: GYAE6OF02H9IDR.1.49.E05.1.454.CMB.1.raw
  modified_base (493)..(493): a, c, t, g, unknown or other
  misc_feature (493)..(493): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagcgtgagctgcagaagccgtggggcctgagtgagtggtctctgcgagtgcttctggttacattccttttaccaccgttacggtagttagtaagtttggttagacgacgaccgggacccccggagggtacggggtcttaggaggtaggaggtagggagtggtacgtacgacggtacccgttaacggaaactaaacgaggagtagaggaagtagtacgtacgagggtacaggacgtcagtcactccgtaccgacggacacgtacgccgaacgacgtacgacgacctagtacgtacggaagnggagacgacctcgaatcgtcgacggaacgaccgacgggtccgttagttactacgtggtacggagaggagggtacggttaacgtggtaacggttacggttacgtcggttaccgggcggtacggggaccggacgggtaaccgttaccggaccgtaccccgg

SEQ ID NO: 30068 - DNA, 678 bp, Homo sapiens
  misc_feature: GYAE6OF02GUXLC.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgattgctcctgcagtgcttctggttacattccttttccaccgttacggtactgtaattggttgaacgtacacgggacccccggaggacggggtcttggaggtaggagtgggatggattacgacggtacccgttaacggaaacgtaaaacgaggtacgttaagtagggaagaacggtaacgttaccgaagggcgaagacgtcgaactccgaactccgtaaccggacgaccaactacgacgtacgaactacgacactacagtagaccaggacggtcgacgtacgtagtacttacggacgaaccggtaccggaccgtaaccgttacgttaacttaccggcggtaccgaacgtacggtagttaacgtttacgtaccgtacgttaccggtcggttaccggtttacgacgtttaacccggaaccccgttacggttacggtttacgggccgttaacccgggg

SEQ ID NO: 30069 - DNA, 820 bp, Homo sapiens
  misc_feature: GYAE6OF02I7G6N.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgagtggtcctcctggctaggtcgtccttacgttggttaacactttaccttttccctaacccgttacggttattacggtaagtttcgggttagaacgaacgaccggggccccccgggtaaggacggggggtaccgttgggtacgggttacgggaggttagggggtacgtagggtaacgtaccggaacggttaccccggttaaaccgggtaaaaccgttaaaaacgagggtaacggttaacggtagggaacgggtaaacggtaaacggtttaccggaacggggtacgtaaacgggtacgttaccgtaaactacgtaaccggtaccgtaacccgggtaccgggtaaccaaaccgtaaccgttaacccccggaaacgggtaaaccgtaaccctaaaccgggtacccttaaacggtacggtaacgggaaaccttaggggaacggtacgtcccgttacgaacgtacgtccgtacgaccgaccgaacgtaccctacgtttaacttaccgtacggtcgacgtagtacgtatttacgcgtacgtacgttcgtaccgttaggtaccgtacggtaaccctacggtcgttacgggtacggtaccggg

SEQ ID NO: 30070 - DNA, 705 bp, Homo sapiens
  misc_feature: GYAE6OF02HM09O.1.49.E05.1.454.CMB.1.raw
  modified_base (195)..(195): a, c, t, g, unknown or other
  misc_feature (195)..(195): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctgganctgagctgcagaagcctggggcctcagtgatggtctctgcagtgcttctggttacagttcttttccacctacggtatgaacttggttgagacacggcccccggtagacggggtcttaggacgttaggacgtgggattagggacttcgaacggtaccccgtttaacgggaaaccttaaaaacgagaacggttaacgttagggaacgtaaggtaaacggtttcccggaaggggaccgaaggtacgtaccgaacgttaccaacttccgaacccggacgggaacaaccgtaacgtacccgtaaacggacgttaaccgaagtacccgtaactaacgttacggaaccgttgggaacggacgtccgttacagtactacgttacggaaccgaccgacccgggtaacctacgtttaaccttacgtcgacgacggtagacgttactttacgttcgactaacggttcggtacccgttgtccgtacggttaacccgaccggttacgtttcggacgggtaccg

SEQ ID NO: 30071 - DNA, 700 bp, Homo sapiens
  misc_feature: GYAE6OF02GJC6T.1.49.E05.1.454.CMB.1.raw
tcagacgagtgcgtcacgaccggtgctcgatttagagcgactagcaacacacaaaaggggacccaaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctggttactagttccttttccaccgttaacggtatcgtaagttggttaggagtacgacgggcccccggaggacgggggtcttggaggtggtagtgggtacgtagggagtcgaacgtcccgttaacggaaactaaaacgagtaagtaagtacgggaagtaaggtaacggttaccgagggtacgaggtacgtacgtatacacgtccgaaccggccggaacaccgtacgaccctaacggacgttaaccgacgacccgtaacgacgttacggaaacgttaacgggaggtaccgtaccttacgacgtacgttccggtaacggtaacccggaccgaaccgggtacccttaacgtttaacctttaaccggtcgaccggtagtaacgagttagtttacgtacgtacctacgttaccggtccgtaggttccctagtaacccgtcgtccggtttggccgggtacgg

SEQ ID NO: 30072 - DNA, 696 bp, Homo sapiens
  misc_feature: GYAE6OF02HDBK5.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggaccgtggagcattccttttcttggtggcagcagcaacaggtcgcccactcctaggttcacctggtgcagtcgtggagctgagctgcagaagccgtgggcctcagtcgagttggtctccgtgcagtcgtcgtttcgtaggttactactttcctttttcccgaccgttacggtatgtacgtttggtgagacgaccggccccggaggtacggggtcttggaggtggaagtgggtagtacggtatcgaccggttaccgttaaaccggaaaactaaaacgacggtagttaagagggtaaacgaagttaacggttaccggaacgggacgtaaggtacgttacacttaccgacgttaccgaccggtaccggaaccaaccgtaccgttaccgaacggtaacgtacgtaccggaccttacgaggtacggaacgtaggaacggacgtccgacgagtactcgaacgtacgaccgaccgtactactttaacgcgtagcgagacgttagtacgttacgtacgtacgttacggttccgtccggttagtaccgtacgttaaccgaggttcgtttaggggccgtaccggg

SEQ ID NO: 30073 - DNA, 908 bp, Homo sapiens
  misc_feature: GYAE6OF02JRV15.1.49.E05.1.454.CMB.1.raw
tcagacgagtgcgtcacgaccggtgctcgatttagagcgactagcaacacacaaagggacccaaaaaccacacccctccttgggagaatcccctagatcacagctcctcaccatggacgggacctggagcattccttttcgttggtggcagcagcaacaggtcgcccactcccgtaggttccaccgtggtcgcagtcgtggagcgtgagtcgtcgacgaaggaacggtccggtcggggtcccgtcgtaggtgtagttcggtccgtccgtgcgtagtcgtcgttcgttacggttaccttactttccttttacccgtaccgttaacggttagttacgtaagttggttagtacgaccggtaccgggaccccgggtacgggtacggggtcgttaggtacggtagggtaggtagggtaggttagggtacgtaccggtaaccggtaacccggttaaacggtaaaaccgttaaaaacgtaggtaaacggtaacggtaagggaaacggtaaacggtaaacggttaccgggaacgggtaacgtaacggtaacggtacgtaacgtaccgtaaccgtaaccggacccgtaaccggacctaaccgtaaccgtaaccgaaaccggtaaaccgaccgtaaccgtaaccgtaaccgaacggttacgggtaaaccggtacggtaaccggggtaaccgtacccgtaagtaacgtaaccggtaccgtaacggaaacccggtaaccccggtaccgtaacccgtttaaccgtttaacggttaccggtacggtaccgggtaacgtaaccggtacgttaagtttacccgtacggtaaccgttaccgggtttaccggtaaccggttcggttacccgttaaaccggtaacccggttaccggtttggttaccccggggttcggtaaccccggg

SEQ ID NO: 30074 - DNA, 701 bp, Homo sapiens
  misc_feature: GYAE6OF02F7A2L.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatggtctcctgcagtgtcttctggttacattctttcccacttacggtatgtaattggtgagacacggccccggagaggggtctgaggtggagtgggatggatcgacgtccgttaacggaactaaaacgagtaagttagagggtagaaggtaacgttaccggaggacaaggacgtacactacgagtcccgaaccggcgacgtaacacgtaacccgacggtacgtaaccgacgtacctaacgagtacgggtaaactcggaaacggccgtacctacggtaacgtaccgttcggtaacggaaccggaaccgtaccggggtacccttaacgtttaacgttaccgtacgggtaccgtacggtaacgggttattaacggtttaacttacggtaccgttaaccggttcggttacccgttcggggtacccgttaaccgggtttacccacccgggtttacgtttacgggttacgggaaccccggg

SEQ ID NO: 30075 - DNA, 637 bp, Homo sapiens
  misc_feature: GYAE6OF02HD5Y1.1.49.E05.1.454.CMB.1.raw
  modified_base (269)..(269): a, c, t, g, unknown or other
  misc_feature (269)..(269): n is a, c, g, or t
  modified_base (388)..(388): a, c, t, g, unknown or other
  misc_feature (388)..(388): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgacgctgacaaggacgccggtcgggcctcgagtgagtcggtcctccgtgctagtcgtcttcgttacgttacnctttcctttaccgaccgttacggtatagtagttggtagagtacgaccggccccggtaggacggggtcttaggacggtggaaggtggagtaggactcgaccgtaccgtaagaaactaagngtagtagaggagagtacgtcgagganagntacatacacgtccgacgacgacacgtactacgaacgtacgtacgactacgtaacgtgaaccggagtggaacggtccgactacgtagtaccgtcgtaacggaccgacgtacccggtacttacgttacgtacgtccggcgtaagtccgtattagttacggaccgtagtaccggttaccgtcgtagtacccgtagacccgttcgtgtttacggcggtacccgg

SEQ ID NO: 30076 - DNA, 777 bp, Homo sapiens
  misc_feature: GYAE6OF02G1PGD.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagccacaggtgcccactcccaggtccagcttgtgcagtctggggctgaggtgaagaagcctggggcctcagtgaaggtttcctgcaaggcttcaggatacaccttcactaggtatgctatactattgggtgcgccacggcccccggacaaaggcttgagtggatgggatggatcgaacgcgtggacaataggtaacaacaaaaacttcaacaagtaacgttaccgaagggacagacgtactaaccgtttaaccgaagggaacctaaccgacgttacccggacggtaacggtaatttaaaccgtttaagtagttacgggtaaggtaccgttacggaacggtccgtaacggaccgttacggaaacggtaaccgttacccgggaaaacggtaaccgaaccggggtaccgtttaacggtttaacgttttacgtttttttacgggtcggttaacccggttaaccgtttaccggttaacgggttaggggtacgggttacgtttaacgttttaacggtttaaccggtacctttaaacgttaacgttttaccggtaaccgtttaccccgggttacgggggtaccccggttaaacgggggtacccccgtttaggggtaccccgttaacccccggg

SEQ ID NO: 30077 - DNA, 664 bp, Homo sapiens
  misc_feature: GYAE6OF02HXUGV.1.49.E05.1.454.CMB.1.raw
  modified_base (615)..(615): a, c, t, g, unknown or other
  misc_feature (615)..(615): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgagtggtctcctgcagtgcttctggtacattctttccaccttacggtattgtaacgttggttagacggacgacgggacccccggagggacggggtccttaggacggtggacgtgggagtgggatcgacgtacccgttaacggaaactaaaaccgagtaacggttataggggaagtaaggtaacggttaccggaagggacgaaggtagtacgtactacgaactccgacccggacgaaccacgtactaccgaacgtacgtaacacgtaccctacagttacgaacgttggacgacgtcccgatagactcgtacggacgacgacgtacctacgttactttacgcggtcgacggtagacgttacgtttagtaccgacgttacggtacggtttaccgngggtacttaccgggaacccttaggtccggtttcgggacggtaacccggg

SEQ ID NO: 30078 - DNA, 750 bp, Homo sapiens
  misc_feature: GYAE6OF02JSE0R.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctcctgctagtgcttcgtaggttacattcgttttccaccgttacggttactagtaagtttggttagagtaccgacgggtaccccccgggaggtacgggggtccgttaggacggtaggtaggtcgggtaagtgggtactacgtacggacccgtttaacggtaaacgtaaaaacgtacggaaagttaacggtagggaaaggtaaggtaacggttaccggaggggacgaaggtacgtacgattaccgagtaccgaaccggcggtaaaccaccggtactacccgaacggaacgttaccgagtacccgtaagacgtacggaacgtggaacggacgtcctaacgtacagttaacgtacggaaccgtaaccgacccggaaccgttacgtttacgtttaccgacggttacgggaccgtacgggtacttaaggtttacgttacggtacgtaccggttaccggtacccggtcggttaaccgttaccgggaaaccgtacccggttcggtttaccggggtccggtaacccggg

SEQ ID NO: 30079 - DNA, 635 bp, Homo sapiens
  misc_feature: GYAE6OF02F567Z.1.49.E05.1.454.CMB.1.raw
  modified_base (514)..(514): a, c, t, g, unknown or other
  misc_feature (514)..(514): n is a, c, g, or t
  modified_base (558)..(558): a, c, t, g, unknown or other
  misc_feature (558)..(558): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaacgcctagggggcctcgacgtgagtaggtctccgtgcgagtgcttcgtggttacattcttttaccaccgtacggtatgtaattggttagagtacgacggcccccgggaggagggggtctggtacgtggtagtgggacgtggatcgacgtacccgttaacggtaaactaaaacgtacgtaaggtacgtaggaagtaaggtaaggttccgaagggtcaaaggagtactaagtaccacgttccgaccgcggaaccacgacctccgaaccggtagtaaccacggacctaacgagtacgggaacgtgacgggnacccgtacgagtactcgtagacgactaccgctacttagtaacgngtcgacgtgacgttatacgtcgacctacgtcggtccgtaggtcttaccggtaacccgacgtcgttgggtacggacgg

SEQ ID NO: 30080 - DNA, 759 bp, Homo sapiens
  misc_feature: GYAE6OF02JHANK.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagaagcctggggcctcagtgatggtctccgtgcagtgcttctggttacagttcctttaccacctacggtatcgtaattggtgtagacgtacgggacccccggtaggacggggtcttaggaggtggtagtgggtagtgggtactacgacggtacccgttaacgggaaactaaaaccgtaggtagtacgtagggaggtaacggtaacggttacccggagggtaccgaaggtacgtaccgtaactaccgtaacgtacccggaaccggacggtaaccgtaccgtaacgttaccccgaacggtacgtaaccgtacgtacccttaacgaacggttacgggtaaccgtacgggtaacgggaccgtacccgttacgtaacggtacgtaccggttacggaacccggtaaccgtacccgggacccttaactttaaccgttacgtacggtccgggaacgtaacggttagtaagtttaccgttcggaccgttacggttccggttacccggttaggtaaccgttacgttaaccccggtacggttccggtttacgggtcggtaacccggg

SEQ ID NO: 30081 - DNA, 597 bp, Homo sapiens
  misc_feature: GYAE6OF02FWM01.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctggttacatcttttccaccttacggtatgtattgttgagacaggcccccgagagggcttgagtggagtgggatggatcgacgtacctacggaactaaaacagagtataggagtagaagttcgaggcagagtcatcatcaccgcgacacactaccacgacgtacacgtacctaacgtacgaggtaacgttaggagggtacgccttacgagtacgtcgtagaccgacgaccggtaccctaactttacgttaacgtcggacgaccggtaagagttacgttagttcgtaccgtacgtcggttacccgtggtacgttaccggtaaccctaccggtaccgtttacggtacgggtacccgg

SEQ ID NO: 30082 - DNA, 663 bp, Homo sapiens
  misc_feature: GYAE6OF02GK3QQ.1.49.E05.1.454.CMB.1.raw
  modified_base (468)..(468): a, c, t, g, unknown or other
  misc_feature (468)..(468): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggtactattctttccacgtacggtatgtaattggttagagacgacggccccggtaggacggggcttggaggtggagtggggtatggatcgacggtaccgttaacggaaactaaacgaggtacgtagtaggaggaagtaacgttacggagggtacgaaggtagttacaattacagtaccgaccggacggaaccacgactaccgacgacgtaacacgccctaanacgtaggtaacgtaggaacgggtactcccgtagaacgtactaccgtacggaccgtaaccggacccgaccgttaaccgtttacttaaccgtcgaccgggaccgtaagaggttacttaggtcgaccgttacggttcgggtaccgtcggtaacccgttacgtaaccgtaccggttcgttacgggtccgggtaacccgg

SEQ ID NO: 30083 - DNA, 791 bp, Homo sapiens
  misc_feature: GYAE6OF02HUW3E.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgacccactcccaggttccaccgtggtgcagtctggagctgagctgcagaagccgtggggcctcgaggtgacgtgtcctccgtgacctaggtcgtcttcgtggttactacttccttttccgaaccttacggtattaggtatttgggtagacggaccgacgggacccccggagggacgggggtcttgggtacggtgggtaggtcgggtagtaggtaacgtcgtaaccggtaaccccggtttaaaccggaaaaaccgttaaaacggaacggtaacgggttaagtagggtaaacggtaacggtaaacggtttacccggaaggggtactaacgggtaggtaccgtattaacccggaacgtacccgacccgggaaccggaactaccctaactacccggaacggtaaaccgactaccggtacctcgaaggtaacggacggtagggaacggtaccgaccgtacgaacgttcgaccgtagaaccccggtaccgtaaccggtaccttaacgttaatttacccggcgttaaccgggacgtacgtaggttcttaaccggtcggttacctaagggtcccggttacgttcccgggtacgtttaacccgtaccggtaccgttcgggttcgggtacggtacccgggg

SEQ ID NO: 30084 - DNA, 691 bp, Homo sapiens
  misc_feature: GYAE6OF02J2FAW.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgacagaagccgtggggcctacagtgatcggtcctccgtgctagtcgtcttcgtcggttactacttccttttccaaccttacggtatgtaagtttggttgacgtacgaccgggtacccccggagggtacgggtcttaggacggtggtagtgggatggtacgtcgacggtacccttaacggaacgtaaaacgaggtagagtggaagacggtaacgtcgacggactaggagtacagtacgacgtacgacccgtacggaacctactaacgtaccgtaacgacgtaacgtacgacctaagacgtacggaacgtcggaacggacgtccgtaagtacgactacgtaggaaccgtacgaccgtacttaaccgttactaccgtggtaaccgcggtaacgtagaacgttttacgtacggtaccgtaacgttcggttaaccccgtggttacccgttacggtaaacccgttcgggtaccgtttagggtcccgggtaaccgg

SEQ ID NO: 30085 - DNA, 769 bp, Homo sapiens
  misc_feature: GYAE6OF02IJEBE.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactccccaggttcacctggtgcagtctggagctgagctgcagagccgtggggcctcagtgattggtctcctgcagtcgtcttcgtcggttactacttccgttttaccctaccgttaaccggttatagtaagtttggttgaacgtacgaccgggcccccggaggaggggtcttggaggtggagtaggagtggatcgacgcccgtacgaaactaaacgaggagtagtggaacgtagtaacgtaccggaggtcgaaggagtacatccgaacgtaccgacccggacggtaccaacgtacgtaccccgaacggtaccggtaacaccggtacccttaacgacgtaacgggaaccgttacgggaacgggtaaccgtacccgttacgaccggtaacgttccggtaaccggtaaccggacccgaaccccggggttaaccctaaccgttttaaaccgtttaccgacggtaccggggtacgaacggttaacgtagttttaaccggtaccggttacccggtacggtttacccgggttccccggttagggtacccgtttacccgggaaaccccggttaccgggtttacccgttgggggttaacccgggtacccggggg

SEQ ID NO: 30086 - DNA, 638 bp, Homo sapiens
  misc_feature: GYAE6OF02HAXDJ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtgggcctcagtgagtggtctcctgcagtgcttctggttacattctttccaccgttacggtatcgtaagttggttgacgacgtacgggcccccggaggacggggtcttggacgtggagtgggatggatcgacgtccctacggaaactaaacgagtagtaagtggaagtaggtaagttccgagggcaagagtactatcaacgtccaaccggcggtaacacctacgtacccgacgtaacgtaacgacgtacctaacgtaacgtacggaacgttaggaacgggaccgaccgtaacgagtacctacgtaggaaccgaccgaccggacctaacgtttaacgttacgtacggacgtcgaagtagttattaacgtcgtacgtcgttacggtccgtaggtacttacggaccgtacggtccggttaggcggtaccgg

SEQ ID NO: 30087 - DNA, 674 bp, Homo sapiens
  misc_feature: GYAE6OF02FMCH9.1.49.E05.1.454.CMB.1.raw
  modified_base (302)..(302): a, c, t, g, unknown or other
  misc_feature (302)..(302): n is a, c, g, or t
tcagacgagtgcgtcacgaccggtgctcgatttagagcgactagcaacgacacaaaggggacccaaaaaccacacccctccttgggagaatcccctagatcacagcctcctcaccatggacgggacctggagcatccttttcttggtggcagcagcaacaggtgcccactcccaggttcacctggtgccagtctggagctgagctgcagaagcctggggcctcgagtgatcggtctcctgctagtgcttctggttacattccttttccaccgttacggtatagtaatttacgggttgagacncgggacccccggaggaggggtcttaggacggttggaacgttggggatgggtacgtccgacggtcccctttaacgggaaaccttaaaaccgaggtaagtagtagggtaagaacggtaaggtttaccgaagggtctacggacgtcaacgttcaacgtaccgaccggcggtaccaacgactaccgaacgtagaccaggtacctacacgtacggtaactagacggacgccctagaggaacttcgttacgaaccggtaccgacccggaccttaacgttactacgttacggcgtacgaagtcgtattacgtcgacctacgttacggtcccttagggccttacggtaacccgacgtttcccgttagggtccgtaccggg

SEQ ID NO: 30088 - DNA, 853 bp, Homo sapiens
  misc_feature: GYAE6OF02IYZSC.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgccagtctggagctgcgctgcagaacggccgtggggcctcgagtgagttggtcctccgtgcgtaggtgtccttcgtcggttactacttccttttacccaaccgttacggtagttacgtaagtttcgggttaggacgaccggtaccggggtcccccgggtaaggtaacgggggttccgttaggtacgggttacggtaaggttgggtacgtaggggtaccgtccgtaaccggtacccccgtttaaacgggaaaaacccgttaaaacggacggtaagtaaacggtaggggtaacggttaaacggtaaaccggttccgggtaaacgggaccgtaacgggtaacggttacctaagtacccgtaagtacccggtaacccgggtacggaacccgtaacgtacgttacccgaaccggtaacgttaaccgacgtaacccgtagtaacccgtagggaaaccgtggaacggtaaccgtccgtaacgacgtaacgttacgaacggaccggtaccgtaaccgggttaccctaaacgttttacgtaaccgtacggtaccggacgtaacggtacgttaaggtttaccgtcggttaaccgtacgttaaccgggttccggttaacggtaccgtttaacccgggtaacccttccgggtaaccgttttacggggaccggttaacccggg

SEQ ID NO: 30089 - DNA, 774 bp, Homo sapiens
  misc_feature: GYAE6OF02J1JTC.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggctcagtgatggtctcctgcagtgcttctggtactattctttccaccgttcgtattgaattcggttgagaccgacgggtccccggaggtagggcgttaggacggttggagtcggggagtggtacgtcacggtacccgttaacggaaaccttaaaagacgtaacggttagtacgggaagtaacggtaacgttaccggtaacgggcgaaaggtactacggtaacgtactaacgttaccggaaccggtacgggacctaacgaaccgtacccggaacggtacggttaaaccgacggttaaccctacggtaaacggtaccgggaaacggttacggaacgggtacgtacccgtacggaacggtaacctaccggtacgggtaaacccggacccgtaaccgtacccgttaaccgtttaaccgtttaaccgaccggtccggtaaacggtaagttaggttaaccgtttaggtacccggtagtacccggtttaccgggtacggttaacccggacggtttaacccgtaaaccccgaccgggtttacctttccgggggacgttaaccccgggg

SEQ ID NO: 30090 - DNA, 672 bp, Homo sapiens
  misc_feature: GYAE6OF02FR4K3.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcgagtgatggtcctcctgcagtgtcttctggttactattctttccacctacggtatgtaagttggttgagacgacgggtcccccgggaggtacggggtcttaggaggttgggagtggggtactggtacgtcgacgtacccgttaacggtaaactaaaacgtaggaacgtagtagggaacgtagtaacgttaccgagggtacgaggtaacgtacatacgtataccgtacccggcgggtaacctacgtacgtcccgaaacggtacgtaaccgtaaccggtaccctaacgacgtaacggggtaacttgggaacggtacggcccttcgaacggtactacgtacggaacgaccgtacgggacccttactttaacgtactcggacacggtacgtagtacgttattcggacgtaacgtcggttccgtggtactacgtaaccgacgtcgttaggcgtacgg

SEQ ID NO: 30091 - DNA, 677 bp, Homo sapiens
  misc_feature: GYAE6OF02FLTQN.1.49.E05.1.454.CMB.1.raw
  modified_base (329)..(329): a, c, t, g, unknown or other
  misc_feature (329)..(329): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatgggtctcctgcagtgcttctggttacattctttccacctacggtatgtaattggtgagacgacgggccccggaggacggggtcgttggaggtggagtagggngtggatcgagtacccgttaacggaactaaaacgagagtagtaggagtaagtacgttcgaaggtcgaggtagtactatacgtactaccgaccggtccgaactacgacgtaccgaacggtacgtaacacggtacctaacacgtaggaacgtgacggacgccgtacgacgtactccgtacgaaccgtaacggtaccgtcccgtaacgtttacttacgtacggacccggtagtaacggacgttaatttacggttacggtaacctaccgggttaacgggttcccgttacgggtaccgttaccggttaaacccggtaccgggtttacggtttaccgggtaccggggtaaccggg

SEQ ID NO: 30092 - DNA, 769 bp, Homo sapiens
  misc_feature: GYAE6OF02JJHBC.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtgcagcagcacaggtgccactcccaggttcacctggtgcagtctggagctgagctgcagtaagcctggggcctcgacgtgacgttaggtctcctggccagtgacttctggtacagtctttccacctacggtatcgtaattggttgagacacggcccccggaggtagggcgttggtagtgtgtaggatggtactcgaggtccctaacgtaaacgtaaacgacggtagtacgtaggtacgaaggtaacgttacgtaacgggaccgtaggaacgtcgtaaatacgtaacgtccgtaaccggacggtaccgtaacgtacctacccggtaacggaaccggttaccgtacggacccttaaaccgacgtaacgggtaacttacgggacgtaacccggtcctcggtaaaccgacggttccttaacgggacccgaacggtaaaccccgggtaaccggtaaccgtttaaacgtttaacccgcggtaaccgggtacggtaaacgggtacggttaactttaacggtttccggtaccgttaacggtttccgggttaacccggttccggtttacccgtaaccggggtttaaacccccgcggtttaccgggttttacggggtaaccgggttacccccgggg

SEQ ID NO: 30093 - DNA, 834 bp, Homo sapiens
  misc_feature: GYAE6OF02IPW5Q.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttccacctggtgcagtctggagctgagctgcagaagccgtgggcctcagtgatggtctcctgcagtgcttcgtggttacacttccttttacccaccgttaaccggttattacggtaaagtttcgggttagacggtaccgaaccgggtaccccccgaaggggtacggggaacgggggtccgtttagggagggtacgggtaacggttagggggaagttaggggtaacttaccggaacggttaacccccgtttaaaacggggaaaaaccttaaaaaccggaagggtaagttaaacggtaggggaaacggtaaacggttaacgggtttacccggaagggggtaacctaaacgggtaacgtaaccgtaacgttaccgtaaccgtacccggacccggggtaacgggtaaccctaaccgaaccgttacccgaaacgggtaaccttaaccgaccgtaccctaaacgacggttacggtaaaccgttcgggaacggtaccgtaccctaccggagtaccttacgaccggtaaccgaccgtaccggtacctaactttaacgtaccgtagtaccgaacgagtaacgtagttttaacgtacgtaaccggttagttaccggtccgttagggtaccttaacccgggtaaccgaccggtttcggttacgggtaccggg

SEQ ID NO: 30094 - DNA, 843 bp, Homo sapiens
  misc_feature: GYAE6OF02HWGSJ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgagtggtctctgacagtcgcttctcggttacacttccttttccaccttacggtagttcgtaagttgggttcgtagaccgtacgggtcccccggagggtacggggtccttgggtacggtgggacgttggggacgttgggtacgttcgacggtacccgttaacggtaaaccgtaaaacgtacggtaaggtacgttaggggacggttaaacggtaacggtttacccggaaggggaccgtaacggtaacggtaccgttaacgtaccggttaacccgtaccggtaaccccgggaacgtaaccccgtaaccggtaaaccgtttaaccccggaaacgggtaaccggttaaacccggaccgttaaacccgttaaacggaccggttaaaccgggtaaaccggttaacggaaaggggttacccggtaccgtttaacggaaaccgtaacggttacgttaaccgggaacccggtacccgggtaccggggtaccgttacggtttaacgttaccggttacggttacggaccggtaagtacgggtaacggttacgaacgttaccgtacgggttcgtaccggtacggtccggtaccgggtaacggaccggtacccgtacgggtaccggtaccccg

SEQ ID NO: 30095 - DNA, 667 bp, Homo sapiens
  misc_feature: GYAE6OF02FO90Z.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttgggtggcagcagcaacaggtgcccactcccaggttcacctggtgcagtctggagctgagctgcagaagcctggggcctcagtgatggtcctcctgccagtgtcttcgtggttacacttctttccaccttacggtatagtaagttcggttgagacgacggtcccccgggaggaacggggtcgttcggagtacgggtagtcgggagtggtactcgacgtacccgttaacggaactaaaaaaacgcggtaagtagtacgggaagtaaggtaacgttaccgagggtacaggtagtacgactctagttacccgaccggacgaaccgaacctactacccgacgaagttaccaacgtaccctaacacggtaggaaccgttaggaacggtacgtccctagtaacgacttcgacgaccgtacgaaccgtcctaacttacgttaccgtcggtaacgacggtacgtagtattacgttcgtaccgtacgtcggttcgtacggtcgtacctaaccggcgtcggttcggacggtaccgg

SEQ ID NO: 30096 - DNA, 896 bp, Homo sapiens
  misc_feature: GYAE6OF02G23ME.1.49.E05.1.454.CMB.1.raw
  modified_base (196)..(196): a, c, t, g, unknown or other
  misc_feature (196)..(196): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatacttttcttggtggcagcagcaacaggtgcccactcccaggttccacctggtgcagtctgganctgagctgcagaagccgtgggcctcgagtgatcggtctccgtgcgtacgtcgtccgttcgttcggtttaacctacgtttccttttacccgaacccgtttaaccggttaacgtttacggttaaaacgttttcgggtttaaggaaccggtaacccggtaaccggggtaccccccccggggtaaaggggttaacccgggggggttaccgtttacggggtaaccgggttaggggtaagggtaccggggggttaagttaacggggtacgttaccgtaacccgggttaccccggttttaaaccggggaaaaacccgttaaaaaacggacgggtaaacggttaaaggtaacggggtaaacggtaaaccggttaaccgggttttaccggaacggggttaacgaaggtacgttacgtacgtacgtaaccgtaccggtaacccggaccgggtaaacccaaccggttacgtaccggtaaccgtaacggtaccgaacgtcccgtaaacgtacgtaggtaacgtacgtaacgggtacgtaccgtacgtacgtacttacgtacggaaccgtaaccgaccgtaccttacgtttaacgttccgtaacgaccgggtacgtacggtagttacgtttaagttccgaaccgttcgttaccgggtaccgttaggtcgttaaccggttacccgtagggtcccgtttagggtacggtacccgg

SEQ ID NO: 30097 - DNA, 774 bp, Homo sapiens
  misc_feature: GYAE6OF02IFWVW.1.49.E05.1.454.CMB.1.raw
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtgcccactcccaggttcacctggtgcagtctggagctgagctgacgagaacgccgtggggcctcgagtgagtcggtcctccgtcgcgtagtcgtcttcgtaggttacctactttccttttaccctaaccgttacggttattcgtaaagtttgggttagaacggtacggacccgggtaccccggagggtacggggtcgtttaggaggttagggacgtggggtagtgggtaactacggtaaccgtacccgttaaacggtaaaacgtaaaacgtacggtaagtaacggtaggtaggaaacggtaacggttaccgaagggtacgaaggtacgtacactacgacgtaccgaccggtacgaaccgaacgtaccgtacccgaacggtaccgttaacgacgtacccgtaaacgtaacgttacgggaaacgttacggacggacgttaccgtaacggactaacgttcgaacggtaaccggaaccgtaccggtaccgttaacgtttagttaccggacggtacccgaggtacggtattaacgttacgttcggaccggttacggttccgggttaccgtacggtaccgttaacggtacccgtacggttcgttacgggacggtacccggg

SEQ ID NO: 30098 - DNA, 778 bp, Homo sapiens
  misc_feature: GYAE6OF02I2383.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccatggacgggacctgagcatcctttcttggtggcagcagcaacaggtgcccactcccaggttcacctggtgcagtctggagctgagctgcagaagcctggggcctcagtgatcggtctccgtgctagtgtcttctggttacattctttccaccgtacgtatgtaagttggtcgagaccgtacgggacccccggtaggaacgggggtccttggacggtcgggtagtacggggattaggacgtactacgtcccgttaaaccggaaaccgtaaaaacgtacggtaaggttaaggtagggtaaggtaagtaaacggttcccgggaacgggaccgtaaaggaggttaaccaacgttaccgtaacgttacccgacccggtaccggtaaacccgaacctaaccggttcccaaaccgggtaacggtaacccaacggtacccgttaaacaaccggttacgggtaaaacgcgggtaaaccgggaccgtacccgtaacggtaaacggtactttacccgtacggaaacccggtaaccgaacccgggtaacccttaacgtttaacttaccggtcggacggtaaccgaacgtagtaaacttacgtacggtaccgtaacgtccgggttacctggtacccttaacgggtaaccccgacggtaccgtttgggaccgggtaccgg

SEQ ID NO: 30099 - DNA, 764 bp, Homo sapiens
  misc_feature: GYAE6OF02IY0TM.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtgcagcagcaacaggtgcccactcccaggttcacctggtgcagtctggagctgagctgcagacgccgtgggcctcgagtgagtcggtctccgtgcagtcgtcttcgtagttacacttcctttaccaccgttacggtatgtaacttggttagtaacgacgtaccggccccgggtagggacgggtcttaggaggtaggtacgtggggtacgttaggaacgttccgaacgtacccgttaacgggaaaaccgttaaaacggacggtaaggtaacggtaggaaggtaacggtaacgtccgggtaaacggcgaagtacgtaccgagttacgacgtacccgaccgacggtacctaacccgacgttaccccgaaacggaccgttaaccgacgtaaccgttaaccgtaacggttaccggaacgttacggtaaaccggaccgttaccggtaccgtaaggtaccgttaccgggtaacgttacccggaaccgtacccgggtaaccttaaccgttaacgtttaccgtacggaacccggtacgtacgggtattacggtttaaagtcgtacgttaaccggttcttaccggttcgtaccgttacggtaacccgtgtccggttccggtaggtaccgg

SEQ ID NO: 30100 - DNA, 719 bp, Homo sapiens
  misc_feature: GYAE6OF02JJXOK.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgattggtgagacacggccccggaggaggggtcttggaggtggagtgggatggatcagtcccgttaacggaacgtaaaacacggtagtagtagggaagaggtaacgttaccggagggacgtaggaacgtcgaatacgacgttaccgaccggaccggaacgtacctaacggtacccgaacgggtaacgtaaccgtaaccgtaccgttaaccgacgttacggaacggttacgaacggggtacgcccgttaccgtacggtaacttaccggtaccggtaaaccgggtaacccgaacccgggtaacccgttaaccgttttaagttaacccgtacgggaccgtaccgggtaaccgaggttaccgtttaagttcggtacctacgggtttcggtcccgttacggtaccgttaccgttaacccggtaaccggtcgggtttacggttcgggtaacccgg

SEQ ID NO: 30101 - DNA, 664 bp, Homo sapiens
  misc_feature: GYAE6OF02HH4XT.1.49.E05.1.454.CMB.1.raw
  modified_base (250)..(250): a, c, t, g, unknown or other
  misc_feature (250)..(250): n is a, c, g, or t
  modified_base (282)..(282): a, c, t, g, unknown or other
  misc_feature (282)..(282): n is a, c, g, or t
tcagacgagtgcgtcacgaccggtgctcgatttagagcgactagcaacacgacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctctgcagtgcttcgtgttantcttttccacctacggtatgtaattggttganacgaggcccccggagaggggcttgagtggagtggagtggatcgacgtccttaacggaaactaaaacagtagtagtaggagtaagagttcgaaggcagaagtcatacatccgacgccgacacgactaccaacggtaagtaccgaagtaccctaactagtacggaaacgttggaacggtaaccgaccgttcgacgtaacgttaccgtacggaaccgtaaccgtccggaacccctaacgttttaccgttaaccgttacggaccgtaccgacgtaaccgttaagtttacgttacggccgttaacccggttccggtacccgttaggtaccgtttaaaccggtaaccccgtaacgggtttccccggtttagggtcccggtaacccggg

SEQ ID NO: 30102 - DNA, 721 bp, Homo sapiens
  misc_feature: GYAE6OF02I0BID.1.49.E05.1.454.CMB.1.raw
  modified_base (200)..(200): a, c, t, g, unknown or other
  misc_feature (200)..(200): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttgggtggcagcagcaacaggtcgcccactcccaggttccaccgtggtgcagtctgganctgagctgcagacgccgtggggcctcagtgagtcggttctcctgacgtgtcgtctttcgtggttacactttcctttccaccgttacggtatagtaagttggttgacgtacgaccgggccccggaaggtacggggtcttggacggtggacgtgggatcggagtcgacggtaccttaacggaaactaaagagtaacgtagtagggaagtaagtaacggttaccggagggtacgtaaggtacgttacgaacgttacgaaccggtacccgaaccgggacgaaccgtaacctacgtaacccggaacggtaacgttacccgaccgtaccgtaacgtaaggtacgtaacggtacgaacggtaccgcccgtagtagtccgttacggacggaaccgaccggacccgtacccttaagtttacttacggcggaacggtacgtaaggtacttacgttacgttcggactacgggttaccgttcggtacggaccttacggtaaccgtcggtttaacgttcgggtacggtaccggg

SEQ ID NO: 30103 - DNA, 724 bp, Homo sapiens
  misc_feature: GYAE6OF02IY71I.1.49.E05.1.454.CMB.1.raw
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcacctggtgcagtcgtggagctgagctgcaggaacnccgtggggcctacagtgagtggtctcctgcagtgcttgnggttacattctttccactacgtatgtaagttggtgagacgacggccccggaggacgggcttggaggtggagtagggagtggatacgacgtaccgttaacgaaactaaaacgagtaacgtagtaggaaggtacggaacgttaccggaagggactagaagtcactacgtactacgaccggaccgaacgaacctaacgtacccgaacggtaacggtaacaaccgtacctaactaacggtaacggaacggtaggaacgggtacaccgttacgaactaacgtactacggaaccggaaccgaccggtaacccttaacgttaaacgtttaccgtacggacccgaacgggtaacgtaggttaaacgtttacgtccgggtaaccgttaaaccgggttaccgggttaccccggttaaggtaaccccggttaccgttaaacccgggtaccgttaccgggtttacggggtacgggtaaccccgg

SEQ ID NO: 30104 - DNA, 884 bp, Homo sapiens
  misc_feature: GYAE6OF02GS63T.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgccactcccaggttcacctggtgcagtctggagctgagctgcgagaacgccgtggggcctcgtacgtgagttggtcctccgtgccgtaggtcgtcgtttcgtggttacctagttccttttcccgtaccgttaccggttatagtaacggtttgggttacgtaaggaccgtacggggaccccccggtagggtaacgggggtcgttcgggtaaggttggggtaacgggttggggtaacggttacgggtaacgttacccgtaaaccgggttacccccggtttaaaaccggggtaaaaaccggttaaaaaaaacggggtaaggttaaacggttaaggggtaacgggtaaacggttaaaccggggttttacccggaaaccgggggtacggtaaacggggtaactacgtaaccgttaacctaacggtacccgtaacccgggacccgggtaactaaccggtaccgtacccggaaacggttacggtaaccgaccgaccgttaaaccggaggtttaacggaacccgtagggtaacggtaccggtaccgttaacgacgttaacggttccggtaccggtaaccgaccggtacccggtaccttaaacggttacgtttaccgccgggtaacgacggtaacgacttagttacgtacggtccgtaacggttccgttcggtacccgtacgttaacggtccgtaccggttcggtttaacggtcgggtaccttaaccggggg

SEQ ID NO: 30105 - DNA, 669 bp, Homo sapiens
  misc_feature: GYAE6OF02F2EVX.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcgagtgatggtctcctgcagtgtcttcgtgttactactcttttccaccgttacgtagtgtagttggttgagtacgacggcccccggaggacggggtcgttggtaggtggacgtgggagtgggtactacgacgtacccgttaacggaaacgttaaaacgaggtaacgtagtagggaagtaggtaacggttaccgaagggcaaggacgtctaactaccgaactaccggaccgacggtaacacgaacgtccaacggacgttacgacgtaaccctagacgtacggaactacggaacggtacgcccgtacgaacggtacttaccgtagggacccaaccggaccggtacctacgtttaaactaccgtacggtacgacgtaggacgttatttacggtcgacttacggtcgttcgtacggtccgttacgtaacccgtaggttcgtacggtacgggtacg

SEQ ID NO: 30106 - DNA, 783 bp, Homo sapiens
  misc_feature: GYAE6OF02HBNNH.1.49.E05.1.454.CMB.1.raw
tcagacgagtgcgtcacgaccggtgctcgatttagagcgactagcaacacacaaaggggacccaaaaccacaccctccttgggagaatccctagatcacagctcctcaccatggacgggacctggagcatccttttctggtggcagcagcaacaggtgcccactcccaggttcacctggtgcagtctggagctgagctgctagagccgtgggcctacagtgagtcggtctctgctagtgtcttcgtggttaacctcttcttttcccgaacgttacggtattacggtaagtttgggttcgaacgtaccggtaccgggaccccgggtagggacgggtcttaggacgggtggagtggggatgggacttcgacgttaccgtaacggaaaacctaaagcggtaagtacgtagggagtaagtacgttaccggaagggacgtaaaggtgtaacgtagtacgtaaccgttaacggacccgggtaacgaccgttaaccgaccgttaccgaaacggtaccgttaacgaacgtacccgtaagaggttaccggaaacggttggaacggtaccggacccgtagtaacggaacttccgggtaacggacccggaaaccgtaccgggtaaccttaaccgttttacgttacccggcggtaaccgggtacggtaaacgttacggtaaggtttttaccgtacggttaacccggtcgtttaccggggtacccgttttaccgggtaaccggtaacgttaaccccgggttacggtttccgtttagggtacccggggttaaacccg

SEQ ID NO: 30107 - DNA, 843 bp, Homo sapiens
  misc_feature: GYAE6OF02G5F9N.1.49.E05.1.454.CMB.1.raw
  modified_base (243)..(243): a, c, t, g, unknown or other
  misc_feature (243)..(243): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgacaggaagccgtgggcctcgagtgagtggtctccgtgacgngtgtcttctaggttacctatttccgttttacccaccgttacggttattaggtaaagtttcgggttagacgtaccgtaccggggacccccggagggacgggggttccttggtagggtaggtacggtggggtacgtggaacgtacgacccggtacccgtttaaacgggtaaaacctaaaacggaagtaacggtaaggagggtaaaggtaggtaaacggttaccggtaagggaccgtagggtaacgtaccgtattaccgacgtacccgggtaaccgaccgggtaactaacccgtaccgttaacccggaaccggtaacgttaacgaccgtaccgtaacgtagtaacggacgttaacggggacgtacggtacccgtacgtaacgttacgtacccggttaaccggaaaccggtaacccgtaacccgttaaacccgttaacgtttttaaacccgtaacgggttacccggtaacgggaacggtaaaggtacgtttaaacccggtttagtaacccgtaccggttacggttaacccgggtccggttacgttacccggtaaccggtttaacccgtacccgggtttcggttaggggtccggtaaccccgggg

SEQ ID NO: 30108 - DNA, 762 bp, Homo sapiens
  misc_feature: GYAE6OF02HN7M3.1.49.E05.1.454.CMB.1.raw
  modified_base (196)..(196): a, c, t, g, unknown or other
  misc_feature (196)..(196): n is a, c, g, or t
  modified_base (275)..(275): a, c, t, g, unknown or other
  misc_feature (275)..(275): n is a, c, g, or t
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (409)..(409): a, c, t, g, unknown or other
  misc_feature (409)..(409): n is a, c, g, or t
tcagacgagtgcgtcacgaccggtgctcgatttagagcgactagcaacacacaaagggaccaaaaccacaccctcctggagaatccctagatcacagctcctcaccatggacgggacctggagcatcctttcttggtggcagcagcaacaggtgcccactcccaggttcacctggtgcagtcgtggagctgagtcncgcaagagccgtggggccctcgagttcgagtggtcctccgtgcgagtcgtcttgtcggttactacttcttttaaaaccnccgtaggtatagtagttgttagacgctacggtcccgtacggaggtacgggtctaggngttaggngtagggagtacgtattccgagtaccccgttaacgtaaaactaaaacggtaggtaacgtagtacggggaanaaggttaacggttacgaaggggaccgtaagggtaactacgtacgtaccgtaaggtaccgaacccggtacggaacctaacgaccgtaccgaacggtaacgtaacgactaccgtaacgaagtaacgggaacgtaggaacggtccgtaaaccgtcgaaacgtacgtacgtacggaacccgtaacgaccgtaaccttaacgttccgttaaccgtcgggaccgttaacgggtaacgttaacggttcgtttaaaccggtacgttacccgtaaaccggggttttccgggtttacgaaccgggtttacccgtaacggttttaaaacccgggtcggtaaaccgggtttccgggtaaccgggg

SEQ ID NO: 30109 - DNA, 685 bp, Homo sapiens
  misc_feature: GYAE6OF02I30EM.1.49.E05.1.454.CMB.1.raw
  modified_base (158)..(158): a, c, t, g, unknown or other
  misc_feature (158)..(158): n is a, c, g, or t
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (497)..(497): a, c, t, g, unknown or other
  misc_feature (497)..(497): n is a, c, g, or t
  modified_base (521)..(521): a, c, t, g, unknown or other
  misc_feature (521)..(521): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcactccttttctggtggcagcagcaacnggtgcccactcccaggttccaccgtggtcacgtagtcgtgggacncgtgngctgacagtacgcgtgggcctgagtgactcggtctacgcgcgtaggtctacgttacgtggttactactttccgtttccaacgttacggtatagtacgttggtacgaacgacgtaccgggccccggtaaggtacggggtcttacggtaggtaggtacggttagggagtggtactaccgtacgggttacctaaaggtaaacctaaagtaggtaaggttaggtaggtaaggtaacggtaacgttaccggaggacgtaagacggtacgaacttacgacgttcacggacgtaanaccgtactacgacgtagaccgtanaccgtagacgtacgaagaggtacgacgtccgtataacggactcgtacggaaccgtcgaacccggtaccttacgttacctacggctacgacgtagttacgtacgtttacgcggtactacgggtcttacggcgttactaccggtaactcggtctagggcgtaacgg

SEQ ID NO: 30110 - DNA, 813 bp, Homo sapiens
  misc_feature: GYAE6OF02F8VZO.1.49.E05.1.454.CMB.1.raw
  modified_base (786)..(786): a, c, t, g, unknown or other
  misc_feature (786)..(786): n is a, c, g, or t
tcagacgagtgcgtcacgaccggtgctcgatttagagcgactagcaacacacaaaggggacccaaaaaccacacccctcgttgggagaactccctagatcacagctcctcaccagtcgggacgggacctggagcacttccttttcgttgggtcggcagcagcaacgaggtcgcccaccgtcccagggttaccaccgttggtcgctagtcgtggagcgtggacgctcggacaggaacgccggttcggggcctacgtaggtcgagttcgggtcctcctgacgtaggtcgttccgtttcggttacggttacttactttcctttacctaccggttcgtagtacgttaagttcggttaggacggaccgtaccgggtacccggagggtacggggttacttgggtaacggtacggaggtaggggtacgtacggtacgaccggtaacgttacccgttaaacgggtaaacgtaaaacgagtaacggtacgttaaggggacgtaacggtaaccgttaccgggagggtacgaaggtacgtacgtaacgtaccgtacgtcccgaacggtaccggaactaccgaacgtccggaaacgtaccgaaactcccgtaacgtacacgggttacggaacgtacggggaacaccggaccttaaggagtacgttcgaccgggaaccgtaccgtaacgggttaccctaagtttaaccgttcgaccggtacgggaaccgtaaggacgtttacgtttacgtacgggacctttcgggtacgtcccggtttagcccgttacggtaacccggntttacggggtcgtcccggtaacccggg

SEQ ID NO: 30111 - DNA, 881 bp, Homo sapiens
  misc_feature: GYAE6OF02FSWS2.1.49.E05.1.454.CMB.1.raw
  modified_base (240)..(240): a, c, t, g, unknown or other
  misc_feature (240)..(240): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctctgcagtncttcgtgttactattctttccacctacggtatgtaagttggttgagtacgaccggccccggaggtacggggtcgttggagggttggaggttaggggagttagggtactccgtaacggttaccccgtttaacgggtaaaaccgtaaaaacgtaggtaaggttacgtaggggtagtaaggtaacgtttaccgggaacgggtacgaagggtacgtacgtacgttaccgtaacgttacccggaacccggtaccgtaaacccgtaaccgtacccgttaaccccggaaaccggttaaaccggttaacccgaaaccggtaccccgttaaaccggtaacggtaacccggggttaaacgttaacggggaaccggggtaacgttaacccccgtaccgtaaacgggtaccgtttacccgtaccgggaaacccggtaaacccggtaaccccggttaaccccgtttaaacccttttaaacggtttaacccggtacgggtaccgggtaaccggggtaaggttaacggttaacttttaccgggtttaacggtacccggtttaacccggttcgggttaccccgggttacggttaacccgtttaccggttaaaccccggacggttttccgggtttaccggggtacgggttaccccggg

SEQ ID NO: 30112 - DNA, 652 bp, Homo sapiens
  misc_feature: GYAE6OF02ICNHJ.1.49.E05.1.454.CMB.1.raw
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtgcccactcccaggttcacctggtgcagtctggagctgagctgcagaacgccgtggggcctcgaggtgatcggtctctgctagtcgtcttcgtggttactattcctttcctaccgttaggtactagtaagttggttagagacgacgggtacccccggaggacgggtcgttggacggtgggagtagggtagtggagtccgtacgtacccgtaacggtaaactaaacgagtagtagaggagaaggtacgtacgaggacgagacgtacagtactacgtacgaccgacgacacgtacgtaccgacggtaactacgacgacctaacgtagtagaacgtaggacggactactacgatacgtcgtacgacgtacaaccggtacgtacgttaacgttacgtacggaccgtacgagtagtagtttacgcgttacgtacgtccggttaccgtcggtaccgttaccggtaaaccgtacggtccggttacgggtcggtacccggg

SEQ ID NO: 30113 - DNA, 541 bp, Homo sapiens
  misc_feature: GYAE6OF02FZMDF.1.49.E05.1.454.CMB.1.raw
  modified_base (414)..(414): a, c, t, g, unknown or other
  misc_feature (414)..(414): n is a, c, g, or t
  modified_base (433)..(433): a, c, t, g, unknown or other
  misc_feature (433)..(433): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagtacaggcccccggagaggggcttggagtggatgggatggatcagccttacggaactaaaacagagtataggagagtaacgtcgagggcagagtcatcatcaccgcgacacatccagagtacagtcctacanggaactgaggagcctaganagtctagacgacgacgacctacttacttaactgtcgacgagagtacttattggactacgtcgtccgttaggtcgtacgtaacccgtacgtccgtttggtggtacccgg

SEQ ID NO: 30114 - DNA, 542 bp, Homo sapiens
  misc_feature: GYAE6OF02FE6EH.1.49.E05.1.454.CMB.1.raw
  modified_base (448)..(448): a, c, t, g, unknown or other
  misc_feature (448)..(448): n is a, c, g, or t
tcagacgagtgcgtcacgaccggtgctcgatttagagcgactagcaacacacaaaaggggacccaaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggccccccggaggagggggcttgagtgggatggggatgggatcagcccttaacgggaactaaaaacagagtatggagagaagttccagggcagagtacatcatcaccgcggacacatccacgagtacagtccctacatggaactgaggagcctcagatcngacgacaaccggcctaactttattactcgcgcgaagtagattagttgcaccgtggttccctgggcctgtaaacccgcgtcgttggtgggtaccg

SEQ ID NO: 30115 - DNA, 745 bp, Homo sapiens
  misc_feature: GYAE6OF02JQFLI.1.49.E05.1.454.CMB.1.raw
tcagacgagtgcgtcacgaccggtgctcgatttagagcgactagcaacacacaaaggggacccaaaaaccacacccctccttgggagaatccctagatcacagctcctcaccatggacgggacctggagcatcctttcttggtggcagcagcaacaggtgcccactcccgaggttcacctggtgcagtctggagctgacgctgcagagcctggggcctcagtgagttggtctccgtgcagtgtcgttcgtaggttactacttccttttccaccgttacggttatgtaacgtttggttagacgtaaccggcgggacccccgggtaagggtacggggggtaccttaggtacgggttaggaaggtcggggtacgtcggggtaacttcgaacccggtaccgttaacggaaaacgttaaaaccgaggtaagtaagtgggtaagtaacgtaacggttaccggacgggaacgtaggtaacgtacgtactcgtaactaccgtaaccggacgactaaccgacctaaccggtacggtaacgtacgtaacgccgtaacgtaacgtacggaacgttgggaaacgtccgaccttacgaacgtcgtacgtaggtaccgaaccgtaccgggttaccttaaaccggttactttaacggccggtacggtaccgtaacgtacgtaatttccggtagtaaccgtcggttaaccgtcgaggttcccgtaacggtacccgtacggttaggttcggtaccggtacgg

SEQ ID NO: 30116 - DNA, 689 bp, Homo sapiens
  misc_feature: GYAE6OF02F6A3H.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagctcggggcctcagtgatggtctccgtgcgtagtgtcttctggttactattccttttcccaccgttacggtactagtaagtttggttagacgacgtacggccccggaggtacggggtcgttggaggtcggaggtacgggagtcggagtacgacgtacccggttaacggaaacgtaaacgacggtaagtagtacggaggaagtaacggttaccggagggacgtaaggtacgtactaagtctacggtaccgaaccggaccggaaccacgtacgtaccgtaacggtaacggtacgaccgtacgttaacgaggttacggaacgttaggacggaacgccggttaacacgtatccggttacggacctaccggaaccgtacgtaacttacgttacgacgtccgtagaccgttagacgtttacggtcggacctcggttacggtcctaggttcctaacggtacctccgggtaccttagggcggtaccggg

SEQ ID NO: 30117 - DNA, 728 bp, Homo sapiens
  misc_feature: GYAE6OF02GNXAV.1.49.E05.1.454.CMB.1.raw
  modified_base (198)..(198): a, c, t, g, unknown or other
  misc_feature (198)..(198): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgngctgcagaagccgtggggcctcagtgagtggtcctcctgcagtcggtcttcgtggttacctagtttaccttttcccacccttaacggttattagttaagtttgggttggacgaccgaccgggtacccccggagggaggggtcgttaggtaggtggtaggttgggtacggtaggtctacgtaccgacccgttaaacgggaaaacctaaaacgaggtaagttaacggtagggtaaggaacggtaaggttaccgaacgggacgacggtaacggttacacgtactacgtaccgaacccggaccggaacacgtaaccgtaccgaacggaacgtaccgaaccgtcctaaccgtacggtacggtaacgtacggacggacgaccgtagacgtacgtctacgaacggaccgaaccggacccttaactttaaccgtacgtcggacccgagtaacgggacttaaggttcgtacgtaccgtacgttcgggttacccgtgggttacctacggtacccgtaggtccgttacgggtgtaaccggg

SEQ ID NO: 30118 - DNA, 702 bp, Homo sapiens
  misc_feature: GYAE6OF02FISKO.1.49.E05.1.454.CMB.1.raw
tcagacgagtgcgtcacgaccggtgctcgatttagagcgactagcaacgacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagaagcctggggcctcagtgatggtctcctgcagtgcttctggttacatctttccacttacggtatgtattggttgagacgtacggcccccggtagagggggtcttggaggtggagtcgggatggatcgacgtcccgttaacggtaaactaaacgacgtagtacgtaggagagtaacgttccgagggacgtaagacggtacaacgtcacttccgaccggacgaccgacacgtacccgaacgtaacggttaaccacgtaaccctaacgtaacggtaacggtaaacggttcggaaagggtaccggtaccccgttagaacgtaccgttaacccggacggtaacccggaacccgtaacccggggacccttaaacctttacgttaaccgtccgggaccgacggtacggtacgtaacgttacgttccggtacgtaaccggttccggtccgttaacggcccgttacgtaacccggtacgttccggttacgggtaccggtaccggg

SEQ ID NO: 30119 - DNA, 633 bp, Homo sapiens
  misc_feature: GYAE6OF02FVZB0.1.49.E05.1.454.CMB.1.raw
  modified_base (327)..(327): a, c, t, g, unknown or other
  misc_feature (327)..(327): n is a, c, g, or t
  modified_base (581)..(581): a, c, t, g, unknown or other
  misc_feature (581)..(581): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccactacggtatgtaattggttgagacacggtcccccggaggacgggtcttgaggtggatggggatggntacagcccttaacggaactaaaacagtaacgtatagggaagtagaaggttaccgagggtacgaagacgttacgaatcctaagttaccgaacggacggaaccgaacaaacgttacccgaacgtaagtaccgaaacgtcccgttaacaagtacggtaaacgttcggaaacgggacggaccctacgagtaaacgtcgtacggaacaccgacgaccctaacgttaacttacgacgtccgacgagacgtattaacgttnctaccgtaggtcctggtacctacgtaaccgtacgtcgttacggtggtacccg

SEQ ID NO: 30120 - DNA, 668 bp, Homo sapiens
  misc_feature: GYAE6OF02HEWGK.1.49.E05.1.454.CMB.1.raw
  modified_base (243)..(243): a, c, t, g, unknown or other
  misc_feature (243)..(243): n is a, c, g, or t
  modified_base (433)..(433): a, c, t, g, unknown or other
  misc_feature (433)..(433): n is a, c, g, or t
  modified_base (471)..(471): a, c, t, g, unknown or other
  misc_feature (471)..(471): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctctgcagtgctttntggttacattctttccacctacggtatgaattggttgagacgacggcccccgggaggacgggtcttggaggtgggataggggattaggattacgacggtacccttaacgggaaaacttaaaaccgaggtaagtaagtagggaagtaaggaaggttaccggagggtacgtaaggtacgtactagactaacncgaaccggacgtaacgactacaccgtaacgataacganccgtaacctaagacggtaacgtaggacggtacgaccgtacgagtactcgtacggaccgaaccgcggtaaccctaagtttaacctcgtacgggaccgaacggacgagttaacttagtaacgacccggttagtaccggttccgtaacgggttcccgaacgtaacccggttacgggttaccttggggtaccggtaccggg

SEQ ID NO: 30121 - DNA, 887 bp, Homo sapiens
  misc_feature: GYAE6OF02G0FQB.1.49.E05.1.454.CMB.1.raw
  modified_base (195)..(195): a, c, t, g, unknown or other
  misc_feature (195)..(195): n is a, c, g, or t
tcagacgagtgcgtcacgaccggtgctcgatttagagcgactagcaacacacaaaggggacccaaaaaccacacccctccttgggagaatccccctagatcacagctcctcaccatggacggacctggagcatcctttcttggtgcagcagcaacaggtcgcccactcccaggttcaccgtggtgcagtctgganctgcgctgcagacgccgtgggcctcagtgagtcgtcctcctgcagtcgtcttcgttggttactactttcctttccctaccgttacggttactaggttaagtttggttacgaacggacgtaccgggacccccgggaggtaacggggtccggttaggaggttgggtacggtggggtacgtcggtactccgtaacggttaccccggttaaacgggtaaaaccgttaaaaaccggaggtacggtaacggtagggaaaggtaaacggttaccggttaacgaaggggtactaaggtacgttacgtaacgtaccgtaacgtacccgaacccgggtacgggaacccaacgtaacccgtaaaccgtaaccgggtaaaccggtaacccgaaaccggtaaccgtaaccgtaaacgggttaaccgaaaccggttaacgggaaggggtaaccccttcccgtaacggtaaacggtaccgtaacgttaacggaaacccggtaacccggaaccgttaacccttaaccgtttaacgttacggtcccgaaccgggtactaacgggttacgtttaaaggtttaccggttaccggttacttaaacccgggttttcccggaacccgggttttaccggtaccgtttaaaccccgggttaaccccgtaacccgggttttacggttttacccgggggtaacggtttaaccccgggg

SEQ ID NO: 30122 - DNA, 751 bp, Homo sapiens
  misc_feature: GYAE6OF02IXTFV.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtgcccactcccaggttcacctggtgcagtcgtggagctgagctgcagaacgccgtggggcctcgagtgatggtctctgctagtgcttctggttactattcctttaccactacggtatgtagttggtagacgacgaccgggccccggaggtcggggtcgttggacggtgggaaggtcggggtagtacgggtatacggaccgtacccgtttaacggaaaactaaaacgtaggaaggttaacgtagggaaggtaacgtaacggtaccgtaagggacctaaggtaacggtctaacgtaccgaacgtccggaacccggacggtaaccgaacgtaactaccggaacggtaacggtaccaacggtaccctataaggtaccgggaaactcgggaacggtacgtaccctacggtatacgtacgtacgggaaccgtaaccggtaaccggaccctttaaacgttaccttaacggtaccggacgtaacgggtaacgtaagttcggttttacggtaacggtaccgtaaccggtttcggttcccggttaggttaaccgttacggttaacccggtacggttccgggttacgggtcgggtaaccgg

SEQ ID NO: 30123 - DNA, 857 bp, Homo sapiens
  misc_feature: GYAE6OF02GT8VT.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctcctgctagtcgtcttcgtacggttactacttccttttacccgaaccgttacgggttattacggttaagtttgggttacggtaacggtaccgaccggggtaccccccggaaggggtaacgggggtcgtttaggtacgggttgggtaggtacggggtagttgggactaccggtaaccggttacccgttaaacggtaaaaccgtaaaacgaaggtaacggtaagtagggtaaaggtaacgtaacggttaccgggaacgggacgtaaggtacggtaccaacgttcgtaacgtaccgtacccggacgggtaaccaccgtaaccgtacccgaaacggtacgtaaacccggtaggtaccccttaaacgtacggtaaccgggaaaccgttagggaaccgggtaccgttacccgtacgaacgttaccgtacggtaaccggacccggttaaaccccggtacccgggtaaccctttaaacgtttaaacccgttccgggtacggaccggtaacgggtaagttaacggtttaactttaccggtaaccggtccgtttaaaccggtcggtttccgtaaccgggttaccgtttacgtaaccccggttacggtttccggtttaccgggtcgggtaaccccggg

SEQ ID NO: 30124 - DNA, 614 bp, Homo sapiens
  misc_feature: GYAE6OF02GY5GI.1.49.E05.1.454.CMB.1.raw
  modified_base (309)..(309): a, c, t, g, unknown or other
  misc_feature (309)..(309): n is a, c, g, or t
  modified_base (325)..(325): a, c, t, g, unknown or other
  misc_feature (325)..(325): n is a, c, g, or t
  modified_base (422)..(422): a, c, t, g, unknown or other
  misc_feature (422)..(422): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggaccctggagcatccttttcttggtggcagcagcaacaggtgcccactcccaggttcacctggtgcagtctggagctgagctgcagaagccgtggggcctcagtgagtggtctcctgcagtgcttcttggttacattcttttccaccgttacggtatgtaagttgttgagacgacggaccccggaggngggtcgttgaggtggngtgggatggatcgacgtacccgttaacggaactaaacgagagtagtaggagagtaacgtcgaggcgaaggtgtacagtctagtccgacgacgacacncgtacacgacgtacacgacctagacgtaggaacgtggtagacgcctgaacgtctcgtaacgaccgacggtaccgtccgtaactttagttacgtcgtacgggacgtaaggagttacgttagttccgaccgttacgttcggtacctcgggtacccttaggtaacccgtaggtaccgtttcgggtacggtaccgg

SEQ ID NO: 30125 - DNA, 632 bp, Homo sapiens
  misc_feature: GYAE6OF02GFH32.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtggggcctcagtgagtggtctcctgcagtgtcttctggttacacttccttttcccaccgtacggtatagtaagttggttgagaccgacgggcccccggaggcggggtcgttggacggtggagtgggatggtagtcgacgtcccgttaaggtaaactaaacgagtagtaagtggaagtaagtaagttacgacggacgaggtagtactagtacacgtccacggacgacacgtaacgccgaacgtacgtaacacgtaccctaagacgtacggactagaacggagtcctagagtctacgtcggaccgacgacccgtagtacctttattacgcgaccgagacgtagtaatttcgacgtgtaacgttcggtaccgtcgggttaccgtaccgttaacccgtaggtcgtttacggtacggtacccgg

SEQ ID NO: 30126 - DNA, 683 bp, Homo sapiens
  misc_feature: GYAE6OF02HPZRW.1.49.E05.1.454.CMB.1.raw
  modified_base (198)..(198): a, c, t, g, unknown or other
  misc_feature (198)..(198): n is a, c, g, or t
  modified_base (245)..(245): a, c, t, g, unknown or other
  misc_feature (245)..(245): n is a, c, g, or t
  modified_base (555)..(555): a, c, t, g, unknown or other
  misc_feature (555)..(555): n is a, c, g, or t
tcagacgagtgcgtcacgaccggtgctcgatttagagcgactagcaacacacaaaggggacccaaaaaccacacccctccttgggagaagtcccctagatcacagctcctcaccatggacgggacctggagcatccttttctggtggcagcagcaacaggtgcccactcccgaggttcaccgtggtgctagtctgganctgagctgcagacgccgtgggcctcgagtgagtggtcctccgtgacngtcgtcttcgtggttactactttccttttccaccttacggtattagtaagtttggttagagaccgacgggacccccggaggacggggtcttggacggttaggaggtgggtagtggagtccgacgtaccgttaacggaaactaaaacgaggtagtacgtggtaacgaagtacggtaccgtagggacaaggtagtactatacgtacgtacgaaccccggtagaacctaccgtaaccgtacccgaacggtacgttaccgaacgtacccttaacggaaggttaacggaacgttacgggacggaactcgtaacgngtacgtcgacggtaaccgacgaccgtacctaacgttaccttacgtacgaccggtacgaggtacttacgttagtcgacgttcggtacgttccgtacggtcttacgacgttaccgtgttggccgtaccgg

SEQ ID NO: 30127 - DNA, 616 bp, Homo sapiens
  misc_feature: GYAE6OF02JFP1C.1.49.E05.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
  modified_base (464)..(464): a, c, t, g, unknown or other
  misc_feature (464)..(464): n is a, c, g, or t
  modified_base (558)..(558): a, c, t, g, unknown or other
  misc_feature (558)..(558): n is a, c, g, or t
tcagacgagtgcgtcacgaccggtgctcgatttagagcgactagcaacgacgacaaaggggacccgaaaaaccacacccctccttgggagaatcccctagatcacagctcctcaccatggacgggacctggagcatcctttcttggtcggcagcagcaacaggtgcccactcccaggttcacctggtgcagtcgtgganctgagctgcagacgcgtgggcctnagtgatggtcctctgctaggntcttcgtggttacagtttctttaccgacctacggttactagtaatttggttacgagaccgtacgggaccccggtaggacggggtacttaggacggtaggaacgtgggtacgtaggtactcgtacgtaccgtaacgaaactaaacgagtataggagagacgtacgtcgaggcaacgagtcatacgactcgacgcacacgacacgtcgacgtcacgtccaancgtacgaagtagacggtacgcctaacgagtccgtacgtacgacctacgaccgtacgtaacgttactaccgtgacggtcgagtcgtacgtagtcncggtaacgtcgggtactacggacttagaaacccgtcggtaccgttgggtcgtaccggg

SEQ ID NO: 30128 - DNA, 886 bp, Homo sapiens
  misc_feature: GYAE6OF02JKWXZ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtgcccactcccaggttccacctggtgcagtctggagctgagctgcagaacgccgtggggcctcgagtgagtcggtctccgtgcgtgttcggtctttcgttaggttacctactttccttttacccaccgttacggttagtagtaacgtttgggtcggaacgacgtaccgggccccgggtaaagggtcgggggtcgttagggtacgggtagggtacgggttagggggtaggtacgtaccgtaaccggttaccccgggttaaaccggtaaaaccggttaaaaccgaaaggtaaggtaacggttagggaacgggtaacgtaacggttaccggtacgggacggacgtacggttacgtactacgtaacgacgtaccgggacggtaccaaccggtactacccgtaacggtacggtaaactacggtaccgttaaacgtaacggtaaccggtaacggtaagggttaacgggtaccggtaactccggttaacggtaccgtaggttaaccgacgggtaaacccgtaaccccgggtaccgtttaaccgttaacgttttaacccggtacgggttaccgaaccgggttaaccgggtaaacgttttacgtttaacgtttaccggttaaccggtaccggttttacgggtaacccggtttaggtaacccggtttaccccgttaaaccgggttcccggttccggttttaacggggttcccggggtaaccggtaaccccggggg

SEQ ID NO: 30129 - DNA, 903 bp, Homo sapiens
  misc_feature: GYAE6OF02GQIR3.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgacccactcccaggttcacctggtgcagtctggagctgagctgcagaagccgtggggcctcagtgatggtctcctgctagtcgtcttcgtaggttactacttccgttttccctaccgttacgggtattacggttaagttggtttacggaacgtaccgaccggggtcccccgggaagggtacgggggtacctttggaggttgggaacggtggggtaagtgggtaacgtaccgtacggtaccccgttaaacgggaaaacttaaaaacgtagggtaacggttaggtacgggaaggtaacggtaacggttaccgggaacggggtaccgtaaggtaccgttacgtaacgttaccgtaaaccgtacccggtaaccggacccgggtaaacctacccgttaaacgtccccggaaaccggttaacgtaaacccggaccggtaaacccttaccggtaaacggttaccgggtaaacgttacggggaaaccggtaacccgtacccgttaacggtaaccggtaccgttcccggttaacggggaaaccccgttacccggttaacccggggtaacccttaaacccggtttttaagtaccccggtagggtaaacccggacgggttaagttaccggttaacttttaaccggggtctaaccgttacccgggttaccgggttcccggtaacgggtttacccgttaaccgggttaccccggttaggtttccccgggggtttaggttcccggggtaacccgg

SEQ ID NO: 30130 - DNA, 616 bp, Homo sapiens
  misc_feature: GYAE6OF02IBTBE.1.49.E05.1.454.CMB.1.raw
  modified_base (255)..(255): a, c, t, g, unknown or other
  misc_feature (255)..(255): n is a, c, g, or t
  modified_base (402)..(402): a, c, t, g, unknown or other
  misc_feature (402)..(402): n is a, c, g, or t
tcagacgagtgcgtcacgaccggtgctcgatttagagcgactagcaacacacaaaggggacccaaaaaccacacccctccttgggagaatcccctagatcacagctcctcaccatggacaggacctggagcatccttttcttggtggcagcagcaacaggtgcccactcccaggttcacctggtgcagtctggagctgagctgcagaagcctggggcctcagtgagtggtctccgtgcagtgtcttcgtgttacntcctttccactacgtatgtaattggtgagacgacgggccccggaggacggggtctttaggaggtggagtggggattgggatcgacgtacccgttaaggaaactaaaacgagtagtagtaggagagtagtaccgaggacagagtacancactacgacgacgacacactaccgagtacgtaacacgtacctacagtacggaacgtggaacggcgacccgtacgaagttacgtcgtaccggaacgtacccgaccggtacctaacgtttaacttaccgacgtaccgaggaggtaactacgtttaagtcgccgtaacgttcgttaccgtcggtacttaccgtaacccgtcgttccgttggtacggg

SEQ ID NO: 30131 - DNA, 899 bp, Homo sapiens
  misc_feature: GYAE6OF02FMQIV.1.49.E05.1.454.CMB.1.raw
tcagacgagtgcgtcacgaccggtgctcgatttagagcgactagcaacaccaaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcgagtgatcggtcctccgtgcgagtggcctttcgtcggttacatttccttttcccgtacccgttacggttaagtacggttaagtttgggtttaggaacggtaaccgacccggggtacccccccgggggaaggtacggggggtccgtttgggacgggttagggtacggttagggggagttcggggtaacttaccggtaaccggtacccccggtttaaaccggggtaaaaacccgttaaaaaacggtagggtaaacggtttaacgtaaggggaaacggggtaacgggttaaaccggtttaccgggaacggggaaccggtacgggtaaacggttccgtaacgttaccgtaaacgttccccggaaccggaaccggggtaaccaaccgtaaccgtaaccccggtaaacgggaaccgttaaccggaaacgggtacccttaaacccggtaagtaacccggggttaaacgttacgggtaacgggtaaccggcccgttaacggaaacgttacgtttacccgacggtaaacccgggaccgtaaccgggtaacccctttaaccgtttaacgtttacccgtacggacccggttaaagggacgtagtaacggttttacgtcgtaccggttcgttaccggtccgttacgtccgttaacgtaaccggtaccggtcggttacgggtcgtacccggg

SEQ ID NO: 30132 - DNA, 805 bp, Homo sapiens
  misc_feature: GYAE6OF02FIEJV.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcacgtgctttactggttacatccttttaccacctacgggtatgtaacttcggttgagaccacgggcccccgtaggacggggctttgagttgggactgggattgggactacgacgaccccgtttacggaaaccttaaaaccgaggtaagttacgttacgggaaggaacggtaaacggtttcccgaaaggggtaccgtaacggggtaacgtttaccgaacgttccgtaacgttaccctaaccccggggtcggtaaacccgtaacccaacgttccccgaaaccggtaaacggttacccaacggtacccggtttaaaccaacttaacgggggtaaaccttcggtaaaccgggggttacgaccccttaagacgggttaaccttcggttaaccgaacgggtaaccccgaaccgggtaaccccttaaccgttttaaaccgttaaccctttacggggacccgtaccggtaacggtaggtaactttacgtttcggtacctaaacccggtttcgggttaccccgtagggttaccttaacggtaaccccgtaaccgtcgtttacgggttccgggggaaccc

SEQ ID NO: 30133 - DNA, 747 bp, Homo sapiens
  misc_feature: GYAE6OF02GA532.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtcgcccactcccaggttcacctggtgcagtctggagctgagctgcagaacgcctggggcctcagtgagtggtctcctgcagtgtcttctggttacacgttcctttccaccgtacggtatgtaacttggtagagtacgacggtaccccggagggtagggtccttggtacggtagggtacggtagggtagtagggacgtcgaccggtacccgttaacgggtaaacctaaaacgacgtaacggttaagtacgggaaacggtaacggtaacggttaccgaacggggtacgtaacggtaaacgtccgtaaacgtaccggtaccgttacccgaacccgggtaccggaaccgtaaccgtaccgttaacccggaacggtaaccggtaaaccgaccgtacccgttaaacgacggttaacgggaaccgttagggacggtaccggtaccgtacgtaacggtactcggtacgaacggtaccgaccggtacctaacgttcgtaacgtggacgtcggaagtatacgttacgtcgtaccgtaacgtcggttaccgtacgttcgttacccgtaccgttacggtttcggtcggtacggtcccggg

SEQ ID NO: 30134 - DNA, 738 bp, Homo sapiens
  misc_feature: GYAE6OF02ITU7B.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggatgggacctggagcatccttttcttggtggcagcagcaacaggtgcccactcccaggttcacctggtgacagtctggagctgagctgcagaacgccgtcggggcctcgaggtgatcggttctccgtgacagtgtcttcgtgttactattcgtttccaccgttacggtatgtaagttggtagacgacgacggcccccggtaggacggggtcgttagggaggtggtagtaggggtagtggtacgtacgtaccggtacccgttaaacggaaaccgtaaaacgaggaaggtagtaaggaggaggtaacgtcggacgggcaacggtagctaactccagtaccgaccgaaccggtaacaccgtaacgtaccgaaacggtaacgtaaccgacgtaccctaacgtaacggtacggtaaaccgtacgggaacgggtaccgtacccgtacaaacggtaccttaccgtacggtaacccgtaaccggaacccggtaccgttaaccgtttttaaacgtaccggttcggacgacgggtaagtaacgttaggttaactacggtaaccttaccggttaccggttccggtaccgtcgttaacccggtaacccgtaccggttcggttacgggtaccggg

SEQ ID NO: 30135 - DNA, 755 bp, Homo sapiens
  misc_feature: GYAE6OF02IIQRX.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatcggttctcctgcgagtcgtcgttcgtaggttacactttccttttacccaaccgttacggtacttagtaacgtttgggtgtaacgaacgaccgggaccccggaggacggggtcttaggaggtggagtcgggagtaggatcgacgtccgtaacggaaactaaacgagtaagtacgtaggagtaagtaacgttacgacgggacagtaacgtactaactacgacgtaccgaccggacgggaacctacctacctacccggaacgtaaccggtaacctagtaaccccgtacgaaccggtacgggtaaacggtaacggtacgggaacgtccgtaccgaagtaaccgttaccgtacggaaaccgggtacccgaccgggtaacccttaaccgtttaaaccgttccggtggaacgtaccggaaggttaacgaacgttttaggtacgtaccgttaaccggttgggtaccccgttagggtaccgttaccggttaaacccgtaccgggttccggttttaccgggggtaggtaaccccggggg

SEQ ID NO: 30136 - DNA, 761 bp, Homo sapiens
  misc_feature: GYAE6OF02GADQO.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctgtgcagtctggagctgagctgcagaagcctggggctcagtgatggtctcctgcagtgcttctggttacagtctttccacctacggtatgaactttggttgagtacacggcccccggtagagggggcttggagtggaagtggggatgggattacgagtacccctttaacgggaaaccttaaaaacgagtaaggtaactagggagtaagaacggtttacccgaaggggtactaaggtaagtacgaaacgttaccgtaacgtccgtaacccggacgggtaaacctaaccgaagtacccccgtaaacggtaacggttaaacccgaacgtacccgttactaacgtacgggtaaaacccgttaggaacggggaacgtaccccgttaacgaacggttaacgttaccgttaacgggaaccgtaacccgtaaacccggggtaccctaaaccggttttaactttaacccgtaggtaacccggtcgaaacggtagtaactttaaggtttcgaaccgtacggttaacggttcccgttagggtaccttacggttaaaaccccgaccggtactttaccgggtacgggtacccgg

SEQ ID NO: 30137 - DNA, 805 bp, Homo sapiens
  misc_feature: GYAE6OF02IGLJ4.1.49.E05.1.454.CMB.1.raw
  modified_base (200)..(200): a, c, t, g, unknown or other
  misc_feature (200)..(200): n is a, c, g, or t
tcagacgagtgcgtcacgaccggtgctcgatttagagcgactagcaacacacaaaggggacccaaaaaaccacaccccctccttgggagaatcccctagatcaacagctcctcaccatggacgggacctggagcattccttttcttggtggcagcagcaacaggtgcccactcccaggttccacctggtgcagtctgganctgagctgcagagtccgtgggcctgagtgagttggtcctccgtgcgtagtctcttcgtggttaacctgtttccttttacccgaccgttaacggtagttagtaagtttagggtagacggtaaccggtaccggggtaccccccgggtaaggggtacggggttaccgtttagggaagggtttacggggaggtggggtaaattcgggtaacttccggtaaccggttaccccgtttaaaacgggaaaaccttaaaacggaggtaacggttagagggtaacggaggtaaccgttaccgagggtacctaagggtacgtactagtaccgtaccgtaccgtaccgggaccgtaaccaccgtaaccgtacccgtaaccgaacggtcgtaaaccgaccgtaacgtaggtaaacggtaaccggttagggaaccggacctccgtaacgagtccgtaaccggtacggaaccgtaacccgccggtaaccttaaccgtttacgttaccgtacggacgtacggtaagacgtttaccgtttacgaaccggttaccgtcgttaccggttccgtacgtaacgttacccgtaaaccggtcttaccgggttggtaccggtacccggg

SEQ ID NO: 30138 - DNA, 714 bp, Homo sapiens
  misc_feature: GYAE6OF02GEES1.1.49.E05.1.454.CMB.1.raw
  modified_base (356)..(356): a, c, t, g, unknown or other
  misc_feature (356)..(356): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtggggcctcagtgagtggtcctccgtgcgtagtgtcttcgtggttactacttccttttacccaccttacggttactgtaatttggttagacgacgacgggccccggaggaggggtcttggaggtcggtaggtgggagtggacncgtacgtacccgttaacggaaacgtaaaacgagtaagtagtacggagtagtaacgttacgaggacgtaaggacgttacaagtacctaagtaccgacccggacgaaccaacgtaaccctaacgaacggtaactaaccgacgacccgtaagtacggtacgaaccgtaggaacggaaccacgtacgaagtattaccgacggaccgaaacgtacccggtacccttaacgtttacttacggtaccggtacgacgtaaggtacttaacgttacgtttcgaccgtttacgtccggggtttacccgtacggttccttaaacccggtaaaccccggtgtaaccggttttgggaccgggttaccccgg

SEQ ID NO: 30139 - DNA, 893 bp, Homo sapiens
  misc_feature: GYAE6OF02G4EFJ.1.49.E05.1.454.CMB.1.raw
  modified_base (587)..(587): a, c, t, g, unknown or other
  misc_feature (587)..(587): n is a, c, g, or t
tcagacgagtgcgtcacgaccggtgctcgatttagagcgactagcaacacacaaaggggacccaaaaaccacacccctccttgggagaactcccctagatcacagctcctcaccatggacgggacctggagcattccttttcttgggtggcagcagcaacaggtcgcccactcccaggttccacctggtcgcagtcgtaggagctagagctgacgaagacgccgtggggcctgaggtcgagttcggtcctcgtggctacggtcgtcttcgttaggttacctacgttttcctttaccccgaaccgtttacgggtaattacggttaagtttgggttagagtaccgggaccgggtaccccgggaagggacggggggttccttagggttaacgggtcggggtaaggtcggggtaggttacgggacgtaccggtaaccggttaacccggttaaaccggtaaaaccgtaaaacggtaaggtaagttacggtaacgggaaggttaaacggtaaccggtttaccgggaacgggtaacggtaacggtacttaaccgacgttaccgtaaaccgtccggaaccccgggtaggaaaccncccgtaaccgtaaccgtaaacggtaacgaaccgtaccgtaaccgtaagtaccgtaacggtaacggttaacgggagttaccggaccgttacgtaaacggtccgtaacccgttacggaaaccggtacccggtaaaccgtaccctttaacgttaccgtaccggtaccggacgttaacgggtacgaacggtttaccttttacgggcggttaccgttaacgggttccccgggtaaccggtttggttaccccgggttaaccgtttaccgggaaccgggtttcccggttagggggtaacccgggttcccgggg

SEQ ID NO: 30140 - DNA, 643 bp, Homo sapiens
  misc_feature: GYAE6OF02IDPR2.1.49.E05.1.454.CMB.1.raw
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtgcccactcccaggttccacctggtgcagtctggagctgagctgcagacgccgtgggcctgagtgatggtctctgcagtgcttcgtggttactattccttttaccaccgtagtatgtacgttggttgacgacgacggaccccggaggacgggtcgttaggaggttggagttgggagtaggtactacgtacgtaccgttaacggaacttaaacgagtagtataggagaaggacgtacgaggtacgacgagtacagtcactacgaccgacgacactacaccgacgacgtacacgacctaacgacgtacggaactaggagacgtaccgtacgacgtactcgtaccgaacggaccaaccggtaccttaacttaacgttaccgtggaaccgtacggtaagtacgtaactttacggtcgtaccgtacgttccggtacccttgggtacttacggtaacccttccggttacggttacgggtacggtacccgg

SEQ ID NO: 30141 - DNA, 679 bp, Homo sapiens
  misc_feature: GYAE6OF02GIZA8.1.49.E05.1.454.CMB.1.raw
  modified_base (671)..(671): a, c, t, g, unknown or other
  misc_feature (671)..(671): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgagtggtcctcctagcagtgtcttcgtggtacattctttccacgttacggtatgtaattggtagagtacgacgggtccccggaggtacggggtcgttggtaggtagggagtggggagttggatcgtacggtacccgttaacggaaacctaaaacgaggaacgtaggtaggtaacgtaaggtaaacggttaccggaacgggactaaggtaacgtacgtaatacgtactacccgacggacggtaaccacgtacgtacccgaaggtacgtaacgacgaccgttaacgacgttacggaacgttaggaacggtacgtacctagactactacgtaggaaccgtacgacccggtacgttactttaacgtaccgtacggacgacggtaagtacgtaactttgtacgtacgtaccgtgtacccgtgtacgtaccggtaacctcggtcgttacggnggtaccgg

SEQ ID NO: 30142 - DNA, 783 bp, Homo sapiens
  misc_feature: GYAE6OF02FMU93.1.49.E05.1.454.CMB.1.raw
  modified_base (318)..(318): a, c, t, g, unknown or other
  misc_feature (318)..(318): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatcggtcctcctgcagtcgcttcttcggtactcttcctttccacctggttatagtaagttggtgagacgccggacccggaggagggtctggnggtggagtgggataggtacgctacggtaccgttaacggaaactaaacgagtaagtacggtaggaagtaacgtaacggttaccggacgggaacgaggaacggtctaacgttaccgagtacccgaccggaccggaaaccgtacctaccggttaccccgaacgggtaacttaacccggacgtaccccgttaacggtaagtaccggggtaaacttagggaaaccgggaccgttccccgttaacggaacggtttacgttacccgggttaaacggaacccgggtaacccggtaaccgtaccccggttttaaaccttacgggttttaacccaccggggttccgtaccgggaaaggttacttaagtttacccggttcggaacctttacccgggtaccgggtttcccgtacggtacggtttaacccctaaacccgggtacggtttacccggtttcgggaccgggttaccccggg

SEQ ID NO: 30143 - DNA, 587 bp, Homo sapiens
  misc_feature: GYAE6OF02FSGX3.1.49.E05.1.454.CMB.1.raw
  modified_base (253)..(253): a, c, t, g, unknown or other
  misc_feature (253)..(253): n is a, c, g, or t
  modified_base (393)..(393): a, c, t, g, unknown or other
  misc_feature (393)..(393): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgtcttcgtggttacncttcttttcccacctacggtatgtaattggttgagacgacggcccccggaggacggggcttggaggtggagtgggagtggatcgacgtacccgttacggaaacgtaaaacagagtataggagagagtcgaggcagacgtnatcatcgaccgcgacacactaccacgacgtacacgcctaacgagtcggaacgtggacggacgccgtcgagactcgtacgacggacgaccggcctaacttacgttactcggcgtaccgagtagtacttgttacgacgttaccgtcggttccgtaggtactaccgtaaccgtacggtcgttacggtcggtacccgg

SEQ ID NO: 30144 - DNA, 694 bp, Homo sapiens
  misc_feature: GYAE6OF02F95PQ.1.49.E05.1.454.CMB.1.raw
  modified_base (253)..(253): a, c, t, g, unknown or other
  misc_feature (253)..(253): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggttacnttctttccactacggtatgtaattggttagagacgacgggcccccggaggaggggtcttggaggtggagtggggatgggatcgacgtacccgttaacggaaactaaaacgaggtagtagtagggaaggaaggtaacggttcccgaaggggacgtaagacgttacactcgaacgtccgaaccggacggaaccaactacgtacccgaacgaacggtaccgaacgtaccctaacgagtacgggtaaactggaacggacgtaccctagacgtaactcgtacgaaccggaaccgtaccgggtaaccctaacgtttaacgttaccgacggtaccgacggtaacgtacggttaattacgtttacggaccgttacggttacggttccgtacgggtaccttaaccggttaacccgtaccggttacggtttacgggtacgggtaaccccgg

SEQ ID NO: 30145 - DNA, 861 bp, Homo sapiens
  misc_feature: GYAE6OF02G2FVY.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtcgcccactcccaggttcacctggtgctagtctggagctggagctgacgagtaacgccgtggggcctcgagtgatcggtcctccgtgcgtagtcgtccttacgtaggttactactttcctttaccctaccgttaacgggttaacgttaaggttaacggtttcggttacggaacggtaacccggtaaccggggtacccccccggggtagggtaaacgggggttccgttaacgggtaacgggttggtaacgggttacgggtacgttagggtaccgttacccggtaacggtaacccgtttaaaccggaaaaacccgttaaaaacggtaccggtaaaggttacggttaacggggtaagggtaaaccggttaaccggggttacccggtaaaggggtaaccggtaacgggtaacgttaacccgtaacgtaccgtaaacggttacccgggaacccggtaaccgggaaaccctaacgtaaacccgttaccccgggtaaacggtaaaccggttaaccgaacggttaacccttaaacggtacggtaacgggtaaacgtacgggaaccgttacgaccgtacgagacgtacgtagaccgtaccgaaccgtacctacgttacgccgtacgcgagtacgacgttagttaccgtagtccgtaacgtccggcgttacgtcgttaaccgaccggttacgtcgttacgggaaggtcccgg

SEQ ID NO: 30146 - DNA, 672 bp, Homo sapiens
  misc_feature: GYAE6OF02G14AN.1.49.E05.1.454.CMB.1.raw
  modified_base (335)..(335): a, c, t, g, unknown or other
  misc_feature (335)..(335): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacgaggtgcccactcccaggttcacctggtgcagtctggagctgagctgcagaagccgtggggcctcagtgatggtctccgtgcagtgcttcgtggttacattctttccacctacggtatgtaattggtgagacgacggccccggagacggggtcttaggaggtgggtagtgggagtggntacgacgtacccgttaacggaaactaaaaccgagtaaggttaacgtgggaagtaggtaacggttacggaacgggacgaaggtaacggtctaaacgttctaacgtccgaacccggaccgaacaaccgtactaacccgaaccgaaggtaaccgacgtacccgtaacgtacggtacgaacgtaggaacggacgtacctacgaagtaccgacgttacggaaccgtaaccgaccggtaccttacgtttacgtacctcgaacggtacgagtagtacgtttagtgtaccgtagtccggttaccgtggtcttacggaaccgtacggtccgttaggtccggtacgg

SEQ ID NO: 30147 - DNA, 675 bp, Homo sapiens
  misc_feature: GYAE6OF02GRBZI.1.49.E05.1.454.CMB.1.raw
  modified_base (241)..(241): a, c, t, g, unknown or other
  misc_feature (241)..(241): n is a, c, g, or t
  modified_base (373)..(373): a, c, t, g, unknown or other
  misc_feature (373)..(373): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattcctttttcttggtggcagcagcaacaggtgacccactcccaggttcacctggtgcagtctggagctgagctgcagagccgtgggcctcgagtgagttcggtctccgngcagtgtcttcgtggtactattccttttccacgttacgtatgtaagttggttgagaccgacggccccggaggacggggtcttggagtggagttgggatggataccgacgtaccgttaacggaaactaaacgngtacgtagtaggaagtagtaacgttacgaggacaggtacgtacactagacgtccgaccggacggaactacgacgtacccgaacgtacgtaacgacgtacctacgtaacgtacggtaaagtcgaacggtacgtccgtaacgtatacgtacgtacggaacgtacccgtaccgtaaccgtaacctttaacttacgtcggacgtaacggaagtacgtttaaacttacggttcgaacgttaccggttcgtaaccgtttccggtacgttaaccgtaaccgtacgtttcgggttaggtaccggtaccgg

SEQ ID NO: 30148 - DNA, 750 bp, Homo sapiens
  misc_feature: GYAE6OF02I8N47.1.49.E05.1.454.CMB.1.raw
  modified_base (196)..(196): a, c, t, g, unknown or other
  misc_feature (196)..(196): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccacctcccaggttcacctggtgcagtctgganctgagctgcagagcctgggcctcgagtgatggtctcctgcagtgtcttcgtggtactagttctttccacgtacggtatagtagttggttgagaccgtacgggccccggaggacggggtcgttagtcggtaggaggtgggtacgtaggtactacgacggtacccgttaacgggtaaacctaaacggtaagtaacggttagtaacgggaaggtaacggtaacggttaccggaacgggtacgtaacggtacgtaacctaacgtcgtacgttaccggaacccggcgggtaaacctacccggtacgtaacccgacggtaaagtaccgaaccgtacccgtaaacgtaccgtaaggggtaacccttagggaaccgtaccggtccctacggtaacgacgtacgtaccggaccgtaccgtaacccgtaccgttaattaccgttaccggtagcccggaagtacggtactttaacggttagttacgaacgtccggtttaacggtccgtttacggtacggttaccctaaccgggaccgtttaggtttcgggacccgggttaacggg

SEQ ID NO: 30149 - DNA, 604 bp, Homo sapiens
  misc_feature: GYAE6OF02H3PV9.1.49.E05.1.454.CMB.1.raw
  modified_base (196)..(196): a, c, t, g, unknown or other
  misc_feature (196)..(196): n is a, c, g, or t
  modified_base (399)..(399): a, c, t, g, unknown or other
  misc_feature (399)..(399): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaaacaggtgcccactcccaggttcacctggtgcagtctgganctgagctgcagaagcctggggcctcagtgatggtctcctgcagtgcttctggttactatcttttccacctacggtatgaattggttgagacacggcccccggagacggggtcttggacggtggacgtggggactggatcgacgcccgttaggaaacctaaacagacgtatcgggaagtaagaacgttccgaggacgagtagtnaactcaacgtcaacccgacgggtaccacatacccgaacgtagtaaccacgacctacgagtggaactagaggacgctacagattctacgacgacgacggacccaacgtttactaacgtcggcgaccgtaagacgttaattagtaccgacgtacgtcggtaccgtaggtcgttacgtaaccgaccggttattcggtacgggtaccgg

SEQ ID NO: 30150 - DNA, 857 bp, Homo sapiens
  misc_feature: GYAE6OF02I9PXE.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatgggacggacctggagcatccttttctggtggcagcagctaacaggtcgcccactcccaggttcacctggtgcagtcgtggagctgacgctgcagaacggccgtggggcctcgaggtgacgttggtctcgtagcagttcgtcttacgtcggttactactttccgtttacccgaccgttacggtattacggtaacgtttcgggtacgtacggaaccggttacccggggacccccgggtaagggttacggggttaccgttagggtaacgggttacgggtaacgggttcggggtaaacgtcgggtaaccgttaccggtaacgggttaaccccggtttaaaccgggtaaaaccgtaaaaccggagggtttaacgtaaccgggtaaggggtaaacgttaaacgggtaaccggtttaacccgggaaggggtaccgtaacgggtaacgtaccgtaacggtacaacccggttaccgaacccggtacgtaaccgtacgtaaccgtacgaacggtactaacggacctacgtaacggtacgtacggtaaacgtcgggaaacgtacgtccgtaacgtacgtaaccgtaccgttaacgggaacctacccggtaaccgttaccttaacggttaacgttacccggaggtacccgtaagaaccgtttagttaacgttacggtacgtaccgtaacgttccggaacgtttacgaacccggttacgtaacccgttcggtcggtttacggaccggtaccgggg

SEQ ID NO: 30151 - DNA, 678 bp, Homo sapiens
  misc_feature: GYAE6OF02FY8OC.1.49.E05.1.454.CMB.1.raw
  modified_base (258)..(258): a, c, t, g, unknown or other
  misc_feature (258)..(258): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggggcctcgagtcgatggtctcctgcagtgtcttctggttactnttcctttccaccgtacggtagtggtagttcggttagagtaccgacgggtcccccggtaggagggggtcttggaagttcgggtaagtggggagtgggatcgtacgtccccgttaaccggaaacttaaaaccgaggtaaggtaacgtaggggtaacgaaggtaacggttaccgaggggtaccaggacgtacctagtaccaacgttccggaccggccggaacctaacgactacccgaaccggtacgtaaccacggtacccttacgaagtacgggtaacctggaacggtacgccgtacagtacgtactacgacgtaccgaccggacctacgtttataccggacgcgtaacgagtacgtattagttcgacctacggttcggtcctgggtactaccggtaaccgtcgtcctttagggacgtcccgg

SEQ ID NO: 30152 - DNA, 607 bp, Homo sapiens
  misc_feature: GYAE6OF02F4LDQ.1.49.E05.1.454.CMB.1.raw
  modified_base (392)..(392): a, c, t, g, unknown or other
  misc_feature (392)..(392): n is a, c, g, or t
  modified_base (421)..(421): a, c, t, g, unknown or other
  misc_feature (421)..(421): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgagtggtctcctgcagtgtcttcgtggttactattctttccacctacggtactgtaatttggttgagtacgacggcccccggaggaggggtcgttggaggtggagtgggtagtgggtatcgtacgtacccgttaaggaactaaacagagtagaggagagagtcgaggnagagtcatcacgtacaccggacgacacanacccgaacgtacgtacgacgtacctaaccgagtaacggtacgtagacgggacgtcccgacgacgtactacgtagaccgaccgaccggccttacttacttacgcgtcgacgtacgagtattacgtcgacgtacgtcggttccgtcggtacttacgtaaccggtacgttcgttacggtcggtacccgg

SEQ ID NO: 30153 - DNA, 735 bp, Homo sapiens
  misc_feature: GYAE6OF02F7VUK.1.49.E05.1.454.CMB.1.raw
tcagacgagtgcgtcacgaccggtgctcgatttagagcgactagcaacacacaaagggacccaaaaaccacacccctccttgggagaatcccctagatcacagctcctcaccatggacgggacctggagcatccttttcttggtgcagcagcaacaggtcgcccactcccaggttccacctggtgcagtcgtggagcgtgagctgcgagaagccgtcggggcctcgagtgattggtcctccgtgctagtcgtccttagtggttacctattcccttttacctaccgttaacggttagttacgtaaggtttggttaggtacgtaccgaccggggtcccccgggaaggtacgggggtcgttggacggttagggtacgttggggagttggtacctcgtaccggtaacccgttaacgggaaaactaaaacgaggtagtaacggtaggtaaggtaacggtaaggttaccggagggacgtaggacgttacgacttagaccgttacaccgggtacgacgtaacgtactaccggaacggtacgtaccgacgtaccgtaacgagttacgggaaccgtaggaccgtacgtacccgtaacagacgttacgaacggacgtaccggaccgtacgtaaccgtttagtaccgtcggtaacggaccgaggtataaccgttagttccggtactaccggttcggtaccttagggactaccgttaaccgttcggtacgtttggaccggttaccgg

SEQ ID NO: 30154 - DNA, 670 bp, Homo sapiens
  misc_feature: GYAE6OF02FHYEO.1.49.E05.1.454.CMB.1.raw
  modified_base (526)..(526): a, c, t, g, unknown or other
  misc_feature (526)..(526): n is a, c, g, or t
tcagacgagtgcgtcacgaccggtgctcgatttagagcgactagcaacacacgaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcgagaacgccgtggggcctcgagtgatcggtctcctgcagtgtcttcgtaggttactacttcctttacccaccttacggttatacgtagttggtcgacgtacgaccgggccccgaggacggggtgttagcgtaggtacgtggagtcgggactccgacgtacccgttaacggaaacgtaaacgagtacgtagtaggagaacgtacggttccgaagggctagacgtactacgtactacgtcgaccgcgaaccaacgtactaccgaacgtacgtacgacgtacctaagaactacggaacgtcggtagacgtacccgtgaacggtntaccggacgaccggacgtaaccggtaacctacttacgtacgtacggacgtacgtaggtactacgttacgtacggacctacggttcggtcccgttacggtacgtacgtaacccgtcggttccggttagggtacccggtaaccggg

SEQ ID NO: 30155 - DNA, 635 bp, Homo sapiens
  misc_feature: GYAE6OF02FZLOH.1.49.E05.1.454.CMB.1.raw
  modified_base (373)..(373): a, c, t, g, unknown or other
  misc_feature (373)..(373): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggttactattctttccaccgtacggtatagtaagttgttgagacgacggcccccggagagggtctggtagtggagtggggtatggactcgacgtacccgttaacggaaactaaaacgagtaagtagngggaagaggtaagttccgagggacaagacgtactagtctataccgaccggacggacacctactccgaacgtacgtaacgacgtaccctacgacgtacggaacgtggaacgacgaccctagtagacttacgtacggacgaccgtaccgtactactttaacgtaacgtcgtacggaccgtagtagtaactttagtcggtactacgttcgttaccggtgttacgtaccggttaacccgtacgttccggtttagggcggtaaccgg

SEQ ID NO: 30156 - DNA, 785 bp, Homo sapiens
  misc_feature: GYAE6OF02GO61P.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatgggacgggacctggagcattccttttcttggtggcagcagcaacaggtgcccactcccaggttcacctggtgcagtcgtggagctgagctgcagagcgtagggctcgagtgagtcgtctcctgctagtcgtctttcgtaggttactacgttccttttacccaccgttacggtatagtaaggtttcggttagaacggacgtacccgggacccccggggagggtagggggtcgttagggacggtggtagggtgggtagtaggtaacttccgaacggttacccctaaacgggtaaaactaaaacgaggtaaacgtacggtaggtaacggtaacggtaacggttacccggaagggtaccgtaagggaacttaccgaagttacccgaccgttaaccccggaaccgggtaaccgggtaaccgtaaaccgtacccgttaaccggaaccggtaacgtaaccgtacggtacccgttaaagtacgtaacgggtaacgtagggaacgtaaccgtaccgtacgacgtactacggtacgaaccggacgtacgtacccttacgttactaccggtaggtaccggacgagtaacggttcgttaggtaaccgtaccggtaacgttccggtacggtacggttacgtaaccgttacccggtaccggttcgttacgggtaccggtacggg

SEQ ID NO: 30157 - DNA, 1186 bp, Homo sapiens
  misc_feature: GYAE6OF02HL9K5.1.49.E05.1.454.CMB.1.raw
tcagacgagtgcgtcacgaccggtgctcgatttagagcgactagcaacacaccaaggtggacccaaaaaccacacccctccttgggagaatcccctagatcacagctcctcaccatggacggacctggagcatccttttcttggtggcagcagcaacaggtgcccactccaggttcacctggtagcagtctggagctgacgctgacagaacggtccgtggggtcctcgtacggtgtacgtcgggttcctaccgtcggcgtaaggttcgttccgtttacggttcggttttacctacgttttccgtttttaccccgtaacccgtttaccgggttagttacggttaaaggttttcgggttaacgggaaccggttaacccgggaacccccgggggtaccccccggggtaaggggggtaaccggggggttttaaccggttttaggggtaagggtttacggggtaacgggttggggggtaaccggtttaacgggtaccggtaccggttaaccccggtttaaaccccccgggttttaaaaccgggggaaaaaacccttaaaaaaaaccggggtacggtttaaacggggtttaaagggtaaccggggggtaaaaagggttaaccggggtttaaaaccggtttaaccccggggttaagggggaaaccgtaaaacgggtttaaacggttaccctaaacggttaacccgtaacccggtttaaccggaaaccccgggttacccggaaaccccggaaacccgttaaacccccgttaacccgggaaacccggttaacccgttaaacccggaaacctttaaccccccggtaaaggttaaccgttaaacccggggttaaacccggtaacggggtaccggtaaacccggttaccccgtaacggtaaacggtttacccgttaacccggttaacccggggaaacccgtaccccccgggggtaaaactttcccggttaaaaccgtttttaaaacggtaccccggttacccggtaacccggggtaaccggttaaaccgggttaagttttaaccgggttttaaccgtaccccggggtttaaccggttaacccgggtttaccccggggttaaccgtttaccgggggtttaaaaccccggtttaccggtttaaaccccccgggggttaacccgggtttaggggtttaccccgggttttaccccggggggg

SEQ ID NO: 30158 - DNA, 631 bp, Homo sapiens
  misc_feature: GYAE6OF02H4NX3.1.49.E05.1.454.CMB.1.raw
  modified_base (548)..(548): a, c, t, g, unknown or other
  misc_feature (548)..(548): n is a, c, g, or t
tcagacgagtgcgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtgcccactcccaggttcacctggtgcagtctggagctggagctgcagaagcctggggcctcagtgatggtctcctgcagtgcttctggttacattcttttccacctacggtatgaattggttgtagacagggcccccggagacgggggcttggaggtggagtgggatgggatcgagtacccgttacggaaactaaaacgagtagtacgtaggacgtaggaacgttaccgtaagggcgaaggagtcgacgttacaacttcgaacccgtcgggaacaccgaacgttccaacggtaacgaaccgacgtacccgtaacagttaggaaccttggaacggtacgccgttacagacgtcgtaggacggacgtaccggaccgtactttaacgttacnggtccgacgagagtacgtttagttgtacctacgttcggtcctcggtcttacgaaaccgtacggtacctttcgggtcggtacgg

SEQ ID NO: 30159 - DNA, 660 bp, Homo sapiens
  misc_feature: GYAE6OF02GIJYO.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactccccaggttcacctggtgcagtctggagctgagctgcagaacgccgtgggcctcgagtgagtcggtctcctgcagtgtctttcgtggttactactttccttttaccgaccgttacggttacgttagttaagttggttagacggtaccgaccgggccccggaggacggggtcgttggaggtggagtgggagtggactcgacgtacccgttaacggaaactaaacgaggtagtagtaggtaagtaagtaacgttcgaaggcgaagtagtacgagtacacgtaccgaccggaccggactaaccacgtaccgaacgtaacgtaaccacgtaacctaacgagtacgggaactggaacggacgtacagacgtacgtcgaacggaccgaccgtaccggtaccttacgtttacgtcgtacgacgaggtagtagttattacggtgtaccttacgtccggtacgtgtacgtacgtaccgtacgttcggttcggtggacccgg

SEQ ID NO: 30160 - DNA, 778 bp, Homo sapiens
  misc_feature: GYAE6OF02H1M3M.1.49.E05.1.454.CMB.1.raw
  modified_base (687)..(687): a, c, t, g, unknown or other
  misc_feature (687)..(687): n is a, c, g, or t
tcagacgagtgcgtcacgaccggtgctcgatttagagcgactagcaacacacaaaggggacccaaaaaccacacccctccttgggagaatcccctagatcacagctcctcacccatggacgggacctggagcatccttttcttggtggcagcagcaacaggtgcccactcccaggttcacctggtgcagtctggagctggagctggcaagaaggcccgtggggcctcagtgagtcggtctcgtgcgtagtcgtcgttccgtggttactagttccttttacccgaccgttacggtacttagtaaggttggttagagtaccggacggacccccgggtaaggtacgggtcgttaggtaggtacgggtaagtgggtagtacggtaacgttaccggaaccgtacccgtttaaaccggaaaactaaaaacgaggtaagtaacgtagggtaagtaaaggtaacgtaccggaggtacgaaggtacgtagaactcgtaacgccgaaccggtaccgaacgtaactaccgtaccgaacgtaacgtacgtaacgtaccctaagtacgtaacgaacgtaggtaacgacgtaccgtacgaacgtacgtacgttaacggaaccgaccgaacccgtaacccttaaccgtttaattaccgggtacaacccgggtaacgtaaggtaaccgttaagttttaaccgnggttaaccgtacgttccggttacccgttaacgggtccgttaacggttaaaccggaacccggttttacggtacggttaccgggtaccccggg

SEQ ID NO: 30161 - DNA, 573 bp, Homo sapiens
  misc_feature: GYAE6OF02G2QH7.1.49.E05.1.454.CMB.1.raw
  modified_base (440)..(440): a, c, t, g, unknown or other
  misc_feature (440)..(440): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctgagctgagctgcagaagcctggggcctcagtgatggtctcctgcagtgcttcgtggttacatcttttccacctacggtatgtaattggtgtagacgaggcccccggagagggggcttggagtggatgggatggatcgagcccttacggaacctaaaacgagagtatggaagagaagtcgaggcagagtcatcatccacgcggacacactaccacgagtacagcctacatcgaactggagacgcctaganactcacgtacgacaaccggcctaacgttacttaccgtgtaccggagaacggtagtaatttagtcgtactaccgtgggttcccgtagggtaccgttcggtaaaccctacggtcggtttaggtccgggtaaccgg

SEQ ID NO: 30162 - DNA, 710 bp, Homo sapiens
  misc_feature: GYAE6OF02HZESB.1.49.E05.1.454.CMB.1.raw
tcagacgagtgcgtcacgaccggtgctcgatttagagcgactagcaacacacaaaggggacccaaaaaccacacccctcttgggagaatcccctagatcacagctcctcaccatggacggacctggagcatccttttcttggtggcagcagcaacaggtgcccactcccaggttcaccgtggtgcagtctggagctgagctgcagaacgccgtagggcctgagtgagtggtcctccgtgctagtcgtcttacgtcggttactagtttccttttcccgaaccgttacggtacgtagtagtttggttagacgtaccgaccgggaccccggaggtacgggtcttaggtaggtggtaggtagggagtggtacgtacgtaccggtacccgttaacggtaaaactaaaacgtagtaagtaaggtggtaacggtaagtaacggttaccggaaggtacgtaaggtacgtacgtacgtacgtactaccggaccggaccggaacacgtaactacccgaacgtacggtacaccggtacctacgtacgtaaggtaactagggacgtacgtacctacgacgtacgtacgtacggaaccggaccgacggtacctacgttacgttcgacggaccgtaacgacgttagtaccttagtacgtcccggtagttccggtacgtccggtacttacggtacccgtacgttacggttccggtaggtacccgg

SEQ ID NO: 30163 - DNA, 655 bp, Homo sapiens
  misc_feature: GYAE6OF02HGM08.1.49.E05.1.454.CMB.1.raw
  modified_base (335)..(335): a, c, t, g, unknown or other
  misc_feature (335)..(335): n is a, c, g, or t
  modified_base (433)..(433): a, c, t, g, unknown or other
  misc_feature (433)..(433): n is a, c, g, or t
  modified_base (455)..(455): a, c, t, g, unknown or other
  misc_feature (455)..(455): n is a, c, g, or t
  modified_base (469)..(469): a, c, t, g, unknown or other
  misc_feature (469)..(469): n is a, c, g, or t
  modified_base (497)..(497): a, c, t, g, unknown or other
  misc_feature (497)..(497): n is a, c, g, or t
tcagacgagtgcgtcacgaccggtgctcgattttagagcgactagcaacgaacacaaaagggggacccaaaaaaccacacccctccttgggagaatccctagatcacagctcctcaccatggacgggacctggagcatccttttcttggtggcagcagcaacaggtcgcccactcccaggttccaacctggtcgcagtctggagctgagctgcagaagccgtcgggcctacgagtgacgtcggtctcgtgctaggtcgtcttcgttagttactactttcctttaccgacgtaggtatagttagttcgtgacgacgccggacccggaggtcgggtntggacgtggtacggtggtcggtggactcgtaacggtacccgttaacggaaaactaacgagtagtagaggagtacgaacgtcgaggacgagtctagacnctacgaccgacgacgactcacncgaacgacgtaccngtcctagacgtagagcggactcgacctnacgtcgacgtacgaccgtacgaaccgtcgttaacgttacgtttaacggcggtaaaccagggtaagttacgttcgtttaacgtcgtaaccggtttcgtcggttacggtaccggttaccgttaccgtacgcggttttaccggtacgggtcgtaacccggg

SEQ ID NO: 30164 - DNA, 613 bp, Homo sapiens
  misc_feature: GYAE6OF02IZN0O.1.49.E05.1.454.CMB.1.raw
  modified_base (361)..(361): a, c, t, g, unknown or other
  misc_feature (361)..(361): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcgagtgatggtctcctgcagtgcttcgtggttacattcttttccaccttacggtattgtaatttggttgagacgtacgggcccccggaggaggggcttggaggtggagtgggatggatcacgtcccttaaggaactaaaacgngagtacgtaggagaagtacgttcgagggcaggtagtctagtcaacgtccaaccgtcggacacgtacgtaccgaacgtacgtacacgtaccctacacgtacggaatcggagacgtaccgctagtacgtcctaggaccgtacgaaccggtcctaacgtttacttacgtcggtcgacgaggacttagttacgttcaccgttcgtacggtccgtggtaccttacgtaacccgaggttcgtttcgggacggtaccgg

SEQ ID NO: 30165 - DNA, 791 bp, Homo sapiens
  misc_feature: GYAE6OF02IQACM.1.49.E05.1.454.CMB.1.raw
  modified_base (695)..(695): a, c, t, g, unknown or other
  misc_feature (695)..(695): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcacgcaacaggtgcccacctcccaggttccacctggtgcagtcgtggagctgagctgcaacgaagcccgtggggcctgagtggtagttcggtccttccgtcgaccgtaggttcgtacgttaccgttacggttaactacgttttccttttacccaccgtttaacggttagtacggttaagtttggttacgacgtaccgaccgggtacccccgggaggtacggggtcgttggaggtggtacggttagggagttcggactacgtaaccgtacccggttaaacggaaactaaaacgtaggagttaggtacggacgaaaggtacggttaccgacgggtacgtaacggtaggtacctaacgttaccgaacgttacccggaaccgtacgggaaaccctacctaacgacccgtaaaggtaacgtactaccgtactacgtaagtacggtaacctaggaacgtcccggacttacggacgttacgtacgtaccgggtaaccgtaaccggtacccgtaaccttaaccgtttaaccgttaaccgtcgggtaaaccggngtaaacggacggttaacttttaccggagttaccgttacgtccgttacggacgttacgttaccgtaaccgttccggtgttaccgtcgggtaacccgg

SEQ ID NO: 30166 - DNA, 647 bp, Homo sapiens
  misc_feature: GYAE6OF02G4FZW.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctcctgcagtgcttcgtggttacattctttccacctacggtatgtaattggttgagtacacggccccggaggagggtcttggagtggagtgggatggacttcgacgtcccgttaaacggaaacctaaaacgagaacggttaactaggggaagaaggtaacgttccggaagggaccgtaaggacgtacaatacgtaacgtccgaacccggtacggaccacgactaccgaacgtacgtacacgaccctagagtacggaacgtaggaacggtacgtccgtacgacgtacgtacgtacggaaccgacgaccggacctaacctttattaccgtgaccgacggtagtacgtagttacgtcgaccttaggtcgtccgttacggtaccgttaccggtaccgtacggtcgtttcggtcggtacccgg

SEQ ID NO: 30167 - DNA, 806 bp, Homo sapiens
  misc_feature: GYAE6OF02HMI3H.1.49.E05.1.454.CMB.1.raw
  modified_base (193)..(193): a, c, t, g, unknown or other
  misc_feature (193)..(193): n is a, c, g, or t
tcagacgagtgcgtcacgaccggtgctcgatttagagcgactagcaacaccaaggtggacccaaaaaccacacccctccttgggagaatccctagatcacagctcctcaccatggacgggacctggagcatccttttcttggtggcagcagcaacaggtgcccactccaggttcacctggtgcagtcgtaggngctgagctgcagagcctggggcctcagtgattcggtctaccgtgacagtcgcttcgtggttactacttcctttaccaccttaggtatgtaacgttggtagacgacgtaccgggccccggagggtacggggtcgttaggaggttcggacgttcgggagttggaacgtcgtaacggtcccgttaaacggaaccgttaaaacgaggtacggttaacgtagggaacggtaacggtaaacggttccggaacgggtacgtaacgggaagttacgacttaccgtacgtaaccggtaccgggtaccggaaccgttaccgaaccgtttaccccggaaaggtaccgttaaaccggtaccggtaaccgtaacggaaccgtttacggggaaaccgttagggaacgggtaaaccgtcccgtaaggtaacgtacgttaccggaccggtaacgggtaacccgaaccggttaccgttaaccgttttaccgttaccggtaccgggtccgtaaccggtaacggtacgttaccggtttaacgtaccgggttaccttcggttaccgggttacccgtacggtcggttaacccggtacgtaccgggtttacttaccgggggttaggtacccgggg

SEQ ID NO: 30168 - DNA, 602 bp, Homo sapiens
  misc_feature: GYAE6OF02GSIVZ.1.49.E05.1.454.CMB.1.raw
  modified_base (221)..(221): a, c, t, g, unknown or other
  misc_feature (221)..(221): n is a, c, g, or t
  modified_base (284)..(284): a, c, t, g, unknown or other
  misc_feature (284)..(284): n is a, c, g, or t
  modified_base (441)..(441): a, c, t, g, unknown or other
  misc_feature (441)..(441): n is a, c, g, or t
  modified_base (500)..(500): a, c, t, g, unknown or other
  misc_feature (500)..(500): n is a, c, g, or t
  modified_base (509)..(509): a, c, t, g, unknown or other
  misc_feature (509)..(509): n is a, c, g, or t
  modified_base (522)..(522): a, c, t, g, unknown or other
  misc_feature (522)..(522): n is a, c, g, or t
  modified_base (558)..(558): a, c, t, g, unknown or other
  misc_feature (558)..(558): n is a, c, g, or t
  modified_base (579)..(579): a, c, t, g, unknown or other
  misc_feature (579)..(579): n is a, c, g, or t
tcagacgagtgcgtcacgaccggtgctcgatttagagcgactagcaacgacgacaaaggggacccaaaaaccacaccctccttgggagaatcccctagatcacagctcctcaccatggacgggacctggagcatccttttcttggtggcagcagcaacaggtgcccactcccaggttcacctggtgcagtctggagctgagctgcagaagcctggggcctnagtgagtggtctcgtgcagtgcttctggttacagttctttaccgactacggtatcgattggtnacgacgtacggccccggagaggggtcttggacgtggaagtgggaatgggatccgaggtaccccgttaaggaaacctaaaacgaggtaggtaacgtagggtaacgtaaggtaagttaccgagggtacgaagaggttcaacgtacgacgttcaacccgnggtaaccagtacacgacgaaggtaccacgtactaacagtacggaacttgggacacgccnctaggtacncgtagaaccgtanacccgtactacgttagtaccctagccgtacgagtanactttagcgacgtgacgttcnggactacgacgctgtgcgtaccg

SEQ ID NO: 30169 - DNA, 864 bp, Homo sapiens
  misc_feature: GYAE6OF02F6G8T.1.49.E05.1.454.CMB.1.raw
  modified_base (160)..(160): a, c, t, g, unknown or other
  misc_feature (160)..(160): n is a, c, g, or t
  modified_base (533)..(533): a, c, t, g, unknown or other
  misc_feature (533)..(533): n is a, c, g, or t
tcagacgagtgcgtcacgaccggtgctcgatttagagcgactagcaacacacaaagggggacccaaaaaccacacccctccttgggagaatcccctagatcacacgctcctcaccatggacgggacctggagcatccttttcttggtggcagcagcaacnggtcgcccactcccgagggttccaccgttggtgccgagtccgtaggacgtcgttggacgcttggccaaggaacgtccggtggggccctcgaagttcggagtcggtcctaccgtggtacctggtcgtccttacgtcggttaaccgtacttcgtttaccgaccgtacggttacgacgttaagtttgggttacgacgtacgtaccgggaccccgggaaggtacgggggtacttcgggtaacggtaccgggtagtcggggtaacgtacggtacgtaccggaacggtcccccggtttaaagggaaaaccgttaaaaaccggtggttaaaccgggtaaaggttacggggaaacggtaacggttacggtttaaaaccggnggggtaacgaaacggggtaactttcggaaagttcccgtaaacggttcccggaaccgggttacggaccgttaaacgaaccttaccgggtaaacgtaacggtaacccggtaacgaccgttaacgtacgtaacggtaaaccggtggtaacggtacgtacccgtacggtaacttacgtacccgttacgaccgtaaccgtaccggttacctacgtttaacgtccgtacgaccgaaggttaaccgtagtaacggtttacgacggtaacctacggtaccggttaccggttcgacggtacgttaaccgtaccggtacggtttacggccggttaaccggg

SEQ ID NO: 30170 - DNA, 593 bp, Homo sapiens
  misc_feature: GYAE6OF02GL69T.1.49.E05.1.454.CMB.1.raw
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
  modified_base (567)..(567): a, c, t, g, unknown or other
  misc_feature (567)..(567): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatctttccactacggtatgtaattggttgagacgtacggcccccggagagggggtcttggaggtggagtgggatggatcacgcccgttaggaactaaacgagagtataggagaagaacgttaccgagggacgaggagtcatcactaccgaccgacggacacactaccgacgagtacagcctaacatacggataggaggancccgtanagtactcgtacgaacgaccgaccgacctaactttacgtactggaccgtagaacgtagtaattacgttcggactaaccgtcggttacgtcggtaccttacggttaaacccncggtaccgtttgggtccggtaaccgg

SEQ ID NO: 30171 - DNA, 617 bp, Homo sapiens
  misc_feature: GYAE6OF02HEPDN.1.49.E05.1.454.CMB.1.raw
  modified_base (368)..(368): a, c, t, g, unknown or other
  misc_feature (368)..(368): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgagtggtcctcctagctaggtgtcttcgtggttacatccttttccacctacggtatgaattgttgagacacggcccccggagaggggtctgagtggagtgggagtggatcgacgtacccgttaacggaacgtaaacagagtagngggaagagaacgttcgacggacagacgtcatcatccgaccgacggacacgacgtaccgacgaagtacgacgcctaagagtacgaacgtggaagggacgccctagacgtatacgtagaaccggacgaccgggtaccttaacgttaacgttacgtacggaccgtacggtacgagtaacttagttcggacctacggtcggtcccgtacggtacttacggtaaccctacggttcgttacgggccggtacccgg

SEQ ID NO: 30172 - DNA, 615 bp, Homo sapiens
  misc_feature: GYAE6OF02GPU4C.1.49.E05.1.454.CMB.1.raw
  modified_base (377)..(377): a, c, t, g, unknown or other
  misc_feature (377)..(377): n is a, c, g, or t
  modified_base (608)..(608): a, c, t, g, unknown or other
  misc_feature (608)..(608): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagccgtggggcctcgagtgacgtggtcctcctgacagtgcttcgtggtacattcctttccaccgtacggtatgtaagtttggtagagaccgaccgggaccccggaggtacgggtctaggaggtggagtgggatggactcgacgtcccgtaacggaactaaacagtagtagnggagagtaagttccgaggacgagtacgtactatacacgtccgaaccggccgaaccaccgtactaccccgaacggtaacgtacccgacgtacccttacgtacgtacggtaacgaggaccggacgtccctagacgtacgtccgtagaaccgacgtaccgtaccgtacgttacgtctcggaccgacgagtagtattgtcactcgtcgtcgtagcgtacgtaccgcgtacgtcgnggtccgg

SEQ ID NO: 30173 - DNA, 706 bp, Homo sapiens
  misc_feature: GYAE6OF02FGLVC.1.49.E05.1.454.CMB.1.raw
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgagtcggtctcctgcagtgcttntggttacntctttccactacggtatcgtaagttggtagagtacgacgggccccgtaggacgggtcttggaggtggtagtgggagtggactcgacgtacccgttacggaaacctaaaacgacggtaagtacgtagggaagaaggtaacggttaccggagggtacacggtacgtactactacgactaccgaccgacggtaacacgacttcccgaacgtacgtaccacggtaccctaacgtaagtacgggtaacttacggaacgggtacacccgtacgacgtacgtaccgtagggaaccgacgacccgggtaccttaaccgttttaactacgtacggcgtaccgggaaggtacgtacgttaacgttacgggacccttaacgtttccgggtacccgttaggtcccgttttaacggaaaaccccggttcggtaacccggtttcggggaccggttaaccccggg

SEQ ID NO: 30174 - DNA, 722 bp, Homo sapiens
  misc_feature: GYAE6OF02HIRRI.1.49.E05.1.454.CMB.1.raw
  modified_base (202)..(202): a, c, t, g, unknown or other
  misc_feature (202)..(202): n is a, c, g, or t
  modified_base (701)..(701): a, c, t, g, unknown or other
  misc_feature (701)..(701): n is a, c, g, or t
tcagacgagtgcgtcacgaccggtgctcgatttagagcgactagcaacacacaaaggggacccaaaaaccacacccctccttgggagaatcccctagatcacagctcctcaccatgggacgggacctggagcattccttttcttgggtggcagcagcaacaggtgcccactcccaggttcacctggtgcagtctggagctgngctgcagaagccgtgggcctcgagtgagtggtctccgtgcgtagtgtcttcgttggttactacttccttttccaccgttacggtataggtaatttgggttagacgtacgaccgggcccccgggtaggtacggggtcttagggaggtaggaggtgggtacgtgggacttcgtaccgttacccgttaacggaaaactaaacgacgggtagttaacggtagggtaagaacggttaacggttccggaagggtacgtaaggtacggttactaacgtacgtacttaaccgggacccgtacgggaaacctaccgtaactacccgaacgtaacggacacgtaactaacgtagtaaggacgttaggacgtactccgagaagtcgttacgacgacaccggaccgtaccgtaactttacgaccgtcgaccgtaacgagttacgtacgtttcggactagttaccggtccgtttacggaccgtttacggtacccgttaacggttacccggtnttacggggacggttaaccggg

SEQ ID NO: 30175 - DNA, 678 bp, Homo sapiens
  misc_feature: GYAE6OF02FYSDW.1.49.E05.1.454.CMB.1.raw
  modified_base (246)..(246): a, c, t, g, unknown or other
  misc_feature (246)..(246): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctggcagaagccgtggggcctcagtgatggtctcctgcagtgcttntggttacatactttccactacgtatgaattggtgagacgacggtccccggagaggggcttgacggtgagtgggatggatcgacgccgttaacgaactaaacgagtacgtagttaggagaagtacgttaccgaagggtcaaggtacgtacgaactcgtaacgttccgaacccggtaccggacctaaccgtacttacccgaacggaacggttaccacggtacccttaaacctacggtacggtaaccgtaagggtaaccggacggtacccgttacaggtactacgttacggacgtaacccgaaccggttaacctaactttaccgttaactccggtaggtaccgtaagggtattaggtttaactcgtacggaccggtttccggtaccgttcggtaccgtacgtaacccgccggtttacgttcgggtacgggtaccg

SEQ ID NO: 30176 - DNA, 925 bp, Homo sapiens
  misc_feature: GYAE6OF02IBDE7.1.49.E05.1.454.CMB.1.raw
  modified_base (162)..(162): a, c, t, g, unknown or other
  misc_feature (162)..(162): n is a, c, g, or t
  modified_base (187)..(187): a, c, t, g, unknown or other
  misc_feature (187)..(187): n is a, c, g, or t
tcagacgagtgcgtcacgaccggtgctcgatttagagcgactagcaacacacgaaaggggacccaaaaaccacacccctccttggggagaatcccctagatcacagctcctcaccatggacgggacctggagcatcctttctggtggcagcagcaacaggtncccactcccaggttcacctgggtcncgtagtctggagccgtggagtcctacggaccgaaggaacgtcccgtgggggaccccttcgaaggttcggacgttcggtccgttcctacggcgtagtcggtacttcgtcgttacgtaacttccgttttaccaccgttaggtacgttagtaactttggttagtaacgtacgtaccgggccccggaggtaccggggtcgttacggtacggtggtaacggtcgggagtaggtacgtcgtaaccggtaccgtaaccgggaaaacttaaccgaaggtaggtaacgtacggggtaaggtaacgtaccggttcggaacggtacggtaacggtacgtaacgtaacttacggaccgtaccgacccgggtaagtacccaaacccgtaaccgtaaacccggtaacggtaacgtacccggtaacgttaccccgtaaagaacggttaacccggtaacgttaccggggtaacggtaaaccgttaccccggtaagaaccggtaccgttacggttaaccggaccccgggtaaaccggtaccccgggttaaccttttaacccgggttaactttaaacgggttacccggtaacggtaacccggtaagggttaacccgttaaacgggttttccggtttaacccgttaccccggggtttaggttaaccccgggttccggtttaaccggggtaacccgtttaacgggttaaacccccgttaacgggtccgggttttacccgtaccgggggtaacccgggg

SEQ ID NO: 30177 - DNA, 825 bp, Homo sapiens
  misc_feature: GYAE6OF02F4O7V.1.49.E05.1.454.CMB.1.raw
  modified_base (248)..(248): a, c, t, g, unknown or other
  misc_feature (248)..(248): n is a, c, g, or t
  modified_base (422)..(422): a, c, t, g, unknown or other
  misc_feature (422)..(422): n is a, c, g, or t
  modified_base (674)..(674): a, c, t, g, unknown or other
  misc_feature (674)..(674): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcaccgtggtgcagtctggagctgagctgacagaacgccgtagggggccctcgagtcgagttcggtcctccgngcgtagtgtccttcgtggttaactctttcctttacccaccgttacggtattagtaacgtttcggtagtacgaccgtaccgggaccccgggtaggtacggggttcttggacggttagggacgtggggacgtacggtagtaccgacggtacccggttaaaggtaaacctaaaacgnggtaaagtacggtagggtaacgtaacgggtaacggttaccgaagggtcgtaaccggtataccgacgttacgaacgtcccgaccggacggacctaaccgacgttaccgaacggtacgtaccgaacgtcccgtaagtacggtaaccgtacggtaacggacggtaaccgtaccttaacgaacgtttcgggaacgttacccgaaaccgggttacccggaacccgttaacccgtttaacggtttaccggttaaaccnccgggttaaccggacggtacgggttaacttagtttaaccgttttaaggaaccggttacccggtttcgttacccgggttaggttaacccgttaacccggtttaacccggaccggtttttacgggttacggtaaccccgggggtttacccggg

SEQ ID NO: 30178 - DNA, 705 bp, Homo sapiens
  misc_feature: GYAE6OF02GE0O3.1.49.E05.1.454.CMB.1.raw
  modified_base (326)..(326): a, c, t, g, unknown or other
  misc_feature (326)..(326): n is a, c, g, or t
tcagacgagtgcgtcacgaccggtgctcgatttagagcgactagcaacacacaaaggggacccaaaaaccacacccctccttgggagaatcccctagatcacagctcctcaccagtggacgggacctggagcatcctttcttggtggcagcagcaacaggtcgcccactcccaggttcaccgtggtgcagtctggagctgagcgtgcagaacgccgtgggcctcgagtgacgttcggtctccgtgctaggtcgtcgttcgtggttactacgttcctttaccacgttacgtatgtagttgtgagacgaccggacccggaggtcggtntggagtcggaagtcggagtgagtcgaacgtcccgtaagtaactaacgagtacgtacggtagaacggtagtacgtacgaggacgagtactacgtatacgtactaccgacgtcgaacaccgtaactcgaacgtacgtactaaccgtaccgtaaagttacgggtaacgaccgttacgggaacgaccgttaaccgtacgtagttaccgtcggtaccgaaaccggttacggaccccggtttactaaccgttttacgtaaccggtcggaacgttacgggaaacttagtttaccggtttaaccggcggttaaccgcggtttaaccgggttaccgtacggtacgtttaacccggaccggttcggtcggttaggtaccgggtacccgg

SEQ ID NO: 30179 - DNA, 661 bp, Homo sapiens
  misc_feature: GYAE6OF02JJO7R.1.49.E05.1.454.CMB.1.raw
  modified_base (409)..(409): a, c, t, g, unknown or other
  misc_feature (409)..(409): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcaccctggtgcagtctggagctgagctgcagaagcctggggcctcgagtgagtggtctcctgcagtgcttcgtggttactatctttccacctacggtatgtaatttggtgagtaccacggcccccggtaggacggggtaccttggtaggtcggagtgggagtcggagtcgtacgtaccgtacggtaaactaaacgagtagtagtaggagagtaacgtccgagggcaggacgtntactactacgtaccgaccggcgtaccgacgtactaccgtacgacgtacgactactaatacgtagtaacgaggacgacgtccgtacaggtctacgacggaccgtaccgaccgggacctaaccgtttactaacgttacgccgtaccggtaagtacgttaagttacgttacggaccgttaccggtacgttacccggttacggtaccgttaaccggttaccgtacccggtttcggttccgggttaggtaccccggg

SEQ ID NO: 30180 - DNA, 1115 bp, Homo sapiens
  misc_feature: GYAE6OF02H2QP1.1.49.E05.1.454.CMB.1.raw
tcagacgagtgcgtcacgaccggtgctcgatttagagcgactagcaacacacaaagggacccaaaaaccacacccctccttgggagaatcccctagatcacagctcctcaccatggacgggacctggagcattccttttcttggtggcagcagcaacgaggtcgcccactcccaggttcaccgtggtgccagtcgtggagcgtgacgctgacgagacgccgtgggcctagagtgagtcggtctccgtgcgtagtcgtcgttacgttcgttactacgtttccgtttaccgtaaccgttacggtagttaacgtaacggtttgggtacgtaacgtaccggtaaccgggtacccccgggtaagggtaaccggggtttcgttaacggggtaaccggggttagggtaacgggtacggggttaacgtaccgggggtaaaccttaccggttaaaccccgggttaaacccggtttaaaaacccgggtaaaaacccttaaaaaccgggtaaggttaaacgggtttaacggtaaccggggtaaacgggttaaaccgggtttaaaccggttaccggggtaaacgggtaacccggtaaaggttacccggttaaacggttaaaccgttaaccggtaaaccggtttaaccccggaaacccggggttaaacccgtaacccggttaaaacccgttaaccgggtaaacccccggttaaaaccccgggtaaaccggttaaaccccggtaaaccggttaaaccccgggtttaaaccggtaaacggggttttaaaacccggaaccgggtttttccggggaaaaccgggttacccgttaaaccccgttaccgggtaaaaaccggtacccgtttaaaccggggtaaacccggtaaccccgggttaaaccccgggttaaacccgttaaaacccccggtttaacgtttaaaccccggttaacggggttaaaccggtacccggtaaaccggggtaaggtttaaaccgtttaaccggttttagggtaacccggtaccgtttaccggggttaaccggtttacccggtacccgggttttaccgtaaaccggttaaccccgggtccggtttaacgggttttccggggaccccggtttaaccgggg

SEQ ID NO: 30181 - DNA, 690 bp, Homo sapiens
  misc_feature: GYAE6OF02HB3ZH.1.49.E05.1.454.CMB.1.raw
tcagacgagtgcgtcacgaccggtgctcgatttagagcgactagcaacacacaaagggacccaaaaaccacacccctccttgggagaatcccctagatcacagctcctcaccatggacggacctggagcattccttttcttggtggcagcagcaacgaggtcgcccacctcccgtacggttccgtaccgtggtcgcgagtcgtggagctgagctgcccccccccccagaagccgtcgggtccgtcgagtgagtcgtcgtccgtcgcgtgtcgtcttcgttcgttactacgttcctttacctacccgttacgtagttgtaagtttaggttgtagacgaccggaccccggacggagggtcgttacggaggtaggagtaggtagtggtagtaccgacgtacccgttaacggtaaacgtaaaacgtaagtaagtaacgtaggaagtaagtaacgttacgaaggcgaagtagtacgtagtactactccgacgacgacaccacgtaccagtaacgtaccgacgcgtaacacgtggtaaactggacgacgacctagactacgtcgtagaccgaaccgaccgcttaacttacgtacgtacggccgtacgaagtacgttaagttagttacgccgttaaccgtcggttacccgttgttaaccgtacgtaaccgtaccggttcgttacgggcggttaccgg

SEQ ID NO: 30182 - DNA, 867 bp, Homo sapiens
  misc_feature: GYAE6OF02FS45I.1.49.E05.1.454.CMB.1.raw
  modified_base (204)..(204): a, c, t, g, unknown or other
  misc_feature (204)..(204): n is a, c, g, or t
  modified_base (224)..(224): a, c, t, g, unknown or other
  misc_feature (224)..(224): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttccaccttggtgcagttctggagctgacnctgcagacgccgtgggcctnagtgatcgtctctgctagtcgtcttcgtacggttactacgtttcctttacccgacgttaacggttattagtaagtttggtggaacgtaccggacccgggtaccccgggaggtacgggggtcttagggtacggtagggtacggtagggtagtacggtacttccggaaccgttaccccggttaaacggtaaaacgtaaaacgtaggtaacggttaggtaacggggtaagtaaacgggttaaccggttaccggggaacgggaccgtaaacgggtacgttaaccgtaacgttaccgtaaccgtaacccgggaacccggtaccggtaaacccaaaccgtttaccgtaccccgggaaacgttaaccggtaaccgtaccgtaacccggttaacgtaaccggttaacggtaaccgggttaaggaaccgggttccgtaaccggtacgtaaggttacccgacggttaaccggaccgtaacccggtaccgtaacccgttaacgttaccgttacggtaacgaccgggtaacgtaacgttacggttaacttaacgggttcccgttacgttaccggttacggttacccggttagggttaaccccgtttacggttaaacccggttcgttaccgggttacgggtccggttaacccgggg

SEQ ID NO: 30183 - DNA, 777 bp, Homo sapiens
  misc_feature: GYAE6OF02FM4LZ.1.49.E05.1.454.CMB.1.raw
  modified_base (587)..(587): a, c, t, g, unknown or other
  misc_feature (587)..(587): n is a, c, g, or t
tcagacgagtgcgtcacgaccggtgctcgatttagagcgactagcaacaccaaggtggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtggggcctcgagtgatggtctccgtgcagtgtcttcgtggttactattccttttcccaccgttacggtatacgtagttggttgagacgtaccgggtccccggagggacggggtcgttaggacggtagggagtggggagtacgggtatccgtaacggtcccgttaaacgggaaacgtaaaacgaggtaacgttagtagggaagtaacggtaacggttaccggaggggtacgtaacggtacggtactaacgttacgtaccgtaaccgaacccgggtaccggaaccaaccgttacgtaaccccggaagggtaaccggtaccaaccgtaccgtaacgtaaccgggtacgtaacggttagggaaccggtacgacccgtanaacggtaccgttacgtaccgaaacccggtacggaccccggtaacctttaccgttttaacccgtaaccggtacggtacccgggtaacgggaaccgttagtacgtttaacgtccgaccggttaaccggtcggtttcccgtaggtacccgttaacggtacccgtcggtacggttacgggacggttacccgggg

SEQ ID NO: 30184 - DNA, 650 bp, Homo sapiens
  misc_feature: GYAE6OF02I9D8J.1.49.E05.1.454.CMB.1.raw
  modified_base (239)..(239): a, c, t, g, unknown or other
  misc_feature (239)..(239): n is a, c, g, or t
tcagacgagtgcgtcacgaccggtgctcgatttagagcgactagcaacacacaaaggggacccaaaaaccacacccctccttgggagaatcccctagatcacagctcctcaccatgggacgggacctggagcacttccttttcttggtggcagcagcaacaggtcgccccacctcccgaggttccaccgtggtgcagtcgtggagctgagctggcaaggaacgccgtcgggcctgagtnagtcgtcctcctgcagtgtcttgtcggttctacttctttcctacgtacgtagtagtaagttgtacgtacgaccgaccggaccccggtacggacgggtcgtggtggtaggaggtgggtagtggacgtcgacgtttttttttttttaccggaaccggtaaacgaaacgtaagaagtagtaggaaggtagtaacgtacggaggtacgtacgatacgtacgtcgacaccgaccgaacgactaaccagtacgaacgacacgtacgactacacgtacgtacgaggcgacgacgtacacgtctactcgaccgacgtaccgtacctacgttacgtacgtacggacgagacgtagtattagtcgtacgtacgtcgttcgtacgtacgtaccggtaccgtcgtcggttacggtccggtacg

SEQ ID NO: 30185 - DNA, 926 bp, Homo sapiens
  misc_feature: GYAE6OF02FO6EA.1.49.E05.1.454.CMB.1.raw
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
tcagacgagtgcgtcacgaccggtgctcgatttagagcgactagcaacgacacaaaggggacccaaaaaccacacccctccttgggagaactcccctagactccacagcctcctcaccatggacgggacctggacgcatcctttctggtcggcagccagcaacaggtgccctactccgtaggttcacctggtgcagtcgtggacgctcgngcctgcagtacgccgtggggcctcgtggtnacgtccggtctcctggcctaggttcgtccttgttacggttaccgttaactccgttttaccgaccgttaccgggttatgtaacgttggtagtaacggtaccgcccggggtaccccgagggtacggggtccgttagaccggttggtaagtacggggtatacgggtacgtaccgaggttacccccgtttaaacgggaaacccgttaaaaccggacgggtaaacggtttacggttaacgggaaacgggtaacgggttaaacccgggttaccgggaacgggtaccggtaaccgggtacgttaacggtaacttaacccggtaaccggttcccgaaacccgggtaccgggtaaaccctaccgtaacccgtaccgggttaaaccggaaccggtaaaccgtacccggtaacccggttaaaccgacggttaaacgggtacctttacgggaacccgtacgtacccgtaaccgtacggtaaccttaacggtaaccgtacccggtaaccgtaaccggttaacccttaaacggtttacgtaacccgtccgttaaccgggaccggtaaacggttaacgttaaccgtttaccgggttaacgtacccggttaaccgttccgggttacccgtaccggttaaccggtaacccgttaacccgggacggtttaacccggttaccgggtacccgggttaaccccgggg

SEQ ID NO: 30186 - DNA, 789 bp, Homo sapiens
  misc_feature: GYAE6OF02HMJMH.1.49.E05.1.454.CMB.1.raw
  modified_base (232)..(232): a, c, t, g, unknown or other
  misc_feature (232)..(232): n is a, c, g, or t
  modified_base (258)..(258): a, c, t, g, unknown or other
  misc_feature (258)..(258): n is a, c, g, or t
tcagacgagtgcgtcacgaccggtgctcgatttagagcgactagcaacacacaaaggggacccaaaaaccacacccctccttgggagaatcccctagatcacagctcctcaccatgggacggacctggagcatccttttcttggtggcagcagcaacaggtgcccacctccctaggttccacctggtgccagttccgtggagctggagcctcgcaagaagccgtggggcctnagtgagtggtcctcgtgacgtgtgtntttcgttcggtactacgtttccttttaccgaccgttacggtattacgtaagtttacggttagacgtaccggaccgggtaccccgggtaaggcgggggttcttagggtagggtacggtaaggtggggtaatgggttataccgtaacgttacccgttaaacggaaaactaaaacgtggtaacgtaaggtaggaaaggtaagtaacggttccggaagggactaaggtcgtaacacgtacacgtaccgacccggacggtaaccaacgtacgaaccgtaaaccggaacgtaacgaccgtaccgttaaacgtacggtaccggtaaagtcggaaggcgtaccccgtagtcggaaaccttcgtaaccggacccggaacccggtaccgaaacccgtttactttaaccgttaaccggtaggtccggtaacggtagtaacgtttaacggtttaaccgtggttacccctccggttaacggttcccggttaccggtacccgaacgtttaccgaacccggtttcgttacgggtccgggtacccgg

SEQ ID NO: 30187 - DNA, 613 bp, Homo sapiens
  misc_feature: GYAE6OF02JV986.1.49.E05.1.454.CMB.1.raw
  modified_base (335)..(335): a, c, t, g, unknown or other
  misc_feature (335)..(335): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttaggtggtagcagcaacaggtgcccactcccaggttcacctggtgcagtctggagctgagctgcagaagcctggggcctcagtgatggtctctgcagtgcttcgtggttaccattctttccacctacggtatagtacttggtagagacgacggccccggaggacgggtcttggaggtggagtagggagtggancgacgtaccttaacggaactaacgagtatagaggagaagtagtccgagggacaggacgtatacgtctactccgacgacgaaccacacgtaccagacgtacgacgtactacgagtacggaactagggacgtcgactacgagacgtacgtacgaaccgacgtacggtacctacgttacgtacgtcggaccgagggtagtacgtagtttacgtcgacgttagtcggttaccgacggtactaccggttaacgcgttaccggttggtaccggtacgtaccggg

SEQ ID NO: 30188 - DNA, 806 bp, Homo sapiens
  misc_feature: GYAE6OF02GZVQO.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtaggggcctcgagtgtagtggtcctcctgctagtcgtcttcgtaggttactacgttccttttacccgaaccgttacggtacgtacggttaagtttgggttaggacggtaccgaccggggtaccccccggaagggtacgggggtctttacgggaggttaggggtacgttacggggtaagttcgggaacgttccgaacccggttaccccggttaaaccggaaaaccgtaaaaccgtagggtaacgtaggtagggaaggtaaacggtaacggttacccggaggggactaggtaacggtactacgtacctaacggttaccaaccgggtaccggaacctaaccggacctaaccccggtaaaggtaaccggtacccgtaacggtaacccgttaacgttaacggtaacggtaaaccgttacggggtaaccgaacgtacccgttacgacgttaaccgtcggtaacgaccgaaccggtaccgtacccttacgttacgttacgtacggaccgtacgacggtagtacgtttacgtacgacggttaccgtcggttacccgtgtaaccgttccggtaaccttacgtcgttcgggttacgtacccgg

SEQ ID NO: 30189 - DNA, 846 bp, Homo sapiens
  misc_feature: GYAE6OF02HQ555.1.49.E05.1.454.CMB.1.raw
  modified_base (261)..(261): a, c, t, g, unknown or other
  misc_feature (261)..(261): n is a, c, g, or t
  modified_base (788)..(788): a, c, t, g, unknown or other
  misc_feature (788)..(788): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacgtggtgcagtctggagctgagctgcagaacgccgtggggcctcgagtgagtcggtctccgtgcagtgtcttcgtggttactnttcctttaccaccgttaggtacttagtaagtttgggttagacgtaccgaccgggacccccgggtaagggtacgggggtccgttagggtacggtagggacggttaggggtacgtagggaacgttaccgtaacccggttaacccccggttaaacgggtaaaaaccgttaaaaacgtaacgggtaaacggttaaacggttaggggaaacggtaaagggttaaaccggttaccgggaacggggttaacgaggttaacgttaaccggtaacttacgaaaccggttaccgaacccggggaccggtaacctaaccgtaccgacccggtaaacggacgttaacgaccgttacccgtaacgacggtacggaaccggtacgggaacggtaccgtcccgtaacgtacgtacgttacggtaaccgggaccaaaccggtccggtacccgttaacgttttaaaccgttaccggtcggacccggttacgggtaagtaccgtttagtttacggccgttacccggtacggttccgggttaccgnggttaacccgtaacggtaaacccggcggtttacccggttggggtccggtaacccgggg

SEQ ID NO: 30190 - DNA, 730 bp, Homo sapiens
  misc_feature: GYAE6OF02J2NB8.1.49.E05.1.454.CMB.1.raw
  modified_base (70)..(70): a, c, t, g, unknown or other
  misc_feature (70)..(70): n is a, c, g, or t
  modified_base (158)..(158): a, c, t, g, unknown or other
  misc_feature (158)..(158): n is a, c, g, or t
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (243)..(243): a, c, t, g, unknown or other
  misc_feature (243)..(243): n is a, c, g, or t
  modified_base (297)..(297): a, c, t, g, unknown or other
  misc_feature (297)..(297): n is a, c, g, or t
  modified_base (440)..(440): a, c, t, g, unknown or other
  misc_feature (440)..(440): n is a, c, g, or t
  modified_base (672)..(672): a, c, t, g, unknown or other
  misc_feature (672)..(672): n is a, c, g, or t
tcagacgagtgcgtcacgaccggtgctcgatttagagcgactagcaacacacaaaggggacccaaaaccncacccctcttgggagaatcccctagatcacagctcctcaccatcggacggacctggagcatcctttcgtggtggcagctagcaaacgnggtcgcccacgtcccgaggttcaccgttggtacgcacgttcnggacgtctgganccgtgccgaaggacgtccggtcggggacccngtaggtccggtattccgggtctccgagtcgtcgtcgtacgttcttcggtaaccnctttccttaccgaccgttacggtagtcgtaaggttgttacgacgaccggtacggtcccgggaggtacggtccgttggtaacggtgggtacgtcggggtaactgggtactacggttacggtaaccgttaacggtaacgtaaacnggttaaggtacgtaggtaaacggtacgtacggtacgacgggtactagtaacgtaccgtgtacctaccgaccgtaaccgtacggtactaaccgtccgaacgacgtacccggtcgaaccgtaccgttacggaacgtacggtaacgttggaacgggttccaccgttagaacgtcgtaacgtacggaacgtaccgtaacgccgtttaaactcggtaccgtacgacggagtaacgtntacggttatcgaccgttgtaacgtcgtagtctaccgactacggcgtagcggtaaccgg

SEQ ID NO: 30191 - DNA, 920 bp, Homo sapiens
  misc_feature: GYAE6OF02GA1DP.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccacctcccgaggttcacctggtgcagtctggagctgagctgcaagagccgtggggcctcgagtgagttggtccttcctgacgaggtgtacctttcgtaggttaactattttccgttttacctaacccgtttaaccgggttagttacggttaaacgtttcgggttacggaaacggtaaccggaacccgggggtaccccccggggtaacgggtaacgggggggtccctttagggtaacgggttaggggtaacggttcgggggaagtttcggggtaactacccgggtaaccggttaaccccggtttaaaaccgggtaaaaaccgttaaaaaccgggaacggttaaacggttaaacggttaacgggtaaagggtaaacgggttaaacccggggtttaccgggtaaacgggggaccgtaagggtaaacgtacgtaacggttaaccgaaccggttacccggaaccgggtacccggaaccgtaacctaaccgttcccgaaaccggttaacggtacctaaccggtcccttaaagcggttaaaggaacggttggaacgggtactcccgttagactacggtactacggaccgtaacccggaccgtaaccctttaacgttacgtttaccgtacgggacgtcggggaaacttagggttaaacgttcgttcggtacccgtttaacggtcccgggttaccgtttaggtccccggttaaacgtaacccccgggttacggtttcccggtttaggggtacccgggtaaccggg

SEQ ID NO: 30192 - DNA, 846 bp, Homo sapiens
  misc_feature: GYAE6OF02HSB97.1.49.E05.1.454.CMB.1.raw
  modified_base (161)..(161): a, c, t, g, unknown or other
  misc_feature (161)..(161): n is a, c, g, or t
  modified_base (203)..(203): a, c, t, g, unknown or other
  misc_feature (203)..(203): n is a, c, g, or t
  modified_base (679)..(679): a, c, t, g, unknown or other
  misc_feature (679)..(679): n is a, c, g, or t
tcagacgagtgcgtcacgaccggtgctcgatttagagcgactagcaacacacaaaggggacccaaaaaccacacccctccttgggagaactcccctagatcacagctcctcaccatgggacggacctggagcattccttttcttggtggcagcagccaacnggtcgcccactcccaggttcaccgttggtgacagtcgtaggngctagcgctgacaggacgccgtcgggcctgagtgacgttcggtctccgtgtacgtggttcgtcttcggttacggttactctttccgttttaccgaaccgtttaggttcgtaggttaagtttgggttcgaacggacccggtacccgggtaccccgggtaaggtacggggttccgttagggtacgggtacggtaagggtttacgggtacgtaaggtaaccgttaccggtaacccgggttaccccgtttaaacggggaaaaacctaaacgggtagggttaaccggttaacggttacggggaaacgggtaaacggttacgggtttacccgggaaggggactaaacgggttacggttacctaacgggtaaccttaccggtacccggtaacgggaccggtaacaaccgtaccggtacccgtaaacggacgtaaccacgtaccgaaggtacgttacgaacggtcgtaacggacgtccgaacgngtaccgtagtacgtaacccgaccggtacgtaaccttaacgtttacgacccggttgaacggtacgtaacgtacgttacgtttacgtcggaccctttacgggccgttttaaccggcgttacccgggtaacccttacggtaccggttagttcccggggtacgtaccgggg

SEQ ID NO: 30193 - DNA, 622 bp, Homo sapiens
  misc_feature: GYAE6OF02FVPXV.1.49.E05.1.454.CMB.1.raw
  modified_base (359)..(359): a, c, t, g, unknown or other
  misc_feature (359)..(359): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctgagcatcctttcttggtggcagcagcaacaggtgcccactcccaggttcacctggtgcagtctggagctgagctgcagaagccgtggggcctcagtgatggtctcctgcagtgcttctggttactatcttttaccaccttacggttatgtaagttggttgagacgacggaccccggaggtacggggcttggaggtcggagtgggagtgatcgacgccgttacggaactaaacngtaagtacgtaggagtagacgttaccgagggtacaggtacgtcgatcgactacgtaccgcgaaccgaacgtcacccgtacggtacgtacgaacgtcccgtaagacgttaggaacgttacggaaggacgtcccgtagacgtacgtacgtacggaccgaccgtaccgtacctactttaagtacctcggagacgagtacgtaatacgttcggacttacggtcgttcgtacggtcgttaccgtaccgtacggtcgtcggtggtacgg

SEQ ID NO: 30194 - DNA, 713 bp, Homo sapiens
  misc_feature: GYAE6OF02JNDAM.1.49.E05.1.454.CMB.1.raw
  modified_base (245)..(245): a, c, t, g, unknown or other
  misc_feature (245)..(245): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtcgcccactcccaggttcacctggtgcagtctggagctgtacgctgcagaagccgtcggggcctcgagtgatcggtctccgtgnagtgtcttcgtggttactacttcttttcccgaccgtacggttagtacgtagttggttagacgtacgtacgggcccccggaaggtcggggtccttaggacggttacggaggtgggtacgttagggacttacgacgtaaccgttaaacggtaaactaaaacgacgtagttaagtaggaacggtagtaacggttaccgggaaggacgtaacggacgtaactagtaccgtacgtacccgaccgggaccgtaacgaactacggaaccgttaaccgaacggtacctaccgggtacctagtacgtacggaacttcgggacgacgtacctaacgtacgacgttacgacggacgaccaccgggtccttaacgttaccttacggtcgacgtagtaccgtatagttagtacccgtgtaccggtacgttcgttacggacttacccggtaccttacggtcgggtttaggttccggtaccgg

SEQ ID NO: 30195 - DNA, 720 bp, Homo sapiens
  misc_feature: GYAE6OF02GESL0.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttccaccgtggtgcagtctggagctgagctgcagaacgccgtgggcctcgagtgagtggtcctccgtgctagtgcttcgtggttactacttcctttaccgaccgttacggtatacgtagttggtacgagtaccgaccgggacccccggaggtaacggggtctttaggacggttaggtacgtagggtagtaggtaactcgtaacgtacccgttaaacggtaaacctaaaacgagtaaggtagtaggtaacgaacgtaacggtccgaaggacgaagtacgtactacgtacgtacgtaccgaacccgacggaaccaacgtactaccgaacgaacgtacgacgtaccctaagtacgtacggaacgttacgggaacgtacgtaccgtaacgtaacggtacgttaccgtacggaacccgtaaccggacccgttacgttaacgttaaccgtaccgtcggaacgtacggagtacgttagtacgttccgaccgttacgtccggtaccgtagggtacctaccggttaaccgtcgttcggttacgggcggtacccgg

SEQ ID NO: 30196 - DNA, 708 bp, Homo sapiens
  misc_feature: GYAE6OF02GO4H9.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgagtggtctccgtgctaggtcgtctttcgttggttactattccttttcccaccgttacggtatacgtaagtttggttagacgacgtaccgggcccccggagggacggggtcgttggtaggtagggaggtcggggtagtagggtatccgtacgtcccggttaacggtaaactaaacgaggtacgtagtacgggaagaggtaacgttaccgaggacgtaaggacgtacactcaacgtcaacccggcgaaccacgtaacctacgaacgtacggtaaccacgtacctaacgaggtaaccgtaacggttcggaaacggcctaccgtaacgaacggtactccggtaacggaacccggaccgtaacccggaccttaaccgtttaccgtacggttcgaaccggacgtaagtacggttactttacgtctacgttaccgtggttacccgtggtaccgtacggtacccgttacggtcgttgggtcgtaacccggg

SEQ ID NO: 30197 - DNA, 845 bp, Homo sapiens
  misc_feature: GYAE6OF02FMWTA.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtcgcccactcccaggttcaccgtggtgcagtcgtggagctgagctgcagaagccgtgggcctcagtgatggtcctccgtgcgagttgtccttgttcggttactactttccttttaccctaccgttaccggttaatacgttaagttgggtttacggaaggaaccgtaaccggggtaccccccggggaggtacggggggtccgtttagggaacggttagggtagttgggggtacgttagggaacttaccgtaccgggttaccccgttaaaccgggtaaaccgttaaaaaaccgtaggtaaggttaacggtaggggtaacggtaacggtaacgggtttaccggaacggggtacgtaacggtacggtactaacgtacaacgttacccgaaccgggtaccgggactaaccgtaccgtaccgaacggaacggttaaccacgttacccgtaacgtaacggaccgttaacgtcgggtaacggaaccgttacccgtacgaaacggtcgtaaccgtacggtaaacccggaccgtaaccggttaacccgtaacctttaaccgttccgtacggtacggaaccgttaagtacgttaagtttacgttacggtaccttaacggttccgttaccccggttaggaacccgttaccgggtaaacccgttccgggtacccggttacggttacgggtaaccccggg

SEQ ID NO: 30198 - DNA, 754 bp, Homo sapiens
  misc_feature: GYAE6OF02HCS5O.1.49.E05.1.454.CMB.1.raw
  modified_base (264)..(264): a, c, t, g, unknown or other
  misc_feature (264)..(264): n is a, c, g, or t
tcagacgagtgcgtcacgaccggtgctcgattttagagcgactagcgaacgacacaaaggggacccaaaaaccgacacccctccttgggagaatcccctagatcacagctcctactaccatggacgggacctggagcactccttttcttcgggtggcagcgaggcaacgaggtgcccacgtccctaggttcaccgtggtgcgtagtcgtggtagctgagctgcagacgccgtaggggccttcgagtgatggtctcgtcgctagngtcttgtggttactgttccttttaccaacgttacggtatagttacgtttggtagacgacgaccggtaccccgggaaggtcggggtactaggtacggtggtaggtagggagtggactcgacggttaacccggtaacggtaaactaaaccggaggtacgtaacggtaggtaaggtaacggtaacgttacggagggtacaacgggtcgtaacgtaactcgaacgtcccgaacggcgtaaccgactaacgtacccgaagtaccgtacgacgtaccctaagaacgtacggaacgtcggtaacgacgggtccagaaagtccgtaacgacccggtaccggaacgccccggttaacctaacgtttacgttaccgacggtacccggaagtaagggttcttaagtttacccgtcgttaccgtagggtttacccgggtcgtacggggttacccttaaccggaaaccccgttgggtaaccgtttcggggtccgggtaaccgg

SEQ ID NO: 30199 - DNA, 897 bp, Homo sapiens
  misc_feature: GYAE6OF02GAJ1Z.1.49.E05.1.454.CMB.1.raw
tcagacgagtgcgtcacgaccggtgctcgatttagagcgactagcaacacacaaaggggacccaaaaaccacaccccgtccttgggacgaatcccctagatcacagctcctcaccatcggacggggacctggaggcatccttttcttggtggcagcaggcaaccaggtgcccgactcccaggttcacctggtgcagtctggagctgagctgcagaagcctggggcctcgagtgagtcggtctccgtgcgaggtgcttcgtggttacagttctttccacttacggtatgtaagttggttgacgacgacggtccccggaggaggggtcttcggaggttgggacgttaggggtacgtagggtactccgtaacggtaccccgttaaacgggtaaaacctaaaaacgtaaggtaaacggttaacggtaaggggtaaaggtaaacggtaaacggtttaacccggaaagggggtaaccggtaaagggtaacggttaccgtaaacggttaccgtaaacggttacccggaaacccggggttaccgggaaacccgtaacccgtaaaccggttacccggtaaaacggttaaaccggttaaccgtaaaccgggtaaccccgttaaaccggtaacggttaaacgggaaaacccggtttacgggaaacggggttaaccggtacccgttaacgaaaccggttaacgttaacccgtacgggaaaccggtaaccggaaacccgggttacccgttaaaccgttttaaccggttaacgtccggtaccgtaaccggtaacggtacggttaacctttaacgggttccggaccggttaaccggtccggtttacccgtcggtttaacccggtaccggttaaacccggtccggttacggtttccgggaccgggtaaccggg

SEQ ID NO: 30200 - DNA, 818 bp, Homo sapiens
  misc_feature: GYAE6OF02HP69J.1.49.E05.1.454.CMB.1.raw
tcagacgagtgcgtcacgaccggtgctcgatttagagcgactagcaacaccaaggtggacccaaaaaccacacccctccttgggagaatcccctagatcacagctcctcaccatggacgggacctgggagcatccttttcttggtggcagcagcaacaggtgccactcccaggttcacctggtgcagtctggagctgagctgcaggaagccgtggggcctcagtgatggtctctgcagtcgcttcgttggttacacttccttttacccgtaactacggttatagttaagtttgggtttaggacgaaccggaccgggtaccccccgggaagggacggggggtccgtttggacgggtagggtagtaggggtaacgtgggtaacgtcgtaacggtaccccgtttaacgggaaaacttaaaaacggcgtaaggttaagtagggaagtaaggtaacggttaccggaaacggggacgtaaggaacggttacgtaacgtacaacgtccgaacccgggaccgaacccgtaaacctaccggttaccccgaaacggtaaccggttaaccgaacgtaccccgttaaacgaacggtaacgggtaaccggtacgggaaggtaccggacccttagaacgtaaccggtacgttaccgggaacccggtaaccgaaccggtacccttaaagttttaaccttaaccggttcggaaccgggtacaagggtagttaacgttttaacgtcggttaaccttccgggtttaggtaccccggttacggtccggttaacggttaacccgtaccggtttacgttacggggtcgggtaacccggg

SEQ ID NO: 30201 - DNA, 635 bp, Homo sapiens
  misc_feature: GYAE6OF02HM7P8.1.49.E05.1.454.CMB.1.raw
  modified_base (627)..(627): a, c, t, g, unknown or other
  misc_feature (627)..(627): n is a, c, g, or t
tcagacgagtgcgtcacgaccggtgctcgatttagagcgactagcaacacacaaaggggacccaaaaaccacacccctccttgggagaatcccctagatcacagctcctcaccatggacggacctggagcatcctttcttggtggcagcagcaacaggtgcccactcccaggttcacctggtgcagtctggagctgagctgcagaagccgtggggcctcgagtgatggtctcctgcagtgtcttcgtggttacacttcttttaccaccgttaacggtatcgtaagttggttgacgacgacggcccccggagacggggtcgttgaggtggtagtgggagtaggagtacgacgtacccgttaacggaaactaaacgagtagtagtggaacgtaggaacgttcgaggcagacgtcagtacgactccgaccgacggtaccgaacgtacgtaccgtaacgacgttaaccgacgtacccgtaacacgtaggacgttaagacggacgtcctagacgtactcgtacggaacgaccgaccggtaccgtaatttaactacgtcgacgcgagtacgtacgtttacgttggacctacggtcgtccgtggtacgtacgtaacccgtacggtacgttcggnggtaccgg

SEQ ID NO: 30202 - DNA, 845 bp, Homo sapiens
  misc_feature: GYAE6OF02FYGKJ.1.49.E05.1.454.CMB.1.raw
  modified_base (767)..(767): a, c, t, g, unknown or other
  misc_feature (767)..(767): n is a, c, g, or t
  modified_base (836)..(836): a, c, t, g, unknown or other
  misc_feature (836)..(836): n is a, c, g, or t
tcagacgagtgcgtcacgaccggtgctcgatttagagcgactagcaacgacacaaaggggacccaaaaaccacacccctccttgggagaatccctagatcacagctcctcaccatggacgggacctggagcactcctttcttggtgcagcagcaacaggtgccactccaggttcaccgtggtgcagtctggagcgtgacgctacgcacggaacggccgttagggggcctcgagtcggtagttcggttcctcctgccgtagttcggtaccgtttacgttcggttaacactttcctttttaccgaacccgttaaggttactaggttaacgtttgggttaacgaggtaccggtaccggggtacccccggtaagggtacggggggtcctttagggtacgggttggggaacggttacgggggtacggttaacgggtacttacccggtaaccggggttaacccccggttaaacgggtaaaaaacccgtaaaacggtaaacgggtaacggttaaccggttaaggggaacggggttaaaggtaacccggttaaacccgggaaggggtaacggtacggttaacggtacgtaactaacgtacgttacccgggaaccggtacccgggaactaacccgtaacgtaacccggaacggtaaccgtaacggcgtttaaaccccggaattacgggttaacggtaacccggtagggtaacgtaccgtaccgaggtacgtaacgtccgacggaacggacccgacctaccgttaacttacgtaccnggtcaacggagtataagttcgtacgacgtcgttcgtcgtgtaccgttacgtaaccctcggcttacgggngtaacccgg

SEQ ID NO: 30203 - DNA, 705 bp, Homo sapiens
  misc_feature: GYAE6OF02FL0UL.1.49.E05.1.454.CMB.1.raw
  modified_base (196)..(196): a, c, t, g, unknown or other
  misc_feature (196)..(196): n is a, c, g, or t
  modified_base (262)..(262): a, c, t, g, unknown or other
  misc_feature (262)..(262): n is a, c, g, or t
  modified_base (318)..(318): a, c, t, g, unknown or other
  misc_feature (318)..(318): n is a, c, g, or t
  modified_base (490)..(490): a, c, t, g, unknown or other
  misc_feature (490)..(490): n is a, c, g, or t
  modified_base (541)..(541): a, c, t, g, unknown or other
  misc_feature (541)..(541): n is a, c, g, or t
tcagacgagtgcgtcacgaccggtgctcgatttagagcgactagcacacacaaaggggacccaaaaaccacacccctccttgggagaatcccctagatcacagctcctcaccatggacgggacctgagcatcctttctgtgcagcagcaacaggtgcccactcccaggttcacctggtgcagtctggagctgagcngcagagcctggggctcgagtgatggtctcctgcagtgtcttctggtacatcttccactacggttancgtaactttggtgagacctacgggccccccgaggacggggtcctttagacgtaggntcggggtattacgggatccgaaggtccccctaggggtaaaaccttaaaaaccgaggtaaacgtaacgtgggacggtagtaacggtttacccgagggacgaggtacggtcaacgttacacgtcaaccggccgggaacactagtccaaccggtacgtactaaggcccttaaccntacgggtaaaccttcgaaagggtaccgtacctaccgacgtacgttaaccgngaaacggacccgaacgggtacccctaaagttttaccgtaaactttacgcggttacggaacggtaccgttaataacgggttttaccgacggtaaccgttcggttaaccttacggggtccgttaccggttaaaccccggatccccgggttagtaggggtaaccccg

SEQ ID NO: 30204 - DNA, 861 bp, Homo sapiens
  misc_feature: GYAE6OF02FU4DA.1.49.E05.1.454.CMB.1.raw
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
  modified_base (748)..(748): a, c, t, g, unknown or other
  misc_feature (748)..(748): n is a, c, g, or t
tcagacgagtgcgtcacgaccggtgctcgatttagagcgactagcaacgacacaaaggggacccaaaaaccacacccctccttgggagaactcccctagatcacagcctcctcaccatggacgggacctggagcactccttttcttggtggcagcagcaacaggtcgcccactcccaggttacacctggtgcagtctgganctgngctgcaagagtcgtggggtcctcgagttggacgttcggtccttacccgtgacgtacggttcgtaccgtttcgttcgggtttaaccttcttttcccgttttaccccgtaaccggtttaaccgggttaacttacggtttaaaggttttgggtttacgggaacggttaacccgggaccccggggtaccccccgggtaaggggtaccggggggttaccttacgggaggggttaacgggtaaggtgggggtaacggttacggggtaacctcggttaacccggttacccccgttttaaaagggaaaacccggtttaaaaagaggggtaaacggttaaggtacggggaaaagggttaaccggttaaaccgggtttccgggaacgggaccggttaaagtaacggttaacgtaaccgggttacctaaaccgttcccgggaaacccgggtaaccggaaccgttaaaccctaagttaacccggaaacgtaacgttacgaaaccgtaacccgtacgtaacgggtacgtaaccgaggtaacggtaccaccgttaanacgtacgtacgtaacgaccgaccgtacgtacctaacgttcgacgtcgacgtgacgtagtactcgtgacctcggtacgtgtacgtcgtacaccgtatcggttacggcgtaccgg

SEQ ID NO: 30205 - DNA, 881 bp, Homo sapiens
  misc_feature: GYAE6OF02HAUOI.1.49.E05.1.454.CMB.1.raw
  modified_base (141)..(141): a, c, t, g, unknown or other
  misc_feature (141)..(141): n is a, c, g, or t
  modified_base (189)..(189): a, c, t, g, unknown or other
  misc_feature (189)..(189): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattccttttnttggtggcagcagcaacaggtcgcccactcccaggttccaccgtggtncagtctggagctgatcgtgcgagaacgccgtggggcctcgtacgtgacgtcggttctccgtagacgtgtcgtcgtttcgtcggttacctactttaccgttttacccgtaccgtaacggttacgttagtaacgtttggttacggaacggtaccgaaccgggtacccccgggagggtaccgggggtactcgggtaagggttacgggagggttacgggtaggttacgggaacttacccggtaaccgttacccggttaaacccgggaaaacgtttaaaaaccgtaggttaaagggtacgtaggggaaggtaacggttaccggtacgacggggtacgaacggttagtaccgaacgttaacccgtacggttaacccgaccggggtaaccgaaccgtacccgtaactacccgggttaaaccggaacgttaacgaccggtaacgtaaccgtaagggttaacccgggtaaaggttaccgaacggggtacctaccggtaacgtaaccgttcggtaaccgggttacgtacccggggtaaccgacccgttaccggtttaaccttaacccgtttgggacccggtacggacggttaaggttaccgttactttacggtacgggtaaccctttacggtccgggttaacccgttaggcccgtttacggtaaccctacgggtttccggttaggggttacccgtacccggg

SEQ ID NO: 30206 - DNA, 674 bp, Homo sapiens
  misc_feature: GYAE6OF02F17E9.1.49.E05.1.454.CMB.1.raw
  modified_base (638)..(638): a, c, t, g, unknown or other
  misc_feature (638)..(638): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttccacctggtgctagtctggagctagagctgcagacgccgtagggcctcgagtgagtgtctccgtgactagtcgtcttcgtaggttactacgttcctttaccctaccgttacgtacgtagtaagttggttacgagtaccgtacggtacccccggaggtacggggtcgttggtaggtacggacggtagggtagtacggtactccgtaacgtaccgttaacggaaacgtaaacgtagtaagtagtaggaagtaggtacgtacgaggacagtagtacgtatacgacgtaccgacgtacgacacgtactaccgaacgtacgtaccgtacgaccgtacgacgtacggtacgtaggagtaccgtaccgacgtactacgtacgaccgtaccgacgaccggtaccttaaccgttacgttaccgacggtacgacggtactagttattacgtcgtaccgtacgtccgttacgngtacctagtacccgtagtccgttaggcggtaaccgg

SEQ ID NO: 30207 - DNA, 907 bp, Homo sapiens
  misc_feature: GYAE6OF02ISD15.1.49.E05.1.454.CMB.1.raw
tcagacgagtgcgtcacgaccggtgctcgattttagagcgactagcaacacacaaagggacccaaaaacacacccctcctgggagaatcccctagatcacagctcctcaccatggacgggacctggagcacttccttttcttggtcggcagcagcaacaggtcgcccactcccaggttcacctggtcgcagtcgtggagctgagctagcgaaggaacgtcccgtcgggggccctgtaagtgacgttcgggttccttccgtacggcctacggtacgtccgtttacgttcggttaacctaacttttcctttttacccctacccggttaaccgggtaattacggttaacgttttagggttacgaacggaaccgtacccggggtaaccccccgggtaagggtaacggggggtctttacggtaagggttagggtaggtggggaagtacgggataccggtaaccgtaccgtttaaaccggaaaacttaaaacgtaacggtaagttaagaacggaaggtaaagtaacggtttaccggaggggtaacgaacggtaacggtaccgtaacgtaccgttaaacggtaccccgtaaacccgtaccggaaaccgtaacccgtaaaccttaccgggtaaacccggtaaaacggttaaacccgacgtacccgtaaaacgggtaacgtacggggttaaacgttacgggaaacgggttaccgaaaccgttcgaacggtaccttaacggtacggaaccgacccgtaaccggtaaccgtttaacttacgggttaaccttcggaccggacgttaaggtaacgttaagtttaaccgttaacggaaccttccggttaacgggttaccgtaacgggttccgttaacggttaacccggacccggttttacggtacggggtacggtaaccgg

SEQ ID NO: 30208 - DNA, 821 bp, Homo sapiens
  misc_feature: GYAE6OF02GENIE.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtcggggcctcagtgacgtggtcctcctgcaggttgccttcgtcggttacactttcctttaccaccgttacgtatagttaagtttgggttagacggacgaccggaccccgggtaggtacgggggtccgtttaggaggtacgggtaggtcgggtaacgtgggtaacgtccgtaaccgggttaccccgtttaaacggggaaaactaaaaaccggagtaacggttaacggtaagggaacggtaaggttaacggtttaccggaacggggtaactaacggtagtaaccgtacttacgaacccgttaccggaaccggtaccggtaccaaccgtacgtaccccgaacggtaaaccggttaccgaaacgtacccgttaacgtaacgtaacggtaaacgttacgggaacgtacggtccctacgtaacgtaaccgtaaccggaaccgtaacccggaccggtaccgtaacccggtttaacttacccgttacggaacgtaccggtaggtaacccgttagtttacggtacggttaccgtaccggtttaccgggtcccgttacggtaaccgttaccgttacccgtaccgttcgggttacggtccgggtaccggttacccgggg

SEQ ID NO: 30209 - DNA, 851 bp, Homo sapiens
  misc_feature: GYAE6OF02G0071.1.49.E05.1.454.CMB.1.raw
  modified_base (197)..(197): a, c, t, g, unknown or other
  misc_feature (197)..(197): n is a, c, g, or t
tcagacgagtgcgtcacgaccggtgctcgatttagagcgactagcaacacacaaaggggaccaaaaccacacccctccttgggagaatcccctagatcacagctcctcaccatggacgggacctggagcatccttttcttggtggcagcagcaacaggtgcccactcccaggttcacctggtgcagtctgagctganctgaagaagcctggggccttcaggtgatcgggtctcctgcgtagtcgccgtttcgtaggtttaccacgtttccttttacccgtaaccgttaaccggttataggttaaagttttggttaggtaacgtaccgaacggggtaccccccggaaggggtaacggggtccgttggtacgggttacgggaaggttaggggaacgttacgggtaagtacgttaaccggtaccccggtttaaaaccgggtaaaaccgttaaaaacgtaacgggttaaaaggttaacgttagggaaacgtaaggggtttaaacgttaccgggaaacggggtcaaaggtacggttacccgtaagttaccgtaacgttacccgaaccggacgggaaccctaacgtaccgtacccgtaaccggaaacgtttccgaacggtaccctaacgtaactaacgggtaaaccgttaaggaaccggggtaacctaacccgtacgtaacggtacgttaccggtaacgaaccggtaaccgacccgggtaccttaaccgttaaccgtttacgtaacggtacggttaaccggaagttaacgttacgtttaacgtgggtacctacgttacggtacccgtggttactacgtaacccgtccgttaggttaacggtccggtaacgtacgggg

SEQ ID NO: 30210 - DNA, 728 bp, Homo sapiens
  misc_feature: GYAE6OF02HWAHZ.1.49.E05.1.454.CMB.1.raw
  modified_base (591)..(591): a, c, t, g, unknown or other
  misc_feature (591)..(591): n is a, c, g, or t
  modified_base (604)..(604): a, c, t, g, unknown or other
  misc_feature (604)..(604): n is a, c, g, or t
  modified_base (641)..(641): a, c, t, g, unknown or other
  misc_feature (641)..(641): n is a, c, g, or t
  modified_base (647)..(647): a, c, t, g, unknown or other
  misc_feature (647)..(647): n is a, c, g, or t
tcagacgagtgcgtcacgaccggtgctcgatttagagcgactagcaacacacaaaggggacccaaaaaccacacccctccttgggagaatcccctagatcacagctcctcaccatgggacggacctggagcatcctttcttggtggcagcagcaacaggtgcccactcccaggttcacctggtcgcagtccgtggacgctgagcctgcagagcgtgggcctcgagtgagtggtctccgtgctagtcggtcttcgttcggttacagttccttttccaccgttacggtatcgtaagttggttcgacgaccgtacgggacccccggtagggacggggtcttcggtacgggtacggtaggtagggtaactgggtaacgttaccgtaacggttccccgggttttaaacggaaaacggttaaaaccgtaacgggtaaggtaaccggttaccgggtaaaggaacgggtttaaaccggtaccgggtaacggggacgtaaggtaacgttaccggacttaaccgtacgaccgtttacccgggacgtaaccgacctacgtaaccgacggtaaactcgtacgactaacgagtacgagttacgnggacgtactaganacgtacgcggtaccacgaccgacttaacttatcgacncggtanacggagttacttaggcttaccggtcttaacgggtcctagggtaccaacgttaccgacgttacggtttgggacggtacccgg

SEQ ID NO: 30211 - DNA, 644 bp, Homo sapiens
  misc_feature: GYAE6OF02F8BYH.1.49.E05.1.454.CMB.1.raw
  modified_base (267)..(267): a, c, t, g, unknown or other
  misc_feature (267)..(267): n is a, c, g, or t
  modified_base (341)..(341): a, c, t, g, unknown or other
  misc_feature (341)..(341): n is a, c, g, or t
  modified_base (400)..(400): a, c, t, g, unknown or other
  misc_feature (400)..(400): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttccaccgtggtgcagtctggagctgagctgacagaagccgtggggcctcgagtgtagtcggtctccgtgcgtagtgtccttcgtgttactnttcctttccacgtacgtatgttaattggttgagacgccggacccggaggacgggtcttaggaggtggagtgggngtggactcgacgtaccgttaaggaactaaagagaagtagaggagtaacgacgtcgaggnaagtatctagtcacgtaccgaccgcgacaaccgtactccgaagtacacgactacgtacgacggtacgtacgtagggaatccgtccgtaagagtaccgttacgaccggaacggaccgtaccgtacgtttaaccgttaacgtttcccgcggaccggtagtaacggtacgttagttacggttccacgttacggttaccgtccgtagtccggttaaccgtaccgcggttcggttacggacggtaccgg

SEQ ID NO: 30212 - DNA, 801 bp, Homo sapiens
  misc_feature: GYAE6OF02IJ2CE.1.49.E05.1.454.CMB.1.raw
  modified_base (209)..(209): a, c, t, g, unknown or other
  misc_feature (209)..(209): n is a, c, g, or t
  modified_base (243)..(243): a, c, t, g, unknown or other
  misc_feature (243)..(243): n is a, c, g, or t
tcagacgagtgcgtcacgaccggtgctcgatttagagcgactagcaaacacaccaaaggggacccaaaaaaccacaccccctccttgggagaatcccctaggatcacagctcctcaccatggacgggacctcggagcatcctttcttggtggcaggcagcaacaggtcgcccactcccaggttaccaccgtggtgacagtccgtggacnctgacgctgcagaacgccgtacggggcctgacgngtagtcggtctccgtgccgtagtcgtcttacgttcgtacttacttccgtttacctacgtacgttataacgtagttggtagacgaacgtcgggccccggtaggcggggtacttggaggtcgaggtcgggtacgtggacgtaccgtaaccgtaccgttaaacggaaactaaaacgacgggtaagtaacggttacggaaaggtaaacgtaccgggtttaacgggaacggtaaccgtaaggttacgtaacgtaaccggttaccgtaacctccgggtaaccgaacccgggtaaccacccggtaaacctaccggaaacgtaacgtaacccgtacgacccgttaacggaaacgtacgggacgttaacgggacggtacccgtacaccgtacgtacgtacgtaaccggaccgtaccggtaccgtaccggttacgttacgtaccgtaggtaccgaaccggtacggttaaggaccggtttaaccgaacgttaccggtacgttccgggtaacgggacgttacggtaccgggaccggtaaacccggtaccgtaccgggtacccttacccgg

SEQ ID NO: 30213 - DNA, 916 bp, Homo sapiens
  misc_feature: GYAE6OF02GVIAF.1.49.E05.1.454.CMB.1.raw
  modified_base (219)..(219): a, c, t, g, unknown or other
  misc_feature (219)..(219): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctnacgtgatggtctcctgcagtgcttctggttacattcttttccacctacggtatcgtaattggttgagacgacggcccccggagacgggggtcttaggaggtcggtaagtggggtactgggattccgaacggtacccgttaacgggaaaccttaaaaacgacggtaacgtaacgttagggacgtaaggaacggtttaccgaaggggaccgaaggtaacggttacgaacgttacgaacgttaccgaacccgggaccgggtaaccgtaaaccgtaaccgtttaccccgaaaccgggtaaacgggtttaaacccgaaaccgggtacccgggttaaacccgtaaacgggtttaacggggtaaaaccggttttaaccggggaaacggggttaaaccgggtaaccccgttaaccggtaaacggtaaccggttaaccgtttaaccgggaaacccgggttaacccgaaacccggggggttaccccttaaaaccggtttttaaccgtttaaacccggttaccggtaacccggggttaaccgggtaaccgggttaaacgggttaaacggttttaacggtttaaccggtaaccggttaacccggttaccgggtttaaccccgttacggggttaacccggtttaaccgggttaaaccccggttaccggggttaaccggttttacgggttacccggggtttaacccccggg

SEQ ID NO: 30214 - DNA, 671 bp, Homo sapiens
  misc_feature: GYAE6OF02GFDH7.1.49.E05.1.454.CMB.1.raw
  modified_base (342)..(342): a, c, t, g, unknown or other
  misc_feature (342)..(342): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttccacctggtgcagtctggatctgagctgcagaagccgtggggcctgacgtgatggtctcctgcgtagtgtacttcgtgttactacttctttcccacgttacgtatgtattggttgacgacgaccggtaccccggaggacgggtcgttggacgttgggagtcggggngtaggagtacctacggtacccgttaacggaaactaaaagacgtagtagtagggaagtaggaacgttaccggagggtaccaggtactcgtaagtcgaacgtacccgaccggtacggaccacgtacgaacccgtacggaacgtaaccgtacgtaccgtaacgtacgtaaggtaaccgtcgggaacgacgtcctacgacgtagtaccgtagaccgtacgacgtaccctaagttactcggtcacggtacgaacgtagtacttacgtcggtacctaccggttcggttcgtacgtttcggtaacttaacccggccttggttaccgcgggtacccg

SEQ ID NO: 30215 - DNA, 604 bp, Homo sapiens
  misc_feature: GYAE6OF02GIBJG.1.49.E05.1.454.CMB.1.raw
  modified_base (245)..(245): a, c, t, g, unknown or other
  misc_feature (245)..(245): n is a, c, g, or t
  modified_base (360)..(360): a, c, t, g, unknown or other
  misc_feature (360)..(360): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactccccaggttcacctggtgcagtctggagctgagctgcagaagcctggggcctcagtgatggtctcctgcagtgcttntggttacatcttttccacctacggtatgtaattggttgagacgacggcccccggaggacggggtcttggagtcggagtgggatggatcagccttaacggaactaaaacagagtanggagagtaagttcgaggcagagtcatcatcaccgcggacacactccaacgagtacacgacctacagtaggaacttggaggacgccctagagtactcgtagaaccgaccgaacgccctaagtttaacttaaccgtacggtaccgacgtaacgagttaatttacgtacgtacctaaccgttcgggttacccgttaggtaccgttaacggtaaaccccgacggttccgttttagggcgggtaacccg

SEQ ID NO: 30216 - DNA, 808 bp, Homo sapiens
  misc_feature: GYAE6OF02J19OQ.1.49.E05.1.454.CMB.1.raw
  modified_base (693)..(693): a, c, t, g, unknown or other
  misc_feature (693)..(693): n is a, c, g, or t
  modified_base (706)..(706): a, c, t, g, unknown or other
  misc_feature (706)..(706): n is a, c, g, or t
  modified_base (756)..(756): a, c, t, g, unknown or other
  misc_feature (756)..(756): n is a, c, g, or t
tcagacgagtgcgtcacgaccggtgctcgatttagagcgactagcaacacaacaaaggggacccaaaaaccacacccctccttgggagaatcccctagatcacagctcctcaccatggacgggacctaggagcatccttttctggtggcagcagcaacaggtgcccactcccaggttcaccgtggtgccagtccgtggacgcgtgagctgcgaagaacgtccgtcgggggcctcgtaggttcaacgttcggttcctccgtgccgtggttcgtccgtttaccgttacgttacgtaactttcctttacccgtaaccgttacggttagttcgtaagttggttaggacgtacggaccgggccccgtagggacggggtcgttacggaggtcggtaagggtggtacggtacgggtacttaccggtaacggtaacccggttaacgggtaaaaccgtaaaaggttaccgggtaaggtacgttaaacgggggtaaccgtaaagggttaaccggtttaccggaaacggggtaccggtaaagttaccgggttaacgttaaacgtcccggtaaacgttaccccggaaccgggttaccggaaaccacgtttaaccggaccgtaaacggtacgtaaccgaacgtccgtaaaggtccgtaagaacgtacggaacgtcgtcgtaacgagtcctacgtaacacggtaccnccggtaaaccgtntttaaccgaacggtcggaaccgtgaaccgtgtaacgttcgaaggtacccnggtccgttccgacgttacgacgtaacccgttcgacgtcggttaccgaccggg

SEQ ID NO: 30217 - DNA, 838 bp, Homo sapiens
  misc_feature: GYAE6OF02HIAO1.1.49.E05.1.454.CMB.1.raw
tcagacgagtgcgtcacgaccggtgctcgatttagagcgactagcaacaccaaggtggacccaaaaaaccacacccctccttgggagaatcccctagatcacagctcctcaccatggacgggacctggagcatccttttctggtggcagcagcaacaggtgcccactcccaggttcacctggtgcagtctggagctgagctgcagaagcctggggcctcgagtcgatggtcctcctgactagtcgtccttcgttcggttaactacgttcctttttacccgaccgttaaccggttatacggtaattgggtttagaacggaccgtaccgggcccccgggaaggtaacgggggtcctttaggtacggttaggaaggttcggggtaggttggtactaccgtacgttaacccgttaacggtaaaaccgtaaaacgaggtaggttaagtacgggaaggtaacggtaacggttaccgaagggtacgaaggtacgtaccgtaactaccgtaacgtacccgtaacccggaccgggtaaacctaaccgtaaccgttacccgaaaccggtaacccggtaacccgttaaccgtaacccgttaacgaacggtttaacggaaacggtttacgggaggtacccggaccgttagaacggtacgttacttaacgggaaccccgtaaacgtaccgggtaacccttagtttaaacccgttaacggttaccggaaccgtacgtaacgggtacggtttaactttacggttacggtaacccttacgggttacggttcccggttacgggtaaccttaccggtaaccgtacggtttccgttaggggtcccggttaacccggg

SEQ ID NO: 30218 - DNA, 674 bp, Homo sapiens
  misc_feature: GYAE6OF02G8OAF.1.49.E05.1.454.CMB.1.raw
  modified_base (496)..(496): a, c, t, g, unknown or other
  misc_feature (496)..(496): n is a, c, g, or t
tcagacgagtgcgtcacgaccggtgctcgatttagagcgactagcaacacacaaaggggacccaaaaaccacacccctccttgggagaatccctagatcacagctcctcaccatggacggacctggagcattccttttcttggtggcagcagcaacaggtgcccacctcccgaggttccaccctggtgccagtcgtggagcgtgagctgacagaagccgtcgggcctcaggtgagtggtcctccgttgcaggtcgttccgttcgttggttactacgtttccttttaccgtaccgtaacggttacgttagtaacgtttggttagagtacgaccgggccccggtaaggtacggggtcgtttcggaggttggtacgtgggtacgtaggtacgtacgtaccggtaccgttaaaccggtaaacgtaaaacgagtaagtagtaggacgtagtaacggtacgagggacaggtaacgtcaacgtcgtaagtccaacggtccganacgtactaccgaacgactacgacgtaccagatagtacgtagacggtacaccgagtagactacgtacggaccgagaccgtaccgtaacttacgttacgacgcgtaacggacgtattacgttgtaccgtgtaccgtacgtccgttagcgttaacgaccgttcgccgttagggtcggaccg

SEQ ID NO: 30219 - DNA, 623 bp, Homo sapiens
  misc_feature: GYAE6OF02JRO6C.1.49.E05.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (247)..(247): a, c, t, g, unknown or other
  misc_feature (247)..(247): n is a, c, g, or t
  modified_base (323)..(323): a, c, t, g, unknown or other
  misc_feature (323)..(323): n is a, c, g, or t
  modified_base (400)..(400): a, c, t, g, unknown or other
  misc_feature (400)..(400): n is a, c, g, or t
  modified_base (527)..(527): a, c, t, g, unknown or other
  misc_feature (527)..(527): n is a, c, g, or t
tcagacgagtgcgtcacgaccggtgctcgatttagagcgactagcaacacacgaaaggggacccaaaaaccacacccctccttgggagaatcccctagatcacagctcctcaccatggacggacctggagcactccttttcgttggtggctagccagctaacaggtcgcccactcccaggttcacctggtgcagtctgganctagcgtgcgngagaccgtcgggcgtccagtgatcggtctcctcgncgcgtcgtctgtacgttactctttcctaccatacgtgtgtagtagtgtcgacgaccggccgtacggaggtgtacgnggacgtgtggggaatgggatcgagtccgtaggaccttaaacgagtacgtagtcggagtagacgtcgaaggtcaggtntacgagtcagtcacgcgactacgacgtaccacgtacgtacaacgtccgtaacgactacggtaacttcggaaggtacgcgtacgacgtacttacgacgacgagtaccgactaccggttaattacgtanaccgtcgaggtacgttacgtactcgtaccggacgttccggtaccgtggttacctacgggtaaccttacccgggacgtttacgggtacgtacccggg

SEQ ID NO: 30220 - DNA, 777 bp, Homo sapiens
  misc_feature: GYAE6OF02H9RQ9.1.49.E05.1.454.CMB.1.raw
tcagacgagtgcgtcacgaccggtgctcgatttagagcgactagcaacaccaaggtggacccaaaaaaccacacccctccttgggagaatcccctagatcacagctcctcaccatggacgggacctggagcatccttttcttggtggcagcagcaacaggtgcccactcccaggttcaccgtggtgcagtctggagctgacgcctggcctaaggaacgccgtgggggcccttcgaggtgagttcggtctcctggaccaggtcgtcttcttgggttactagttccttttaccgtaccgttacggtacttacgtaagtttggtgtacgacgaccggggtacccccggtaaggacgggggtcttaggacggtgggtaggtcgggtaggtacggtacgtaccaacggtcccgttaaacggaaaacgtaaaacggaagtaacggttaacgagggtaaggaaggtaacggtacggaacgggtacaaggtacggtacaacgtaccgtagtccggaacccggtcggaaccacgtaccgtaacccgtaacggaacgtaaccgaacgtacccgtaactaggtaacggtaacgttacgggaggacgcctagacgtatcgtacggtaaccgacggaccggtaacctacgttaacgttccgtacggacggtaaccggtaagtacggttaatttaccggttcggtaacccgttacgggtacgggttccctaacgggtaccgttaacggtaaccccggttacgttccgggtttaccgggtagggtacccggg

SEQ ID NO: 30221 - DNA, 675 bp, Homo sapiens
  misc_feature: GYAE6OF02FJL31.1.49.E05.1.454.CMB.1.raw
tcagacgagtgcgtcacgaccggtgctcgatttagagcgactagcaacgacgacaaagggggacccaaaaaccacaccccctccttgggagaatcccctagatcacagctcctcaccgagtggacggacctggagcatccttttcttggtggcagcagcgaaccaggtgcccactcccgaggttccaccctggtgcgtagtcgtggagcgtgagctgcgagaacgtccgtacggggcctacgagtgagtcggtcctccgtgctagtgtccttcgtagttactcttccgttaccacgttacggtatgtagttggtagacgaccggccggacccggaggtacggtcgttaggtaggtaggtaggtaggtagtcggtactacgtaaccgtacccgtaacgtaaacgtaacgaggtagtagtaggtaacgaaggtacgtacggacggacgtagtactacgactaccgtacgtaccgaccgacgacctacgtaccgtacgacgtacgtacgacacgtagtacgtacgtacgtaggacgtacgcagacgtacgtacgacgaccgaccgaccgtaaccttacgttacgtaccgacggacgacgtagtacgtagtacgtacgtcctacggtcgtaccgttacgtaccgtaccgtaaccggtcgttacggtcggtacggtccgg

SEQ ID NO: 30222 - DNA, 712 bp, Homo sapiens
  misc_feature: GYAE6OF02GB6CA.1.49.E05.1.454.CMB.1.raw
  modified_base (200)..(200): a, c, t, g, unknown or other
  misc_feature (200)..(200): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctganctgcagagccgtggggcctcagtgagttggtctccgtgactaggtcgtctttcgtaggttactactttccttttaccctaccgttacggtattaggtaagttggttagagacgaccgggcccccggaggacggggtcttggtacggtggtagtgggagtggactcgacgtaccgttaacggaaactaaacgagtagtagaggagtagtagtacgaggctagagtacatacgtactcgaccggacgaaccgacacgttacccgaacgtacgtaacccgtacgtaccctaacgagtaaccgggaacgttacgggacggttaaccgccgtaactacgtacgttaccggtacggaaccggtacccggtaccggtaacccgttaaccgtttacttaacgtcggttaccggagggtacgtacggtaatttacggtttacggaaccgttaccggttaccggttcgtcggttacgttaaccggtacccgttacggtccgtttacgggtacggttacccgg

SEQ ID NO: 30223 - DNA, 668 bp, Homo sapiens
  misc_feature: GYAE6OF02IGMSZ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtggggacctcgagtgagttcgggttctccgtgctaggtcgtcttcgtggttaactactttccttttaccaccgttaacggttatgtaatttggttagagaccgtaccgggcccccggtaaggacggggtcctttagggaaggttggaggttcggggtagtaggacgtaccgtacggtaccccgttaaacggtaaaaccgtaaaacgaggtacgttagagggagtaaggtacgttaccggaagggacaggtacgtacatccgagtaccaccggacgacacgacgtaccgacgtaacgacacgtacctacgagtacggaactacggagtaccgtacctacgacgtacgtcgtacgaaccgaccgaccggtacttacgtttaacttacgcggacgacgagtagtatttacgtgactacgtgtccgtagtcctacgtaacctcgtcgttggtcgaccgg

SEQ ID NO: 30224 - DNA, 715 bp, Homo sapiens
  misc_feature: GYAE6OF02G6060.1.49.E05.1.454.CMB.1.raw
  modified_base (184)..(184): a, c, t, g, unknown or other
  misc_feature (184)..(184): n is a, c, g, or t
  modified_base (200)..(200): a, c, t, g, unknown or other
  misc_feature (200)..(200): n is a, c, g, or t
  modified_base (246)..(246): a, c, t, g, unknown or other
  misc_feature (246)..(246): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttctgggtggcagcagcaacaggtgcccactcccaggttcaccgtggngcagtctggacgctgngcctggcagacgccgtgggccctgagtcgatcggtccaccgtgacngttgtccttctggttacattcctttccaccgtacgtatagtaagtttcggtagacgtaccgacggtacccccgggaagggtcggggtacgttacgggtaggtacgggaggttcgggtagtacgggacgttaccgtaccggtacccgttaaacgggtaaaaccgtaaaacgtagggtaacgttaacggtagggaaggtaaggttaaccggttaccggaggtacgaaggtacgtacgaatacgtactaccggacgtacgacgtactacaccgtacgtagaacacgtactacgacgtacgtaacgtaggacgtccggacctcgatctcggtacgaccggaacaccgggtacctaacgttacgtaccggtacggtaccgtacgaaggttccttaagtttacgtacggttacgtccggttaccggtcgtaggttccgtacgttacgaccggtttaggttggtaccggtaaccgg

SEQ ID NO: 30225 - DNA, 708 bp, Homo sapiens
  misc_feature: GYAE6OF02GWWB4.1.49.E05.1.454.CMB.1.raw
  modified_base (189)..(189): a, c, t, g, unknown or other
  misc_feature (189)..(189): n is a, c, g, or t
  modified_base (630)..(630): a, c, t, g, unknown or other
  misc_feature (630)..(630): n is a, c, g, or t
  modified_base (649)..(649): a, c, t, g, unknown or other
  misc_feature (649)..(649): n is a, c, g, or t
  modified_base (654)..(654): a, c, t, g, unknown or other
  misc_feature (654)..(654): n is a, c, g, or t
  modified_base (699)..(699): a, c, t, g, unknown or other
  misc_feature (699)..(699): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactccctaggttccaccgtggtncagtctggagctgagctgccagacgccgtggggcctcagtgatcggtctccgtgcgagttcgtcgttcgttaggttactacttttccttttaccgtaacccgttaaggtagtagttaagttgggttacgacgtaccggtacccgggaccccccgggtaagggtacggggtcgttacgggtaggtagggacggttagggaagtcggtacgttacgaaccggttacccgttaaaccggtaaaaccttaaaaacggacggtaagttaggagggtaacggtaacgtaacggttacggagggacgtaagtacgtactactacgactccgaccggcgtacacgacgtaccgagtacgaccacgacgtaagacggtaggaaccgtaggtacggactccgtataacgctacgtacgaaccgtacgaaccgtacttaacttaccgttacncggtcgaagagagttagtntacgngtaccgtcgtacgtccggtataccggttacaccggtgttacgggnggtacccgg

SEQ ID NO: 30226 - DNA, 836 bp, Homo sapiens
  misc_feature: GYAE6OF02GNYBQ.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcactccttttcttggtgcagcagcaacaggtgccccactcccgtaggttccaccgttgggtcgaccgtaaggtcccttgggaacgccgtagtaggccttcggacggtaacgaaacgggtcccgtcgggggcccttacgaggtacgtagttcgggttcctaccgttggcgtacgggttcgtacccgtttgttaacgggttaccttaccgtttcctttaccccgtaccgttacggttatacggttagttaggttagacggtacgaccgggtaccccggaggacggggttccgttaagggacggttaggtaggttacggggacgttagggtacgtaccggtaccgggttacccggttaaaccgggtaaaccgttaaaaaccgtagggttaacggttaacggtaaggggtaaccggtaaggtaaccggtttacggaacgggtaacgtacggtacgtactacgtacgacgttccggaaccgacggacctaccgtaacgaccgtacgtaacggtaacctacgtaaccgtagacggttaacggagttacggacggttaacgccgtacgagtactacgcgaaccggtaccaccggtactacgttactacgtacgacggtacgtagtacttacgtacgttaccggactaccgtcgggttcccgttaggacccggtttacggacccttaagggtccggttcggtaacggtcccggg

SEQ ID NO: 30227 - DNA, 742 bp, Homo sapiens
  misc_feature: GYAE6OF02JJR0W.1.49.E05.1.454.CMB.1.raw
  modified_base (602)..(602): a, c, t, g, unknown or other
  misc_feature (602)..(602): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctacgcgtgagtggtcctcctacgcaggtgcttcgtaggttacagttctttccgaaccttacggtatacgagtttgggttgtacgacacggccccggaaggtacggggtacttgacggtaggacggtacgggtaagtcggaacgtacgtaacggccccgtttaaacggaaactaaaaccggagtaacgttaaggtagggaacggtaacggtaacggtttaccggaacgggttacgaacggtaacggtacaaccggttactaaccgtacggaacccgggaccgtaaacgaaccgttaacctaaccgtaacgggtaacgtaaccgtacggtacccgaacgtaaccgtacgggttaaacgtacggtaacgggtacgtaccccggtanaaacggttacgtctaacggtacgaacccgacggtaaccctagtttaacctacgtcgaccggacgtaacgatacgttagtacgtcgacgttccggtacgtcggcctacggttaaccctaggttacgtacggtacgtaccgg

SEQ ID NO: 30228 - DNA, 733 bp, Homo sapiens
  misc_feature: GYAE6OF02G43ND.1.49.E05.1.454.CMB.1.raw
  modified_base (244)..(244): a, c, t, g, unknown or other
  misc_feature (244)..(244): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcaccgtggtcgcagtcgtggagctgagctgcagaagccgtgggcctcgagtgagtgtctccgtgcgngtcgctttcgtggttactacttctttcccaccgttacgtatgtaagtttggtgacgtacgaccgggccccggaggagggtccgtggtacggtagggaggtcgggtagtaggacgttcgtaccgtacccgttaaacgggtaaactaaaacgtaggtaagttaaggtaacgggtagaacgtaacggttaccgaggggccgtaaggtacgtagtactacgtaaccgtccgaaccgtacggaacctacgtaaccgtaccgaacgaacgttaacgaacgtacccgtaaacgtaacggtacggtaaacgtacggtaacggtacccgaccgttagaacgtcgtacccggtagaaccggtaaccggtacccggtaaccgtttaactttaaccgtttaacgaccggtacggtaacgaggttactagtttaacgtcgtcgtaccggttcggtaccgtggtaccttcgaaaccgttccggtcgttaggtcggtacccggg

SEQ ID NO: 30229 - DNA, 948 bp, Homo sapiens
  misc_feature: GYAE6OF02JCA9B.1.49.E05.1.454.CMB.1.raw
  modified_base (279)..(279): a, c, t, g, unknown or other
  misc_feature (279)..(279): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttctggtaggcagcagcaacaggtgcccactcccaggttcacctggtgcagtctggagctgagctggctagaagccgtaggggcctacgagtgagtggtcctcctgactggtgtcttcgtggttacattctttccactcgtancgtagttgtcgagtaccgacgggccccggaggacgggggtcttacggtagggtggtacggtagggtacgtggaacgtccgtaaccgttacccggttaacggtaaaccgtaaaacgtaacgggtaaggttaacggtaacgggtaaaggtaacggtaaccggtttaccggaacggggtaaccctaagggttacggtaccttaacgttaaccgtaacggtacccggtaacccggcggggtaaaccctaaccggtaacccttaacccggaaaccgggtaacgttaacccggtaacccggtaacccttaaccgggtaacgttaacccggggtaacgttaacggggtaacgggtacccgtaccggttaccggaaacgtccgttaacccggttaacgggaaaccccgggttaccggtaaaccccgggggtaaccccttttaaaacgttaaccgggttttttaaaacccggccccgggttaaccgggtaaacccgggttaacggtttaccgggtttaaaccgttttaccggttaccggttaaaccccgtttaccgggttacccggggttaaccccggttttaccgggtaaacccccggttttaacccgggttaaacccccggtttaaacccgttcccgggggttttaaccggtacccggggggtttaaacccccggg

SEQ ID NO: 30230 - DNA, 824 bp, Homo sapiens
  misc_feature: GYAE6OF02JORF8.1.49.E05.1.454.CMB.1.raw
  modified_base (197)..(197): a, c, t, g, unknown or other
  misc_feature (197)..(197): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccacctcccgaggttcacctggtgcagtctgganctgagctgcagagtccgtgggcctcgagtggagtggtctacctgacgagttgccttcgttggttactactttccttttaccgaccgttacggttataggtaactttgggtagaacggtacgaccggggacccccggtaagggcggggttaccttagggtacggttaggggtaaggttcggggtaaacgttcgggtacgttaccggtaaccggttaccccgtttaaaaccggggtaaaaccgtaaaacgtacggtaaaccgttaggttaacgggtaaggtaacggttaacggttaccgggaaacggggtactaacggtacggtaacctacggtaacctaaccggttaccgaacccggacggtaactaaacgtaccgtacccggaaagtacggtacgacgtaaccgtaactacggtacgttaacggagtaaccggtaccggttccaacgtagacggttaccgtaacgtaccggaaaccgaccggttaaccttacccgttaagttaccggtacgacccggtgggtaaacccgtgtttaaaccgttcgtacgggtaaccgtttaccggtacgggttaccgtcgtaacggttaacgtacccgttggtacccgggttggtaccggtaacccgg

SEQ ID NO: 30231 - DNA, 757 bp, Homo sapiens
  misc_feature: GYAE6OF02F6B1P.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccgactcccaggttcacctggtgcagtctggagctgagctgcagtaagccgtgggcctcagtgatcggtctccgtgcagtcgcttctaggttactattccgttttacccaccgttaccggttatcgtaagttggttagacgtacgacgggaccccggaggacgggggtccgttggacggttaggaggtcgggtagtacggtacgtcgtaccgtacccgttaaacggaaactaaaacgagtaacgttagtagggaacggaagtacgttacggacgggacgtacggtagtacgtaagttacaacgtaccgaacccggacggtaccaacgtaacgtaccgaaccgtaaacggtaccgtaaccggtaccctaactaaggtaacgggtaacctacggggtaacggaccgtaaccgtacgtaaagtcttaaccgtaggaacccgtaccggtaaccggtaccccttaacgtttaccgtttaccgagtccgggtaacgtaaggtacgtttaacgtttagttaaccggaccgttacggttacccggttagtaaccggttacacggttaaaccgtccggtaacggttcggacggtaacccggg

SEQ ID NO: 30232 - DNA, 754 bp, Homo sapiens
  misc_feature: GYAE6OF02GHM95.1.49.E05.1.454.CMB.1.raw
  modified_base (239)..(239): a, c, t, g, unknown or other
  misc_feature (239)..(239): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttccacctggtgcagtctggagctgagctgcagagccgtgggctcagtgatgtctcctgcaggtncttctgttacacgttctttccaccgttagtatagtattggtgagacgacggccccggtagagggtccgttggaggtggtatgggtagtggagtcgacgtaccccgttaacggaaaacgtaaaccgaggtaacgtagtagggaacgtaagtacggtaccggaaggcgtaagtagaccgtaagtcctaagtccgaacccggcgtaacgaacctacgtaccgaaaccgtacggtaactaacgtacccgtaagtaccgggtacggttaaacggtagggtaacgggttaccgtaacccgttacggtaaacgtaaccgtttccgtaacccggggaaaccaacccggtaaacccgggtaccctttaaacgtttttaccgtttaacccggacggttccggaacgggtaaacggtacggttaaacgttttacgggaccgtttaggacccggttcccggttcggttaaccggttccgtaaacttaacccggttagttccccggtttagggtacggttacccgggg

SEQ ID NO: 30233 - DNA, 715 bp, Homo sapiens
  misc_feature: GYAE6OF02G99YR.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtgggcctcagtgatcggtcctccgtgactaggtcgctttcgtcggtttacacgtttccttttccaccgttacgttacgtagtaagtttggttagacgtacgaccgggtccccggtaggtacggggtcgttaggaggttcggaggtcgggtagtgggactcgacgtaccgttaacggaaactaaacgagtacgtagtagggagtaacgtaacgtacggaagggacgtaaggtacgtactacgtactaacgtaccgaacccgggacgaacctaccgtaacgtaacccgtaacgtaacgtaaccgacgtaccttaacgacggtacggaacgttacgggacggtacaccgttagacgtagtaccgacgaaccgtaccgtacgtacgttaacttacgtacgtacgacggtacgaagtacgttagttacggtcgtaccgttacgggttcgtacccggttggtacccgttaaccgtaaccgtccgtttcggttacggtacgggtaccgg

SEQ ID NO: 30234 - DNA, 918 bp, Homo sapiens
  misc_feature: GYAE6OF02GIMR9.1.49.E05.1.454.CMB.1.raw
  modified_base (226)..(226): a, c, t, g, unknown or other
  misc_feature (226)..(226): n is a, c, g, or t
tcagacgagtgcgtcacgaccggtgctcgatttagagcgactagcaacacacaaaggggacccaaaaaccacacccctccttgggagaatcccctagatcacagcctcctacaccagtcgggaccggacctggacgctattcctttttcgttgggtcggacagcagacaacgaggtcgacccaccgtaccctaggttccaccgttggtcgctacgtcgtaggtacnctggagctacggacgtaaacggaaccggtccgggtacggggtacctacgaggttaggaacggttcggttacctaccgtacggtacgtcgggttcttcgttagttacggttaaccttaccttttacccgtttacccgtaaccggttacggttaagtacggtttaacggtttcggtaaggtaaccggaaccggtaaccccggggaccccggggtaggggtacgggggttaccgttaggggagggttaagggtacgggtagggtacgttacgggtaacctaccgggtaaccccggtttaacccggtaaaaccggtaaacgtaaaaccggtagggttaacgttaacgggaagggtaacggttaaaggttacccggtagggtaacgggtaacgtacggtaacttacgtacggaaccgttaaccggacccgaaacggtccctaacgtaaccgtacccggtaaccgaacggtaaccgaaccgtacgtaacccgtaacgtaaccggtaacgtacggtaggaaacccgcgtactaacgtaccgtactaccgtacggtaaccgaccgtaccgtaacgttacgttacgtaccgtacggtacggtaagtaagtaccgttaaggttccgtacgaaccggttcggtaaccgttacggtaccgtaaccggttacgtaaccgtcggtacggttcgggacggtcccggg

SEQ ID NO: 30235 - DNA, 830 bp, Homo sapiens
  misc_feature: GYAE6OF02JJ3I0.1.49.E05.1.454.CMB.1.raw
  modified_base (194)..(194): a, c, t, g, unknown or other
  misc_feature (194)..(194): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgccactcccaggttcacctggtgcagtctgganctgagctgcagaagcctgggcctcgagtgatcgggtctccgtgacaggtcgactttcgtaggttactagttccttttaccaccgtaacgttagttcgtaagtttcggttcggaagtaccgaccggggacccccgggaaggtacgggggtccgtttaggacgggttacgggtaacggtgggggtaacgttacgggtactttaccggtaacccggttaaccccggtttaaaccgggtaaaaaccgttaaaaaccggtaagggttaaaccgggttaaacggttacgggggaaacggtaaacgggttaaacggtttacccgggaagggtaaccggtaacgggtaacgtacgtaaccgtaccgtaaccgttacccggtaacccgggtaccgtaaccgtaaccgtaacgttacccgaaacggtacgtaacgtacgtaccgtaacgtacgtaacgggtacgtacggtacggacgtcccgtagtacgtacgtacgtacggaaccgtacgaaccggttactaaccgtttacgttaaccgcggttaccgacgtaaggtacgttaaggttacgttaacggccgttaggtaccggttacggtacggttacgtaccgtaacccgttgtaccggttggtaccggtaccgg

SEQ ID NO: 30236 - DNA, 698 bp, Homo sapiens
  misc_feature: GYAE6OF02H8BLG.1.49.E05.1.454.CMB.1.raw
  modified_base (280)..(280): a, c, t, g, unknown or other
  misc_feature (280)..(280): n is a, c, g, or t
tcagacgagtgcgtcacgaccggtgctcgatttagagcgactagcaacacacaaaggggacccaaaaaccacacccctccttgggagaactcccctagatcacagctccctcaccatggacgggacctggagctattctttttcgttggtggcagcagcaacaggtcgcccactcccgaggttcacctggtgcagtcgtggagctgagctgcaggaacgccgtgggcctagaggtgtacgtcggttctcgtgccgtaggttcgtctttcgtaggttactnttcctttacgaccgttacggtactgtagttgttagacgtaccgacggtccccggtaggtacggtgttagacggtggtagttagggatagggtactacgtaccgtacccgtaaacggtaacctaaaacggagtacggtaagacggtaaaggaacggttacggtaccgaggtacgaagtacgtactagacctcgtaccgaccggtacgtaaccgacgtaccgtaccggaacgtacgtacgtaacgtaaccgtacgtaagtacggtaacgtacggtacggtacgtacgtacgacgtacgtacgtacgtactacgtcctaaaaaactcttaacgtacgtacgacgtacgtacgtacgtacgttagtcgtacgtacgtcgttacgtcgtacgtaccgtacgtacggtcgttacggtgtaccgg

SEQ ID NO: 30237 - DNA, 780 bp, Homo sapiens
  misc_feature: GYAE6OF02G6ARP.1.49.E05.1.454.CMB.1.raw
  modified_base (439)..(439): a, c, t, g, unknown or other
  misc_feature (439)..(439): n is a, c, g, or t
  modified_base (577)..(577): a, c, t, g, unknown or other
  misc_feature (577)..(577): n is a, c, g, or t
  modified_base (691)..(691): a, c, t, g, unknown or other
  misc_feature (691)..(691): n is a, c, g, or t
tcagacgagtgcgtcacgaccggtgctcgatttagagcgactagcaacacacaaaggggacccaaaaaccacacccctccttgggagaatcccctagatcacagctcctcaccatgggacgggtacctggagctacttccttttcttgggtggcagcagacaacgaggtcgcccacctccgacggttcaccgtggtacgcgtagttcgtggagctggacgtccgtagacgaacggacggccggttcggggccctcggaggttcgagttccggtaccttccgtagcgtacggttcgtacgtttacggtacggttaactaccgtttccgtttacccgtaacggttacggttattaggttacggtttaggtacggaacgtaccggtacccgggaccccggggtaggtacgggggtcttacgggtggttacggaggtaacggnggttacgacgttcgaaccggttacccgttaaaacgaactaaacggtggtacggtaagtcgggtaaagtacggtacggtccgggtaagacggagtcgtaagactcgacgtaccgacccggtagactacgacgtaccganacggtaactacgcgtaaacaggttacgaaggtcgagtaccgtacacgtagtacgtaccgaggaaccgtaccggtaccgtactaaccgtttcacggttacggccgtagaacgttnttaacgttaggacgtaccggttacgtaccggttaccgtgttacccggtaccgtaaccggtcggtttaaccggttcggacggtacccggg

SEQ ID NO: 30238 - DNA, 655 bp, Homo sapiens
  misc_feature: GYAE6OF02HA90X.1.49.E05.1.454.CMB.1.raw
  modified_base (401)..(401): a, c, t, g, unknown or other
  misc_feature (401)..(401): n is a, c, g, or t
  modified_base (484)..(484): a, c, t, g, unknown or other
  misc_feature (484)..(484): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatcctttcttggtggtagcagcaacaggtgcccactcccaggttcacctggtgcagtctggagctgagctgcagaagccgtggggcctcagtgatggtctcctgcagtgcttctggttacattctttccactacggtatgtaattggtgagacgacggcccccggaggacggggtcgttggaggtggtaggtgggagtggagtcgacgtacccgttaacggaaactaaacgagtaagtagtaggagagtaacgtccgagggcagacgtanagtacactcgaccgacgacctacactacccgaacgaagtaccgacgtaccacgtagtacggaactagggaacggaccgtccgngaacgtacgtacgttacggaacccgtaccgtaaccggtcctaaagttttaccttaacgtcgaccggaacgaagtagttactttacgtacggtacgtaccggttcggttaccgtcgggtaccgttacgttaacccggacgttcggtttacgggtaccggacgtacccggggg

SEQ ID NO: 30239 - DNA, 673 bp, Homo sapiens
  misc_feature: GYAE6OF02HGIUS.1.49.E05.1.454.CMB.1.raw
  modified_base (407)..(407): a, c, t, g, unknown or other
  misc_feature (407)..(407): n is a, c, g, or t
  modified_base (419)..(419): a, c, t, g, unknown or other
  misc_feature (419)..(419): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttccactggtgcagtcgtggagctagagctgacagacgccgtgggcctcagtgagtggttctaccgtgctagtcgtccttcgtcggttacacgtttccgttttacccaccgttacggtattcggtaagtttggttagacgtacgaccgggtacccccggtaggtacgggggtcttagggagtcgggacgtgggtagttgggactacgacgtacccgttacggaactaaacgngtagtagagganagtacgtacgaggacagtgtacataccagtaccgaccgtacggactacggtactacccgacggtaacgtaccaacgtacccgtaagacgtaacggtaacgtgggaaccggtacgtaccgtacgacgtacgtacgtcgaaccgccgtaaccggtaccttagtttactaccgtcggaaccgtgaaggtcgtaatttcgcggtacctcggtcggttccctggtacctcgttaaccgcggttcttcggcggtacccgg

SEQ ID NO: 30240 - DNA, 839 bp, Homo sapiens
  misc_feature: GYAE6OF02I73EB.1.49.E05.1.454.CMB.1.raw
  modified_base (197)..(197): a, c, t, g, unknown or other
  misc_feature (197)..(197): n is a, c, g, or t
tcagacgagtgcgtcacgaccggtgctcgatttagagcgactagcaacacacaaaggggacccaaaaaccacacccctccttgggagaactcccctagatcacagctcctcaccatggacggacctggagcatccttttcgtggtggcagcagcaacaggtcgcccactcccaggttcacctggtgcagtctggacnctggacgctgcgacgaagccggtgggaccctgaggtagacgttcggttcctcccgtggacctaggtcgttcccgtttagttcggttacttacgtttaccgttttacccaacccgttaggtactaggttaaggtttcggtacgtaccgacggtaacccgggtacccccgggtaggtaacggggtccgttaggtacggtacggtaggtaccggtaaggtaccggtactaccgtaacgtaacccgttaaaccgaaaacgtaaaacgtacggagttaacgagggtaacgaaggtacgtacgaggacgaacgtacgtacaactcgaacgtaccgaaccggtacaaaccgtacgaccggtaaccgacgtaaacggtaccgtaacaccgttaaacgacgtaacggaacggttaacggacggtaaaccgtcccggtaactaaacgtcgttaaccgaacggttacggaaaccccgaccggtttaaccttaacggttaaaccttcggaaccgtaaccgggtagaacgggttaactttacgtaacccggtcgttaaacccggtcgggttaaccgttaccggggtttcgtaaacccgggttacggtttaaacccgttcccgggttaacggttcccgggttccggggtaacccgg

SEQ ID NO: 30241 - DNA, 774 bp, Homo sapiens
  misc_feature: GYAE6OF02HGOME.1.49.E05.1.454.CMB.1.raw
  modified_base (369)..(369): a, c, t, g, unknown or other
  misc_feature (369)..(369): n is a, c, g, or t
  modified_base (589)..(589): a, c, t, g, unknown or other
  misc_feature (589)..(589): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtcgcccactccctaggttccaccgtggtcgctagtcgtgggacgctagagctggacagaacgccgtggggcctcgagtcgtagtcggttcctccgtgcgagttcgtctttcgttacggttactacgtttccctttaccgaaccgttacggtatagttaaggttcggttagacgtaccgaccgggtaccccgggtagggaccggggttnttacggtacgggtaggtacggtgggtacgtaggtactccgaacggttacccggttaaacggaaaaccgtaaacggtacgtaaggtaagacgggtaacgtaacgggtaccgttacgggaacggtccgaaggtaccgtactaccggttacaacggtacccgtaccgggacgtaaccctaacgtaccggtaccgtaacggaacgtacccgaacgttccgtaanacggtacgggaacgtgggtaacgccgtaccgacgtacggttctacggtacggtaaccggaccgtaccggtaaccttacgtttaaccgttcgacgtacggacgtaggttacgttaatttcgacgtaccgtacgtcggttacgtcggtccgttaacggtacccggtgtaccggttggcggtaccggg

SEQ ID NO: 30242 - DNA, 782 bp, Homo sapiens
  misc_feature: GYAE6OF02JK84B.1.49.E05.1.454.CMB.1.raw
  modified_base (185)..(185): a, c, t, g, unknown or other
  misc_feature (185)..(185): n is a, c, g, or t
  modified_base (195)..(195): a, c, t, g, unknown or other
  misc_feature (195)..(195): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtncagtctgganctgagctgcagacgctggggcctcgagtgatggtctccgtgcgagtgtcttcgtaggttactattcctttttacccgaccgttacggttacgttgtaagtttcgggttaggagtaaccgtaccgggaccccccggtagggacgggggtccgttggaaggtagggagtacggggtagtaggacttcgaccggtacccgttaacggtaaactaaaacgagtagtaacgtaggggtagtaacggtaacggttcggaacgggtacaaggtacgtacaagtacacgtaccgtacccggacggtaaccgtactaacgtacccgaacggtaacggtaccgtaaaccgtaccgtaagaacggttacggaaaccggttcgggtaaaccgggtcgtacccgtacgtagtaaccgttcgacggtacccggaaccgtaccgggtacccttaacgtttaccttacggacggtaccggtacgtacggtagttacggttacttacggtaccgttaccggttaccgggttaccggttaccggtacccgttaccggttaaacccgttcccgggttaggttaccggggtaccgggttaccccggg

SEQ ID NO: 30243 - DNA, 802 bp, Homo sapiens
  misc_feature: GYAE6OF02H4KR7.1.49.E05.1.454.CMB.1.raw
  modified_base (204)..(204): a, c, t, g, unknown or other
  misc_feature (204)..(204): n is a, c, g, or t
tcagacgagtgcgtcacgaccggtgctcgatttagagcgactagcaacacacaaaggggacccaaaaaccacacccctccttgggagaatccctagatcacagctcctcaccagtgggacgggacctggagcatccttttcttgggtgcagcagcaacaggtcgcccactcccaggttcacctgggtgcacgtctaggagctgngtacgtgacaagtaacggccggtgggggcctacgagttgggacgtcggtctccgtgtacgtaagttcgactttacgtcggttaacttactttccgttttaccaccggttaacggttagtagtaacggtttcggttaggacgtacggaccgggtaaccccgggaggacggggtcgtaggtacgggttacgagggtaggtaggtaggtagtaccgtacggtaaccggttaaaccgggtaaaccttaaaacggtacggttaaaggtagtaacggggaaggtttaaacgggtacggttaacggacgggaacgtaagtacggtaacgaacgttaacgttacgaacgaaccccgggtacgaaccgacgttaacgaaccccggaaggtaaccgtaaacctacggtaccgttaacgtaacggtaacggtaacggacggtacggaccgtacttacggacgtaacgtaccgtacgaacggacctaacccgggaacttaacctttagtaccggagtcgaggttaacgtaggtttaaactgtctacgtaccggttggtaccctgggttacgtaaccgtaccggtaggtttacgttagggtacgacccggg

SEQ ID NO: 30244 - DNA, 792 bp, Homo sapiens
  misc_feature: GYAE6OF02ILCWP.1.49.E05.1.454.CMB.1.raw
tcagacgagtgcgtcacgaccggtgctcgatttagagcgactagcaacacacaaaggggacccaaaaaaccacaccccctccttgggagaatcccctagatcacagctcctcaccatggacgggacctggagcatcctttcttggtggcagcagcacaggtgcccactcccaggtgcagctggtgcagtcgtggggctgaggtgaagaagccgtgggcctcgagtgaaggtctctgcagtgcttctggtactatccttttccaccgttacggtatagtaattggttagacgacgtaccgggacccccgggtaaggacgggggtcctttaggagggttacgggtaaggtggggaacgtgggtaactacgtacggtaacccccggttaaacgggaaactaaaaacggtacggtaaggttaagtggggaaacgtaaggtaaaccggtttcggaaacgggtaccgaaggttacgtactaagttaccgaactacggaacccgggtacggaacccgtacaacgtacccgaaacggtaccgtaacgacggtaaccctaacgaacgttacggaaaccgtgggaaaccggaccggtacctacgtaaggaactacggtaacggacgaaaccggaccggtacccctaaacgtttaacgttcgacgggtaaccgtaccggtaaagtacgttaagttagttacgtaccgtaacgggtttaccgggtccgttaaggtacccgtttaacgggaacccttacggggttaccttcgggtaccgggtaccggttaggggaaccccggggg

SEQ ID NO: 30245 - DNA, 713 bp, Homo sapiens
  misc_feature: GYAE6OF02HV6JC.1.49.E05.1.454.CMB.1.raw
  modified_base (204)..(204): a, c, t, g, unknown or other
  misc_feature (204)..(204): n is a, c, g, or t
tcagacgagtgcgtcacgaccggtgctcgatttagagcgactagcaacacacaaaggggacccaaaaaaccacacccctcctgggagaatcccctagatcacagctcctcaccatggacgggacctggagcatcctttcttaggtggcagcagcaaacgaggtcgcccacgtcccgtaggttcaccgtggtagcagtcgtaggngctgagtcgtgcagaacgtccgtcgggtcctcagtagagttcggtctccgtgcgagtgtcttcgtgttactacttccttacctacgtacgtagtagtagttggtagacgtaccggtaccggtcccggaggtacgggtacgtaggacggtaggtaggtggtacgtacggtacgtaccgtaccgtaacccgtaaacgtaaaacgtaacgaggtacgtacggtaggacgtacgtaacggtacgaggtactaggtacgtacgtacgtacgtacgtacgaccggacgtaaccactacgtaccgtaacgtacgtaactaccgtaacgtaacgtacgtaggaacgtagggaccgactacgtacgacggtactacgaaccgaaccgtaccgtaaccgtactacgttaccgtacgtcgacgaagtacgttaggtacttacgtaacgtccgttacggttaccgtacccggtagtacgttaccggtaccgttacggtaccggtcgggtaccggtaccggg

SEQ ID NO: 30246 - DNA, 614 bp, Homo sapiens
  misc_feature: GYAE6OF02FVFOV.1.49.E05.1.454.CMB.1.raw
  modified_base (290)..(290): a, c, t, g, unknown or other
  misc_feature (290)..(290): n is a, c, g, or t
  modified_base (385)..(385): a, c, t, g, unknown or other
  misc_feature (385)..(385): n is a, c, g, or t
tcagacgagtgcgtcacgaccggtgctcgatttagagcgactagcaacacacaaaggggacccaaaaaccacaccccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatggtctcctgcagtgcttctggtacattctttcccacttacggtatgtaatttggtgagacncggcccccgggagacggggcttggaggtggagtgggagtggacgtcagtcccttaaggaactaaaacagagtatagggagagaacgttcgacggnagatcaatccagtaccacgtcgaacaccgactccacgagtaccgagaccctagagtcgtaaccgtgacggaacgtccacgagtactacgtacgtaacgaccgtaacgtacctaattaacgttccgtacgtaccgacgtaagtacgttaagttacgttgtaccgtacgtccggttaccgtacggtccgttaaccggtaaccgtaccggtcgtttacggacgggtacccgg

SEQ ID NO: 30247 - DNA, 870 bp, Homo sapiens
  misc_feature: GYAE6OF02F737G.1.49.E05.1.454.CMB.1.raw
  modified_base (320)..(320): a, c, t, g, unknown or other
  misc_feature (320)..(320): n is a, c, g, or t
  modified_base (380)..(380): a, c, t, g, unknown or other
  misc_feature (380)..(380): n is a, c, g, or t
  modified_base (678)..(678): a, c, t, g, unknown or other
  misc_feature (678)..(678): n is a, c, g, or t
tcagacgagtgcgtcacgaccggtgctcgatttagagcgactagcaacgacacaaaggggacccaaaaaaccacacccctccttgggagaactcccgtagatcacagctcctcgaccatgggaaccgggccttaggacgtctacgttccctttttacgttgggtaggctacggccaaggaccaaacgtaggggtcgaccccgtaactccccgtaggttacctacccgtggtcggccgtacggtcgttacgggagtcgttacgaacgtccgtggaccgtaaggacgtccggtcggggcctacgtagtcgagtcgtctaccnggctgtcgtcttcgtacgtactctttccgttaccacggttagtagtacgtagttggtacncggaaccgacgggtaccccggagggtaccggggtacttacgggacggtgggacggtgggtacgtcgggtacctccggtaaccggttaaacccgttaaaccgggtaaaactaaacggtggtaacggttagtaccgggtaaagtcggtaaacggtaccgtacgggtaactacgggtactccgtaacgttaaccaaccgggacccggtaccggaaccgtaaaccgaccgtaccgttaccggaacgtaaacgagtaccgtacgaacgttacgtaacggtaaacgtcggtaaccgggttaccnccgtaaacgtacctaccgttacgtaaccgggtaacgaccgttaacgtaccgtttaaactccggttacgtaccggtaacgacgggtaacgttacgttaagttccgtaaccggtaccgtagttaccgggttaccgtaccgggttaaccttaacccggtaacgttacccggttcggtaccggggtccgtaccggg

SEQ ID NO: 30248 - DNA, 680 bp, Homo sapiens
  misc_feature: GYAE6OF02H4XW9.1.49.E05.1.454.CMB.1.raw
  modified_base (247)..(247): a, c, t, g, unknown or other
  misc_feature (247)..(247): n is a, c, g, or t
  modified_base (351)..(351): a, c, t, g, unknown or other
  misc_feature (351)..(351): n is a, c, g, or t
  modified_base (537)..(537): a, c, t, g, unknown or other
  misc_feature (537)..(537): n is a, c, g, or t
tcagacgagtgcgtcacgaccggtgctcgatttagagcgactagcaacaccgaaggtggacccaaaaaaccacacccctccttgggagaatcccctagatcacagctcctcaccatggacgggacctggagctatcctttttcttgggtggcagcagcaaacaggtcgcccactcccaaggtttcaccgtggtgcagtcgtggagctggcgctagcgagaagccgtggggcctgagttgagtcgtcnccgtgcctagtcggtcttctggttactattccttttaccaacgtaggtactagtagttggttagagtacgacggaccccgggaggacgggtctgaggtggaagngggtagtagtcgtacgaacggtcccttaacggaaactaaaacgtagaacgttagtacgggataacggtaacggtccggaaggtaccaggtacgtactaacgtacaacgccgaaccggaccgaacgaacctataccccgaaagtaacgtaacgacgtactaacgagttaacgagtacggagaccgtnaacagtaacgtacgacgaaccgacgacccggacttaacgtatttaccgaaggcgacgtagagttattacggataccgttacgtaggttcccgtaacggttacgttaacgtaacccggtaggttcgttacggtacgggtaccgg

SEQ ID NO: 30249 - DNA, 651 bp, Homo sapiens
  misc_feature: GYAE6OF02FKT79.1.49.E05.1.454.CMB.1.raw
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgagtggtctctgcagtgcttctggttacatctttccactacggtatcgtaattggtgagacgacggcccccggaggtacggggcgttgaggtggagtgggagtggagtcgacgtacccgttaacggtaaacgtaaaacgacggtaagtagtacgggaggtacgaacgttaccggaagggcgaggaagtacgactactacgtaccgtaccggcggaaccaacgactaccgaacgtacggtaaccgacgtaccgtacgaacgtacggtaacgtaggacggtacgaccgtcgaacgtacttacgtacgacgtaaccgaccgggtacctaacgtttaacttcgtacggccgtacgaagtagtagttacgtcgagtaccgtacggttaccgtcggtcgtacggtaacccgtcgtcgttcggtcgggtacccgg

SEQ ID NO: 30250 - DNA, 772 bp, Homo sapiens
  misc_feature: GYAE6OF02HUPMA.1.49.E05.1.454.CMB.1.raw
  modified_base (210)..(210): a, c, t, g, unknown or other
  misc_feature (210)..(210): n is a, c, g, or t
  modified_base (479)..(479): a, c, t, g, unknown or other
  misc_feature (479)..(479): n is a, c, g, or t
  modified_base (488)..(488): a, c, t, g, unknown or other
  misc_feature (488)..(488): n is a, c, g, or t
  modified_base (507)..(507): a, c, t, g, unknown or other
  misc_feature (507)..(507): n is a, c, g, or t
tcagacgagtgcgtcacgaccggtgctcgatttagagcgactagcaacacacaaaggggacccaaaaaccacacccctccttggagaactccctagatcacagctcctcacctatgggacggacctggagcacttccttttcgttggtggcagcagcaacaggtcgcccacctcccgtaggttccaccgttggtgctacgtcgtaggganccgttgagtctcgacgaaaggccggtccggtcgggacccttcgaggttcggaacgtttcggggtcctaccggttcggacgttaaggttccgtccttttcggttaacggttacttactttcccgtttcccgtaaccggtacggttagttacggttagttagggttagacggaccggaccggggtccccgggaagggttccgggtatttacggaggttacggaggtcggtacgtacgcgtcgtaaccgtaccgggtaaactaaacggtaanaggtaacgngtaaggacgtagtaaccgngggacgtacgagacgtcgtaacacgtcgtaccgcggtaacgactacgtacgaaccacggtaacacgtaccgacgtaccgtaacgtaacggtaaccggagttaccgaacggtcgtaaccgagtacggacgtacggaccgacccgtacgaccttaaacgttctaccgggtacgtcgaacgtgaacgttcgtaactcccggtaagtccgttccgtacgttaggtacggttaaccgtccggtaccttaggttcccggttaggtcccggg

SEQ ID NO: 30251 - DNA, 1035 bp, Homo sapiens
  misc_feature: GYAE6OF02HNG80.1.49.E05.1.454.CMB.1.raw
  modified_base (128)..(128): a, c, t, g, unknown or other
  misc_feature (128)..(128): n is a, c, g, or t
tcagacgagtgcgtcacgaccggtgctcgatttagagcgactagcaacgacgacaaaggggacccaaaaaccacaccctccttgggagaatccctagatcacagctctcaccatcggacggcctggancatcctttcgttggtggcagcagcaacaggtcgacccactcccgaggttccaccgtggtcgctacggtcgtggacgtctcggacgcgtagccgaaggaccggtccggttacggggcctacgaggtacggtaacgttcgggttaccctaccgtaggtaccgaggtttacgtccgttttacggtacgggtttaacctacttttaccgtttttaacccccgaaaccggtttaaccgggtaacgttacgggtaaaggttttccgggttaggaaacgtacccgggaccccggggtaccccggaagggtaccggggttacctttaggggaacgggttacggtaggtacgggttagtacggtacgtacccgtaacggtaccccgttaaaacggtaaaccgtaaaacgtacggtaagttaacgtcggggtaaacggtaaggttaaccggttaccggggaaacggggtaccgttaacgggtaaaccgttacgtaaaccggaaccggttaccgtttaaacccgggtaaccccggggaccgaaaaccgggtaccctttaacccggtaacccctaaaaccggggtttacgtaaaaccccgcgtaaaccccggtaaagtttaaaccggtacggtaaacccggtaagggtttaccccggaaaacggttttcccaaaacgggtaactaaccgttaccgggtaaacggtaaccggtaaccccgggaaaccgtttccgttaaaccgtttaaccgtttacccggtagggtaaaccccgttaggggaaaggttacgtttaaacgggtttacgtaaccccggtacgttaaccccggggttacggttacccgttaacggggacccttttaaaaccgggcccggttaaaccgggttcgggttaccgggggttaaccgtaaccccggggg

SEQ ID NO: 30252 - DNA, 703 bp, Homo sapiens
  misc_feature: GYAE6OF02FWU70.1.49.E05.1.454.CMB.1.raw
  modified_base (472)..(472): a, c, t, g, unknown or other
  misc_feature (472)..(472): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtcgcccactcccgaggttccaccgtggtcgcgagtctggagctgagctgacagaacgccgtgggcctcgtagtgagttcggtcctccgtgactagtcgtctttcgtacggttactacgttctttaccctaccgttacggtataggtaagttcggttagacgtacggaccgggcccccggtaggtacggggtcgttagacgggttaggagttcggggagtggacgtcgtacgtacccggtaacgtaaactaaacgaggtaagtacgtaggaacgtagtaacgtacggaggtcgaggtactacgactcgtacnccgaaccggcggtacacgtaccgtacgaaccgtagtaaccctacggacccttacggacgtaacggtaaccggtggaaccgtaacgtccgtacgtaacggacttacggacggaaccgacgtaccgtaccgtacgtttacgtacgtcgtcggaagtacgtagttagttacgtacgtcctagggtcgttaccggacgttctaacggtaccctgggttaccgtgggcgtaaccgg

SEQ ID NO: 30253 - DNA, 725 bp, Homo sapiens
  misc_feature: GYAE6OF02F0R1Q.1.49.E05.1.454.CMB.1.raw
  modified_base (329)..(329): a, c, t, g, unknown or other
  misc_feature (329)..(329): n is a, c, g, or t
  modified_base (614)..(614): a, c, t, g, unknown or other
  misc_feature (614)..(614): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttccacctggtgcagtctggagctgagctgcagacgccgtgggcctcgagtgagtcggtcctccgtgcgtagtcgtccttacgttggttactattcctttaccaccgttagtatcgttagttggttagagtacgaccggccccggaggacgggtntaggacggtggtacgtgggacgtaggactacgacgtaccgttaacgtaaacgtaaacaggtacgtagtaggaagtaggtaacgttacggaggacgaagactacgacgtacgacgtaccgacgaccggactaacgacgtaccgaacggtaacgtaacgtaaccgtacctaacggaacgtacgggtaaacgtacgggaaccgaccggtacccgtaggtaacgtaccttacggtaccgtaacccggaccgggtacccgtaaccctttacgtttaaacctccgggtacnccgggttaacgacggttacggttaattaccggttgtcccggtacggttaccggttcccggttacggaccgtaccggtaacccgtcggttacggtttcggaccgggtaccgg

SEQ ID NO: 30254 - DNA, 799 bp, Homo sapiens
  misc_feature: GYAE6OF02JQ8NH.1.49.E05.1.454.CMB.1.raw
  modified_base (154)..(154): a, c, t, g, unknown or other
  misc_feature (154)..(154): n is a, c, g, or t
  modified_base (794)..(794): a, c, t, g, unknown or other
  misc_feature (794)..(794): n is a, c, g, or t
tcagacgagtgcgtcacgaccggtgctcgatttagagcgactagcaacacacaaaggggacccaaaaaccacacccctccttgggagaatcccctagatcacagctcctcaccatggacggacctggagcatcctttctggtgcagcagcaacnggtcgcccactccaggttcacctggtcgtcagtcgtggagtcgtgacgctggacgagaacggccgtcgggggaccttacgtacgggttagtacggttcgggtacccgttccgttacggacgtcggtacgttccgttacgtttacggtttaccaacttttccttttaacccgtacccgttaggttaacgttacgttaacggtttgggtttaggaacggtaccggtaccggggtaccccccgggtaaagggtccggggggttaccgttaggtaacgggttagggtacggttacgggtaacggtacgggttacgttccggtaaccggttaccgttaaccgggaaaaccgtaaaaccgtaaggtacgttaacggtaggaacggtttaaggaacgtttacgggacggacgtaacggtaacgtacggtaccgtacgtaccgaccgtaacccggaacgtaccgtacgtacgtaacgacgtaacgacgtaccgtactaagacggtacgtaagacgggtagtacctacaacggtactacgacgtaccggacgtaccgtaccggaccttacgtaaccgttactcggacgtacgtaggtatagttcggaacgtatcggtacgtcgttgactcggtaccgtacgtgtacggngtcgg

SEQ ID NO: 30255 - DNA, 1135 bp, Homo sapiens
  misc_feature: GYAE6OF02F988I.1.49.E05.1.454.CMB.1.raw
  modified_base (171)..(171): a, c, t, g, unknown or other
  misc_feature (171)..(171): n is a, c, g, or t
  modified_base (1077)..(1077): a, c, t, g, unknown or other
  misc_feature (1077)..(1077): n is a, c, g, or t
tcagacgagtgcgtcacgaccggtgctcgatttagagcgactagcaacgacacgaaaggggacccaaaaaccacacccctccttgggagaatcccctagatcacagctcctcaccagtcggacggacctggagcattccttttcttggggtcggcagccgtagtccaacgnggtcgtacccctacgtcccgtaaggttccaccgtgggtcggactaggttccgtgggtacgtccgttaggagggtccttgggaccgtaaacgggtaaccgcccgggttcggggggtaccccttacgggtaacggttacgtaccgggtttccgggtttcccgtacccggttcgaccggttaggtttccgggttaccctttaccgggttttaacgggttaaaccttccccgttttacccgttttaccccggaacggtttaccgggttaagttacggtttaaacggtttcgggtttacggaacccggtaccgggtaaccccggggggtacccccgggttaaggggtaacggggggtttcccctttttaagggggaaccggggttttagggtaacggggttaccgggttaagggttaccgggtacgttaacccgggtttaacccgggttaaacccggttaaaccggttaaaaaaccggttaaaccgggagggttttaaccggtaaacggttacggggaaaaccggttaacggggttacccggttacccgggaacggggttaacggtaccgttaaacggggtcccttaaacgggttacccgtaacgggtacccccgtaagggtaacccgggaaccttaaaccggtaccgaaacccggggttaaacccgtacgggttaacccgttaaccggaaacccgtttaacggaaccggggttaaaccggttaaacggacggggtaaacccgtttacccggaacgtttaacccggacggttaccggttaacccggaaaccgggtaccctaaccgggtaaccgttaacccgtttaagttacccgtccgtacggtaacccgggtaagtaacgggttaggttaaaccttgaacccggttacggttccgtcccgggttaaacgnggttaaaccctcgggttaccggttaaccgttcggggtttacgaaccgggttacccggg

SEQ ID NO: 30256 - DNA, 264 bp, Homo sapiens
  misc_feature: GYAE6OF02I0J3K.1.49.E05.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (220)..(264): a, c, t, g, unknown or other
  misc_feature (220)..(264): n is a, c, g, or t
tcagacgagtgcgtcacgaccggtgctcgatttagagcgactagcaacacacaaaggggacccaaaaaccacacccctccttgggagaatcccctagatcacagctcctcaccatggacgggacctggagctattccttttcttgggtggcagcagcaacaggtcgcccactcccaggtttccaccgtggtgcagtctggagctgngctgcaganctggnnnnnnnnnnnnnnnnnnnnnnnnnnnnnnnnnnnnnnnnnnnnn

SEQ ID NO: 30257 - DNA, 847 bp, Homo sapiens
  misc_feature: GYAE6OF02IGA89.1.49.E05.1.454.CMB.1.raw
  modified_base (76)..(76): a, c, t, g, unknown or other
  misc_feature (76)..(76): n is a, c, g, or t
  modified_base (154)..(154): a, c, t, g, unknown or other
  misc_feature (154)..(154): n is a, c, g, or t
  modified_base (229)..(229): a, c, t, g, unknown or other
  misc_feature (229)..(229): n is a, c, g, or t
  modified_base (587)..(587): a, c, t, g, unknown or other
  misc_feature (587)..(587): n is a, c, g, or t
  modified_base (763)..(763): a, c, t, g, unknown or other
  misc_feature (763)..(763): n is a, c, g, or t
tcagacgagtgcgtcacgaccggtgctcgatttagagcgactagcaacacgacaaagggacccaaaaccacacccnccttgggagaactcccgtacgatcgacagctcctcacccgagtcgggacggccgtggacgctactccgttttcttggnggtcgagcacgctaaacgcggtcgacctacgttcccgaacggttactaccgtacggtcgtacgacgttcctaggnggtcctggacgtccgtacgcgtaaagaacggttccgcgggtacctgacggtagtacggtcgttaccttcgcggtacctagtcgtcggttactcggttagtactttccgtttaccgtaaccgtagtagttaacggtacggtttacggtaggtacccggaaccggttaccgggaaccccggtacgggtagggtaccgggtttggaggtcgggttaacggaggggtttacgccggtaagttaccggtaacccggtaaccgtttaaaccggaaaacccgttaaaggacttaaaacggggttccgaaggtaaccgtaccggggtaaagtcccggttaaggaccggagtaacccgtttaggtanacccgtccgttaacgtcgggaaccggtaacacgtacctacggtaaccggtaacgtaccgtacgtacgtaaccgtagtacgaacgttacgacgacggtactaacgtacggtacgtagttacggaacgtaccggaacgttaactaccgggtactaacgggttcgaacgtcgtaaccgnttaacgtacgttaacgcgttaccggacggtttacggacgtacggttaccgtaaaccgtcccggtaagttaccggtagtaaccgg

SEQ ID NO: 30258 - DNA, 1002 bp, Homo sapiens
  misc_feature: GYAE6OF02FRFHL.1.49.E05.1.454.CMB.1.raw
tcagacgagtgcgtcacgaccggtgctcgatttagagcgactagcaacacacaaaggggaccaaaaaccacacccctccttgggagaatcccctagatcacagctcctcaccatggacgggacctggagcatccttttcttggtggcagcagcaacaggtcgcccactcccaggttcacctggtgcagtctggagcgtgagctgcgtagaacggtccgtggggcctcgagtgagtcggtcctcctgcgtagtcgtcctttcgttggttaacctactttccgttttacccaccgtttaccggttattacggttaacgtttgggttacgacggtaaccgtacccggggtacccccgggtaagggtacgggggttccgtttaggtacggggttacgggtaggttaggggtaaggttcgggtaacgttaccggaaccgttaccccggtttaaacgggtaaaaccttaaaaacgaacgggttaaggttaacggtaacggggtaaggtaaacgggtaaccgggtttaaccgggtacggggtacgtaaggtacggtaccctaaagttaccgttaacgtaccccggtaacccggtaccggggtaaacctaacccggttaaccggaaaccccgtacgggttaaaaccgttaacccggtaaccgtaaaccccggtttaaaccgtaacccgggttaaccgggttaaaccgggttaccggtaaacggggtacccgtttaacccgtaacccgtaacggttaccgttaaccggttaaccgggaacccgggtaacccgtacccgggttaaccgttaacccggtttttaaccggttaccggttaaccgggtaccggtaaccgtaacggggttacggttaacgttttaaccgggttttccggaaccggtttacccggtttaccggggttaaccccgtttcgggttaacccgtttaccggttaaaccccgggttccgggtttaaccggggttttccgggaacccggggtttaccccgggg

SEQ ID NO: 30259 - DNA, 770 bp, Homo sapiens
  misc_feature: GYAE6OF02G1FHY.1.49.E05.1.454.CMB.1.raw
  modified_base (260)..(260): a, c, t, g, unknown or other
  misc_feature (260)..(260): n is a, c, g, or t
tcagacgagtgcgtcacgaccggtgctcgatttagagcgactagcaacacacaaaaggggacccaaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcgtggggcctcgagtgagtggtcctcgtgctagtgtcttcgtggttacnctttcttttccgaccgttacggttactagtaacgtttgggttaggacgtacggaccggtccccccgggaaggacgggggtcttacggaggttcggaaggttggggacgtgggtagtacacggtcccgtttaacggaaactaaaacgacgtaacgtagtgggaacggaagtaaccggttccggtaaggcgaggaacgtactagtacagttacccgaccgggacggtacccaacgaccgtaccgtaacccggaaggttacccaacgtcccgtaatacgtacggtaaacgtggaaggtacgacccgtacgaacgtagttaccgaggtaaccggacctaccggggtacccttaaccgtttacgttttaaccgacgggtacccgtaaggcggtaacgttacggtttaactccgggtccttaacccgggttgggttaccccgttcgggttacccggtttaaccggtaaacccggttaccggttacccgggttttggggacccggggttaacccggg

SEQ ID NO: 30260 - DNA, 882 bp, Homo sapiens
  misc_feature: GYAE6OF02IFML0.1.49.E05.1.454.CMB.1.raw
  modified_base (144)..(144): a, c, t, g, unknown or other
  misc_feature (144)..(144): n is a, c, g, or t
tcagacgagtgcgtcacgaccggtgctcgatttagagcgactagcaacacacaaaggggacccaaaaaccacacccctccttgggagaactccctagatcacagctcctcaccatgggacggacctggagcatcctttcttggnggcagcagacaacgaggtcgcccaactcccgaaggtttcaccgttgggtcgacgtacggttcgtcgggtacgccgttggaggtcgttcggacgaacggaacggtcccggttaccgggggcccttacggagggttacggtaacgtttcgggtaccttccggtacgcgtacggttacgttccgtttcgttacggtttaacttactttaccgttttaccgtaaccgttaacggttattacgtaacgttttaggttacgaacggtaaccgacgggtaccccgggtaagggtacggggtcgttaggtacgggttaggtaaggtggtagtcgggacgttcgtaaacccgggtacccgtttaaacgggaaaaccttaaaacgtaggtaacgtagtagggtaacgtaaggtaaccggtacggaagggtctaagggtatacaacgttacctaacgtaccggaacccgtagaaccgtacgccgtaaaccgaaacggtaaccggtaacaccggtaactacgaacggttacgaaaccggtgtaaacgggtaaacgcccgttaaccggaagttacctacggacggtaacaacccgggtacgaacccctttagtttaacccaggttaccggaccggtaagtaggtaacggtttaacttagggaccttaaccggtttacgtccgggtttacccgtaggttacccgttaaaccggaccgttaaccgggtttcgtaggggttaccccggtaacgg

SEQ ID NO: 30261 - DNA, 1031 bp, Homo sapiens
  misc_feature: GYAE6OF02G3O5D.1.49.E05.1.454.CMB.1.raw
tcagacgagtgcgtcacgaccggtgctcgattttagagcgactagcaacacacaaaggggacccaaaaaccacacccctccttgggagaatcccctagatcacagctcctcaccagtggacggacctggagcattccttttcttggtggcagcagcaacgaggtcgcccactccccgtaggtttcccaccgttggtcgtcgtagttccgtagggacgtccgttaggacgtccgttaggaccgaaaggtaaaccggtcccggttacgggggcccttacgtacgggttggtacggtttccggttcccttccggttcggtaccgtaggtttaccggtccgttttacgtttacggttaaccttacggttttcccctttttacccggtaacccgtttaacggttaagttacggtttaaggttttacgggttacggtaacggtaacccggttaacccgggttaccccgggggtaagggtaacgggggtttccgtttaagggaaccgggtttaggggttaacggttagggggtaccgtttagggtacccgtttaaccgggacccggtttaaacccggttaaacgggtaaaaacccgtaaaacggttggtaacggtaagtagggggaaactacgggttaacggtcccggagggtaacgaggttaagttaccgtaaagtacccgtaacggttcccggaaccccgggtacggaaaccctaacccgtcgttaaaacccgggaacgtttaaccgggtaaccctaacgtttaaacccgttaacgaacgggtaacggttaaccggtacggaaccgggttaccgaccgtaacggtttcgtaaccgtttccggaaaaccgtcccgtaaaccggtaccggttaaccgtttacctttaaacggtttccgtaacgggtacccgtaagggtacggtttaagttacccgtttagttaaccgggccttaacgggttccggttaccgttaaccggggttctttaaacccgggaaccgtttcggttaccgggtttacggtacccgggttaacggg

SEQ ID NO: 30262 - DNA, 518 bp, Homo sapiens
  misc_feature: GYAE6OF01CFJKR.33.11.A11.1.454.CMB.1.raw
  modified_base (276)..(276): a, c, t, g, unknown or other
  misc_feature (276)..(276): n is a, c, g, or t
  modified_base (426)..(426): a, c, t, g, unknown or other
  misc_feature (426)..(426): n is a, c, g, or t
  modified_base (506)..(506): a, c, t, g, unknown or other
  misc_feature (506)..(506): n is a, c, g, or t
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagcttcgcccgggcagttcccccacactgtgatttatgaagttaaccaaagaccctntggggtccctgatcggttctctggctccgtcgacagctcctccaattctgccttcctcaccatctctggactgaagactgaggacgaggctgtatattactgtcagtcctatgatagaaccacccatgtggtctcgggcggggacagtcngaccgtctgagtcacgcccaaggctcgcccctcggtcactctcgtccccaccctcctcagtgtgtgtactgacggcgggntcggcgaaggcg

SEQ ID NO: 30263 - DNA, 519 bp, Homo sapiens
  misc_feature: GYAE6OF01B3V4T.33.11.A11.1.454.CMB.1.raw
tcagtacacacactcacgaccggtgctcgatttagctacgactgcagggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagcttcgcccgggcagttcccccacactgtgatttatgaagttaaccaaagaccctctggggtccctgatcggttctctggctccgtcgacagctcctccaattctgccttctcaccatctctggactgaagactgaggacgaggctgtatattactgtcagtcctatgatagaaccacccatgtgttcgtcgggcgggggaccagtctgaccgtctgagtcagcccaaggtcctcgcccctcggtcacctctcgttcccgccctccgtcagtgtcgtgtactgacgcgggctggcaggcg

SEQ ID NO: 30264 - DNA, 530 bp, Homo sapiens
  misc_feature: GYAE6OF01D8ACX.33.11.A11.1.454.CMB.1.raw
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagcttcgcccgggcacgttcccccacactgtgatttatgaagttaaccaaagaccctctggggtcctgatcggttctctggctccgtcgacagctcctccaattctgccttcctcaccatctctggactgaagactgaggacgaggctgtatattactgtcagtcctatgaatacgaaccacccagtgtggttcgtcgggcgggggaccagtcgtgaccgtctgagtcacgcccgaaggcctcgcccctcggtccactctcgtccccgccctccgtcagtgtgtgtactcggacggcggcgtggcgaggcg

SEQ ID NO: 30265 - DNA, 550 bp, Homo sapiens
  misc_feature: GYAE6OF01ACDB7.33.11.A11.1.454.CMB.1.raw
  modified_base (178)..(178): a, c, t, g, unknown or other
  misc_feature (178)..(178): n is a, c, g, or t
  modified_base (334)..(334): a, c, t, g, unknown or other
  misc_feature (334)..(334): n is a, c, g, or t
  modified_base (492)..(492): a, c, t, g, unknown or other
  misc_feature (492)..(492): n is a, c, g, or t
tcagtacacacactcacgaccggtgctcgatttagctacgactgcaggggccactgtcttctccactacttctcaccctcctcgctcactgcacaggttcttgggccaattttatactgagtcagccccactctttgtcgggtctccggggaagacggtgagcatatcctgcacccgnagcagtggcagcatcgtcgacaactatgtgcactggtaccagcttcgcccgggcagttcccccacactgtgatttatgaagttaaccaaagaccctcgtggggtccctgatcggttctctggctccgtcgacagctcctccaattctgcccttccncaccatctctggactgaagactggaggacgaggctgtatattactgtcagtcctatgatacgaaccaccagtgtggttcgcgggcggggaccagtctgacccgtctgacgtcgacgccgaaggtcctccgtccccgtcggtcacctcttccgtccccnccctccgtcgtagttcgtcgtacgttacgcggtacggccgggtgtcggcgaagggtcg

SEQ ID NO: 30266 - DNA, 535 bp, Homo sapiens
  misc_feature: GYAE6OF01DLQWA.33.11.A11.1.454.CMB.1.raw
  modified_base (445)..(445): a, c, t, g, unknown or other
  misc_feature (445)..(445): n is a, c, g, or t
  modified_base (490)..(490): a, c, t, g, unknown or other
  misc_feature (490)..(490): n is a, c, g, or t
  modified_base (524)..(524): a, c, t, g, unknown or other
  misc_feature (524)..(524): n is a, c, g, or t
tcagtacacacactcacgaccggtgctcgatttagctacgactgcaggggccactgtcttctccactacttctcaccctcctcgctcactgcacaggttcttgggccaatttttatactgagtcagccccactctttgtcggggtctccggggaagacggtgagcatatcctgcacccgcagcagtggcagcatcgtcgacaactatgtgcactggtaccagcttcgcccgggcagttcccccacactgtgatttatgaagttaaccaaagacccctctggggtccctgatcggttctctggctccgtcgacagctcctccaattctgcccttcctcaccatctctggactgaaagctgaggacgaggctgtatattactgtcagtcctatgatagaaccacccatgtggttcgtcgggcgggggaccagtcgtggccgtcctgngtcagcccgaaggcctcgccccctcggtccactcctcgttccccnccctcctctagtgtcgtgtacgtgtacggcgggntggcgaggccg

SEQ ID NO: 30267 - DNA, 519 bp, Homo sapiens
  misc_feature: GYAE6OF01DVQB6.33.11.A11.1.454.CMB.1.raw
  modified_base (391)..(391): a, c, t, g, unknown or other
  misc_feature (391)..(391): n is a, c, g, or t
  modified_base (490)..(490): a, c, t, g, unknown or other
  misc_feature (490)..(490): n is a, c, g, or t
  modified_base (509)..(509): a, c, t, g, unknown or other
  misc_feature (509)..(509): n is a, c, g, or t
tcagtacacacactcacgaccggtgctcgatttagctacgactgcaggggccactgtcttctccactacttctcaccctcctcgctcactgcacaggttcttgggccaatttttatactgagtcagccccactctttgtcggggtctccggggaagacggtgagcatatcctgcacccgcagcagtggcagcatcgtcgacaactatgtgcactggtaccagcttcgcccgggcacgttcccccacactgtgatttatgaagttaaccaaagaccctctggggtccctgatcggttctctggctccgtcgacagctcctccaattctgccttcctcaccatctctggactgaagactgaggacgaggctgtatattactgtcagtcctatnatagaaccacccatgtggttcgtcgggcggggaccagtctgaccgtctgagtcacgcccaaggctcgcccctcgtcactctcgttccccaccctcctcngtgtgtgtctgacggcggncggcgaggcg

SEQ ID NO: 30268 - DNA, 553 bp, Homo sapiens
  misc_feature: GYAE6OF01EZRLO.33.11.A11.1.454.CMB.1.raw
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
  modified_base (313)..(313): a, c, t, g, unknown or other
  misc_feature (313)..(313): n is a, c, g, or t
tcagtacacacactcacgaccggtgctcgatttagctacgactgcaggggccactgtcttctccactacttctcaccctcctcgctcactgcacaggttcttgggccaatttttatactgagtcagccccactctttgtcggggtctccggggaagacggtgagcatatcctgcacccgcagcagtggcagcatcgtcgacaactatgtgcactggtaccagcttcgcccgggcacgttcccccacactgtgatttangaagttaaccaaagaccctntggggtccctgatcggttctctggctccgtcgacngctcctcaattctgcccttcctcaccatctctggactgaagctgaggacgaggctgtatattactgtcagtcctatgatagaaccacccatgtggttcgtcgggcggggacagtctcgaccgtctgagtcgacgcccgaagtcctcgcccctggtccacgtcctcgttcccccaccccgttccctcgtacgttcggttcgtcgttaccgtcggtacggtccgggtctcgggcgagggccg

SEQ ID NO: 30269 - DNA, 544 bp, Homo sapiens
  misc_feature: GYAE6OF01DL6BR.33.11.A11.1.454.CMB.1.raw
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
  modified_base (336)..(336): a, c, t, g, unknown or other
  misc_feature (336)..(336): n is a, c, g, or t
tcagtacacacactcacgaccggtgctcgatttagctacgactgcaggggccactgtcttctccactacttctcaccctcctcgctcactgcacaggttcttgggccaatttttatactgagtcagccccactctttgtcggggtctccggggaagacggtgagcatatcctgcacccgcagcagtggcagcatcgtcgacaactatgtgcactggtaccagcttcgcccgggcacgttcccccacactgtgattttangaaagttaaccaaagccctntggggtccctgatcggttctcgtggctccgtcgacagctcctccattctgccttccncaccatctctggactgaagactgaggacgaggctgtatattactgtcagtcctatgaatacgaaccacctatgtgttcgtcgggcggggacctagtcgtcgaccgtctgagtcagacccgaggctccgccctcgtcacctcctcgtcccctaccctccgtcctaggttcgttgttacgtacgtcggtcggacgggctagggcgaggcg

SEQ ID NO: 30270 - DNA, 587 bp, Homo sapiens
  misc_feature: GYAE6OF01A90SN.33.11.A11.1.454.CMB.1.raw
  modified_base (383)..(383): a, c, t, g, unknown or other
  misc_feature (383)..(383): n is a, c, g, or t
tcagtacacacactcacgaccggtgctcgatttagctacgactgcaggggccactgtcttctccactacttctcaccctcctcgctcactgcacaggttcttgggccaattttatactgagtcagccccatctttgtcgggtctccggggaagacggtgagcatatcctgccacccgcagcagtggcagcatcgtcgacaactatgtgcactggtaccagcttcgcccgggcagttcccccacactgtgtattttatgaagttaaccaaacgaccctcgtcggggtccctgatcggttctctggctccgtcgacagcctcctactaattctgcccttcctcaccatctctggactgaagactgaggacgagctgtatattacngtcagtcctagtgatacgaaccacctagtggttcggttcgtcggggccggggtaccaggttccgtacggacccgtcgtcgacgtccaacggcccaaggtcccgtacgccccccgttcggtcctacccgtcgtacccgttcccccacccgttcccgtctaggttcggttcggtactcggacggtccggcgtaggcgaggcgtacg

SEQ ID NO: 30271 - DNA, 620 bp, Homo sapiens
  misc_feature: GYAE6OF01BT6WE.33.11.A11.1.454.CMB.1.raw
  modified_base (317)..(317): a, c, t, g, unknown or other
  misc_feature (317)..(317): n is a, c, g, or t
tcagtacacacactcacgaccggtgctcgatttagctacgactgcaggggccactgtcttctccactacttctcaccctcctcgctcactgcacaggttcttgggccaatttttatactgagtcagccccactctttgtcggggtctccggggaagacggtgagcatatcctgcacccgcagcagtggcagcatcgtcgacaactatgtgcactggtaccagcttcgcccgggcacgttcccccacactgtgatttatgaacgttaaaccaaagaccctcgtcggggtccctgatcggttctctggctccgtcgacngcctcctcattctcgtcccttcctcaccatcctcgtggactgaagcgtggaggacgaggtctgtattattactgtcagttcctatagataacgaaccctacccagttcggttcggttccgtcggggtccgggggacctacggtccgtcggtacccgtccgtgtacgtccgacggcccgaacggtccgtccggtcccccgtcggtcctaccgttcccgttccggttcccccgtccccgttcccgtccgtaggttcggttcggttcgttacgtcggtacggtccgggtcgtcggcgacgggtccg

SEQ ID NO: 30272 - DNA, 745 bp, Homo sapiens
  misc_feature: GYAE6OF01ANQ59.33.11.A11.1.454.CMB.1.raw
tcagtacacacactcacgaccggtgctcgatttagctacgactgcaggggccactgtcttctccactacttctcaccctcctcgctcactgcacaggttcttgggccaattttatactgagtcagccccactctttggtcggggtctccgggggaagacggtgagcatatcctgccacccgcagcaggtggcagcatcgtcgacaactatgtgcacgtggtaccagccttcggcccggcacgttcccccacactgtgtatttatagaacgttaaaccaaacgacccctcggtcggggttccctgtacgttccggttctcgtcgggtcctccggtacgacacgtcctccctactaattcctcgtcccttcctccacctcttcctcgtacggtactaggaacgtacgtaggacgggacggtaggtcttagttaattacttactggtacctacttcctaagtacgtaactaaccgaaccctactaggttcggttcgggttaccggtcgggggaccggggtacctacggtccgtacggtacccgttcgtacggtaccgtccgaaccggtacccggtaacgggtcccgtaccccggtcccccgttacccgggttaccctaacccggtttcccgttaccccggtttccccccgacccctttccgtaccgttagggttccgggttacgttaccggttaccgggtacggggtaccgggttccgggtaccggttcgggaacccgtcgggtaccg

SEQ ID NO: 30273 - DNA, 530 bp, Homo sapiens
  misc_feature: GYAE6OF01C7NZZ.33.11.A11.1.454.CMB.1.raw
tcagtacacacactcacgaccggtgctcgatttagctacgactgcaggggccactgtcttctccactacttctcaccctcctcgctcactgcacaggttcttgggccaattttatactgagtcagccccatctttgtcggggtctccggggaagacggtgagcatatcctgcacccgcagcagtggcagcatcgtcgacaactatgtgcactggtaccagcttcgcccgggcagttcccccacactgtgatttatgaagttaaccaaagaccctctggggtccctgatcggttctctggctccgtcgacagcctcctcaattctgcccttcctcaccatctctggactgaagctgagacgaggctgtatattactgtcagtctatgatagaaccaccctatcgtggttcgtcgggcggggacctacgtctcgtaccgtcgtcgacgtcacgccaaggtctcgccccgtcgtccactctcgtcccaccctcctcagtcgtcgttactgacgtcggtcgtggcaggcgtacg

SEQ ID NO: 30274 - DNA, 668 bp, Homo sapiens
  misc_feature: GYAE6OF01A2ADU.33.11.A11.1.454.CMB.1.raw
  modified_base (233)..(233): a, c, t, g, unknown or other
  misc_feature (233)..(233): n is a, c, g, or t
  modified_base (605)..(605): a, c, t, g, unknown or other
  misc_feature (605)..(605): n is a, c, g, or t
tcagtacacacactcacgaccggtgctcgatttagctacgactgcaggggccactgtcttctccactacttctcaccctcctcgctcactgcacaggttcttgggccaatttttatactgagtcagccccactctttgtcggggtctccggggaagacggtgagcatatcctgcacccgcagcagtggcagcatcgtcgacaactatgtgcattggtaccagcttcgcccggnacgttcccacccactgtgtattattgaagttaacctaaacgaaccctcctgggtcccgtcgtagtcggttcgttctcggcgtccgtcgacacgctcctcctaacttcttcgccttcctccaccactcttcctcggtacgtacgaagacgtgaggacgaggctgtatattacttgtctacgtcctatgaagtagaacccacccattaggttcgggtttaccgtccggggaccggggggtaccgacgttcgtccggtacccggtcccttggacgttacggaccgaccccggtaagggtcccgttcccggccccccgttccggttacgacccgtttccctccggtttacccccctaccccgtcccgtttaccggngtttcgggtcgttcgttaacccgtgggtaccgggtccgggtccgtcggtacggacgggacccg

SEQ ID NO: 30275 - DNA, 729 bp, Homo sapiens
  misc_feature: GYAE6OF01ALU1F.33.11.A11.1.454.CMB.1.raw
  modified_base (277)..(277): a, c, t, g, unknown or other
  misc_feature (277)..(277): n is a, c, g, or t
  modified_base (313)..(313): a, c, t, g, unknown or other
  misc_feature (313)..(313): n is a, c, g, or t
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagcttcgcccgggcacgttcccccacactgtgatttatagaacgttaaccaagccctntggggtccctgatcggttctctggcctccgtcgacngcctcctacaatttctgtcccttcctcacctatcctctggactgaaagtactggaacgggacgaggtcttgttaattactttactggtacctagttacctagtagtattaacggaacccaacccgtagttcggtttacgggtttccggtaccgggggtccgggggggtaaccccgtacggttacccgttacgggtaccccgtttccgtacggtacggtaccgtaaccggacccccgtaacggggtccccgttacccggtccccccccgttacccgggttacccgtaccccttccgttccccggttttacccccccgtaacccccgttccccgttccgtacgggtttacggttcgggttaccggttaaccgtcgggtacgggtcccggggtacgtcggggtaccgaacggggtcccg

SEQ ID NO: 30276 - DNA, 762 bp, Homo sapiens
  misc_feature: GYAE6OF01BUY64.33.11.A11.1.454.CMB.1.raw
tcagtacacacactcacgaccggtgctcgatttagctacgactgcaggggccactgtcttctccactacttctcaccctcctcgctcactgcacaggttcttgggccaatttttatactgagtcagccccactctttgtcggggtctccggggaagacggtgagcatatcctgcacccgcagcagtggcagcatcgtcgacaactatgtgcactggtaccagtcttccggcccgggcacgttcccccacactgtgtatttatagtaaacgttaaacccaaacgccccttcgtcgggggtccctggtacgttccggtttctcgtcggccttccggtacgacacgtcccttcctacctaattttcctcgtacccctttcctaccacctacgttcctcgtacggactaggaaacgtcgtagggacgggacgtaggtcttaggttacttacgtttaccgtgttaccgtacgttacccgttaagttacgtaaacgttaacccgtaaaccccctaccccgtaaggtttcgggtttaccgggtttcccgggtaccgggggggacccgggggtaacctacggttccgtaccggtacccggttcgtagggacgtccgaccggtaccccgaagggtcccttcccggacccccgtttcggtccctaacccgttcccgttccccgttccccctacccgtttccctcggttacgttcggttcgtacgttaccggttaggaccgggtccgggtaccgtcgggccgtaacgggtccg

SEQ ID NO: 30277 - DNA, 688 bp, Homo sapiens
  misc_feature: GYAE6OF01BRG5T.33.11.A11.1.454.CMB.1.raw
  modified_base (346)..(346): a, c, t, g, unknown or other
  misc_feature (346)..(346): n is a, c, g, or t
  modified_base (519)..(519): a, c, t, g, unknown or other
  misc_feature (519)..(519): n is a, c, g, or t
tcagtacacacactcacgaccggtgctcgatttagctacgactgcaggggccactgtcttctccactacttctcaccctcctcgctcactgcacaggttcttgggccaatttttatactgagtcagccccactctttgtcggggtctccggggaagacggtgagcatatcctgcacccgcagcagtggcagcatcgtcgacaactatgtgcacgtggtaccagccttcgcccgggcacgttcccccacactgtgtatttatgaacgttaaccaaagcccctcgtcggggtccctgacgttcggttctcgtcggcctccggtcgacacgtcctcctaccaatttccncgtcccttcctcacctatcctcgtggactgaaacgtctggacggtaacgaggtcttagtattactttacgtcgtacacgttctagtagtaactacgaaccctacctagttcggttcggtttaccggtccggggaccgggggtacctaggttccgtaccggtacccgttcccgnggttaacgccgtaacggacccgtaaggtcccgttacccgtccccccgttacggttccctaccgttcccgttcccgtttaccccctaccccgttaccccttcgtagggttcggttcggttcgtaccggtaggtaccgggtcccgggtcgtacgggaccggtagggtcccg

SEQ ID NO: 30278 - DNA, 781 bp, Homo sapiens
  misc_feature: GYAE6OF01CA5P9.33.11.A11.1.454.CMB.1.raw
  modified_base (380)..(380): a, c, t, g, unknown or other
  misc_feature (380)..(380): n is a, c, g, or t
  modified_base (748)..(748): a, c, t, g, unknown or other
  misc_feature (748)..(748): n is a, c, g, or t
tcagtacacacactcacgaccggtgctcgatttagctacgactgcaggggccactgtcttctccactacttctcaccctcctcgctcactgcacaggttcttgggcctaattttatactgagtcacgccccattcgtttggtcggggtccgtaccgggggaagacggtgagcatactcctgcccaccgcagcaggtggcagcagtcgtacgaactaactgtgagctacgtgggtaccaggtccgttccggcccgggactacccgttcccccacgtacgtgtagttaacgtttacgtaacggtaaacgttaaaccgaaacgtacccgttcggtccggggtcctagacgttccggttcgtcgtcggtccgtccgtacgaccncgtcccttcctaccttacttccgtcgtcccttacctacacctactcctcggtacggtaacaacggtaacggacggtaacggaacggtacggtagtcgttaagttaacgttacttacgttacgtacgtacgttactagttaacggaaccttaaccgaaacccgtaccgttaggttcgggttacgggttcccggtacggggggacccgggtacgtcgtacccgggttaccgtaccggtcgtacggtaccgtacccggaaccgtacccggtaccggtccccgttaaccccggccccggttctacccgtccgttaccgttccccgtccccttacccgttcgtacgtcgggtttaggtcgttagttacccggnggtaccgggcggtcgacgggtaggacggtacgg

SEQ ID NO: 30279 - DNA, 566 bp, Homo sapiens
  misc_feature: GYAE6OF01DU41F.33.11.A11.1.454.CMB.1.raw
  modified_base (180)..(180): a, c, t, g, unknown or other
  misc_feature (180)..(180): n is a, c, g, or t
  modified_base (260)..(260): a, c, t, g, unknown or other
  misc_feature (260)..(260): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
  modified_base (388)..(388): a, c, t, g, unknown or other
  misc_feature (388)..(388): n is a, c, g, or t
  modified_base (554)..(554): a, c, t, g, unknown or other
  misc_feature (554)..(554): n is a, c, g, or t
tcagtacacacactcacgaccggtgctcgatttagctacgactgcaggggccactgtcttctccactacttctcaccctcctcgctcactgcacaggttcttgggccaatttttatactgagtcagccccactctttgtcggggtctccggggaagacggtgagcatatcctgcacccgnagcagtggcagcatcgtcgacaactatgtgcactggtaccagcttcgcccgggcacgttcccccactactgtgattttangaaagttaaccaaagcccctcgtggggtccctgactcggttctcgtggctccgtcgacagcctcctcaattcngccttcncaccatctctggactgaacgctggagacgagctgtatattactgtacngtactatgaatacgaaccaccctatcgtaggttccgtacggggccgggggtaccaggttctcggtacccgttcgtgacgtacacgacccgaaggtcctccgcccctcggtctacgtccttcgtccccgtcctcctcgtagttcgtgttacgtactcggtacgcggntcggcgtaggcg

SEQ ID NO: 30280 - DNA, 730 bp, Homo sapiens
  misc_feature: GYAE6OF01CYPFO.33.11.A11.1.454.CMB.1.raw
  modified_base (256)..(256): a, c, t, g, unknown or other
  misc_feature (256)..(256): n is a, c, g, or t
tcagtacacacactcacgaccggtgctcgatttagctacgactgcaggggccactgtcttctccactacttctcaccctcctcgctcactgcacaggttcttgggcctaattttatactgagtcagcccatctttgtcgggtctccggggaagacggtgagcatactcctgcacccgcagcagtggcagcatcgtcacaactatgtgcactggtaccagtcttcgcccggctacgttccccacactgtagatttanagaaacgttaaccaaagtccctaggttcggggtcctagtacgttcggttctcgtcggtaccttcccgtacgacagtccttaccctactaagtttcctcgtccccttactccacctactcttacgtagtacctagaaacgtctggaacggaccggagtacttagttaaacttaagtttacgtacggtactaacgttcccttaagtacgtaaacgtaaccgtaaaccccgaaccccgtttagtacggttttcggggttaccggtaccggggggtaccggggggtaacctacgggttccgtacggttacccgtacggttacggtacgtaccgaacggaccccgtaggtaccctccggtacccccgttggtcccctaacgttcccgttacccgcccccttacccgtccgtaccgttaggttcgtacgggtttcctacggttcggacgggttccggagtttaccgggacgtaacggacg

SEQ ID NO: 30281 - DNA, 732 bp, Homo sapiens
  misc_feature: GYAE6OF01E2KIS.33.11.A11.1.454.CMB.1.raw
  modified_base (430)..(430): a, c, t, g, unknown or other
  misc_feature (430)..(430): n is a, c, g, or t
tcagtacacacactcacgaccggtgctcgatttagctacgactgcaggggccactggtcttctccactacttctcaccctcctcgctcactgcacaggttcttgggccaatttttatactgagtcagcccccactctttgtcggggtcgtccggggaagacggtgagcatatcctgccacccgcagcagtggcagcatccgtcgacaaactatgtgcactggtaccagccttcgccccgggcacgttccccccacgactgtcgtattttagagtaaacgtttaaacccaaaacgtccccttcgttacggggtccctagtacgttccggttctccgtggtcctcccgtacgacagccttccctacctattcctcgtcccttcctacaccagttctcgtaggtacctagaacgtacgtggacggacggagtntagtattacttactgtctacgttacctatacgaactaacgaaccctaccctagttcggtcggtttaccggtccggggacggggtaccctacggttacgtccgtaccgtccgtacggacgtccgaaccggtacccgtaacgggtcccgttaccccgtcccccggttaccggtaccctcccgttacccgttccccggtttcccccgtcccctttcccggttaaccggtgggtttacggttacgttacgggttaccgtacgggtcccgggtacgggttccgtaccgggtccggaacgggtaccgg

SEQ ID NO: 30282 - DNA, 699 bp, Homo sapiens
  misc_feature: GYAE6OF01CNXNN.33.11.A11.1.454.CMB.1.raw
  modified_base (272)..(272): a, c, t, g, unknown or other
  misc_feature (272)..(272): n is a, c, g, or t
tcagtacacacactcacgaccggtgctcgatttagctacgactgcagggggccactgtcttctccactacttctcaccctcctcgctcactgcacaggttcttgggcctaatttttatactgagtcagccccatctttggtcggggtctccgggggaagacggtgagcatactcctgcacccgcagcaggtggcagcatcgtcgactaactatgtgcaacgtggtaaccagtccttcggcccgggctacgttcccccacactgtgtatttanagtaacttaaccaaagccctgtcgggtcctgtacttcggttctcgtcggccttccgtacgacacgtcctccctaccgtaattcctaccggtccctttcctaccacctacgtctacgtggacctagaacgtactgggaacggtacggacggttactaggttaaacttacgtttaccgttaggtaccgttagttacccttaagtacggaacttaaccggaaacccctacctaggttacggttacggttccgggtccgggggacgggggtacctacggtcgtacggtacccgtacgtcgtacggtaccaccgggacccgtaacggtccgttcccgtccccggttcggtacctaccgtccgttccgttcccccgtccttccgtcgtagttcggttcgtacgtcgtcggacggtcggcgacgcggtaggtcg

SEQ ID NO: 30283 - DNA, 836 bp, Homo sapiens
  misc_feature: GYAE6OF01CR2LB.33.11.A11.1.454.CMB.1.raw
tcagtacacacactcacgaccggtgctcgatttagctacgactgcaggggccactgtcttctccactacttctcaccctcctcgctcactgcacaggttcttgggccaattttatactgagtcacgccccactctttggtcggggtctccggggaagacggtgagcatatcctgcacccgcagcagtggcagcatcgtcgacaactatgtgctacgtggtaccagtccttccggcccgggctaccgttcccccactacgtgtgtattttagtacgtaaacgttaaaccaaacgtaccccgttcgttaccggggtccctaggtacgttccggtttctcgtcggtacctccggtacgactacgtccctaccctaccgttaactttccgtcgtcccctttaccctaccgaacctacttccttcgtacggtaaccgttaaggaaacgtacgttacgggaacggtaaccggaggtccttaggttaaactttacgttaacctaggttaccgtaacgttacccgtaagtacggtaactaaccgtaaacccctaccgtaagttacgggttaccgggtttaccgggtacccggggggtaccgggggtaacccgtacgggttaccgttaccggtaccccggttccgtacgggtaccggtacccgacccggtaccccgggtaacggtccccggttacccgtaccccccggtttaccggtacccgttacccgttccccgttacccggttacccccctacccgttcccgtaccggtaggtttccggttcgttaccggttaaccgtcgggtacccgggtacggggtacgtcgggaaccggtcggtaccgg

SEQ ID NO: 30284 - DNA, 845 bp, Homo sapiens
  misc_feature: GYAE6OF01CKD99.33.11.A11.1.454.CMB.1.raw
tcagtacacacactcacgaccggtgctcgatttagctacgactgcaggggccactgtcttctccactacttctcaccctcctcgctcactgcacaggttcttgggcctaattttatactgagtcacgccccactctttggtcggggtctccggggaagacggtgagcatactcctgccacccgcagcagtggcagcagtcgtacgaacaactatgtgctacgtcggaccagtccgttccggcccgggtctacccgttacccccaaccgtactgtacgtaatttagtacgtaaacgttaaaccaacgtacccttacggtccggggttacctggtacgttccggttctcggtacgggtccttaccggttacgaccgtacgtccctacccttactaacgttccgttacttccccttacctacctaaaccttacgttcctaaccggtacggtaaccttaaggaacggtacgtacgggaacgggtaacgtacggttccttagtaacgtttaactttaccggttacgttacgtaccgttaacttaacgtacggtaaactaacccgtaaaccccacccgttagttacgggtttcggttaccgggtaccgggggacggggttaacctacgttacggttacccggtacccggtttacgtcgggaccgtaccgtaccggaacccgtaccggtacccgttcccccgggaccccgttaccggtaccctaaccgtttccccggttacccttaacccccgtacccttcccgggtacctaccggggtttataccggtttaccgtaacggtccgggtacgggttacccgggtacgggtaaccggtggaaacccggttaccg

SEQ ID NO: 30285 - DNA, 725 bp, Homo sapiens
  misc_feature: GYAE6OF01AYAZL.33.11.A11.1.454.CMB.1.raw
tcagtacacacactcacgaccggtgctcgatttagctacgactgcaggggccactgtcttctccactacttctcaccctcctcgctcactgcacaggttcttgggccaatttttatactgagtcagccccactctttgtcggggtctccggggaagacggtgagcatatcctgcacccgcagcagtggcagcatcgtcgacaactatgtgcactggtaccagcttcgcccgggcacgttcccccacactgtgtatttagacgaacgttaaaccaaagtccctcgtcggggtccctgacttcggttctcgtcggcctccggtcgacagtcctccctaccgtaattcctcgtccctttcctaccacctacttccgtcgtacggactaggaacgtacgtagggacgggacgtacggtcgttagttaacttaactttaccgttcgtacctacgttacctagtacgtacgtaaccgaaccctaccctagttcggttacggtttccggcgggggtaccggggaacctacggttccgtaccggtacccgttccgaggtccgtccgtaaccggacccgtacgggtcccgtcccggtcccccgttcgggtaccctaccgttcccgttcccgtttacccccgtaccccgtttcccgtacggtaggttccggttggttaccggttaccggttcgggtaccgggtcccgggaggttacgggaaccgtagggtaccgg

SEQ ID NO: 30286 - DNA, 583 bp, Homo sapiens
  misc_feature: GYAE6OF01E3M1O.33.11.A11.1.454.CMB.1.raw
  modified_base (327)..(327): a, c, t, g, unknown or other
  misc_feature (327)..(327): n is a, c, g, or t
  modified_base (344)..(344): a, c, t, g, unknown or other
  misc_feature (344)..(344): n is a, c, g, or t
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagccttcgccccgggcacgttcccccaccactgtgtatttatgaaagttaaccaaaagacccctctgggggtccctgactcggttctctggctccgtcgacagctccnccaattctgcccttccncaccatctctggactgaagactgaggacgaggctgtattattactgtctagtcctatgatacgaacccaccctagtgtggttctcggggcggggacctaggtctcgaccgtcctgagtccgacgcccaaggtcctccggtcccccttcggtccaccttccgtccgttccccgtcccccgttccgtccgagttggtcgttcggtacgtcggtaacggcggggtcgtcgggcgacgggtcg

SEQ ID NO: 30287 - DNA, 714 bp, Homo sapiens
  misc_feature: GYAE6OF01B4JEH.33.11.A11.1.454.CMB.1.raw
  modified_base (464)..(464): a, c, t, g, unknown or other
  misc_feature (464)..(464): n is a, c, g, or t
tcagtacacacactcacgaccggtgctcgatttagctacgactgcaggggccactgtcttctccactacttctcaccctcctcgctcactgcacaggttcttgggccaatttttatactgagtcagccccacttctttggtcgggggtctccgggggaagacgggtgagcatatcctgcacccgcagcagtggcagcatcgtcgacaactatgtgcactggtaccagcttcgcccgggcacgttcccccacactgtagattttatagaaacgtttaaaccaaaacgtaccccttgtcgggggttccctgtacgttccggttctctggcctccggtcgacacgcctccctaccgtaattcctcgtccccttcctccacctattcctcgtacggacttacggaaacgacgtgggaacggtacgaaggtcttaggtacttagtttactcgtactacgttactagtanagtaacgaacccaccgtagttcggttcggttcgtccggggacggggtacctggttcgtacggtcccgttcgtcggtacggtccgaccggtacccgaacgggtcccgtacccggttccccccgtcgggttccctaccgttccgttcccgtttcccccctaacccgttcccgttaccggtacggttcggttccggttacgtaccggtcggtacggggtcccgggtaggtccgggtaccgggtaggtaccggg

SEQ ID NO: 30288 - DNA, 636 bp, Homo sapiens
  misc_feature: GYAE6OF01EA3EM.33.11.A11.1.454.CMB.1.raw
  modified_base (183)..(183): a, c, t, g, unknown or other
  misc_feature (183)..(183): n is a, c, g, or t
  modified_base (624)..(624): a, c, t, g, unknown or other
  misc_feature (624)..(624): n is a, c, g, or t
  modified_base (631)..(631): a, c, t, g, unknown or other
  misc_feature (631)..(631): n is a, c, g, or t
tcagtacacacactcacgaccggtgctcgatttagctacgactgcaggggccactgtcttctccactacttctcaccctcctcgctcactgcacaggttcttgggcctaattttatactgagtcagccccactctttggtcggggtcgtccggggaagacggtgagcatatcctgccacccgnagcagtggcagcatcgtcgacaactatgtgcacgtggtaccagccttccggcccgggcaccgttcccccaccactgtgtatttatagtaacgttaaaccaaacgaccctcgtcgggtcctgtacgtcggttctcgtcggtcgtccgtcgacacgcctcctaccgggggtacttctcgtccttcctccacctactcctcgtcggactagaacgacgtaggaggacggtacggtcgtagtattacttacgttgtctacgtactatagtaactaacgaaccctaccctagtcggttcgggttccggtcggggtaccgggggtaccgtacgtcgtccggtccgtccgtgtacgtaccgacgaccgtacggtccgtccgtccccgtccgtccgtccgtccgttccgtcccgtccctccgtcgtgtcgtgtcgtcgtcgtcggcggngcggcgnggtcg

SEQ ID NO: 30289 - DNA, 604 bp, Homo sapiens
  misc_feature: GYAE6OF01EI0F8.33.11.A11.1.454.CMB.1.raw
  modified_base (494)..(494): a, c, t, g, unknown or other
  misc_feature (494)..(494): n is a, c, g, or t
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagcttccgcccgggcacgttcccccaccactgtgtattttatagaaacgtttaaacccaaaacgtacccctcgtcgggggttccctgtacgttcggtttcctcgttcggcctcccggtcgacacgccttcctaccaatttctcgtccctttcctcaccctatcctcgtggactagaagcgtggacggacgaggctgtattattactgtcagtctatagatacgaaccaccatcggttggttccgtcggggccggggacctgtctcgaccgtctgngtcgacgccgacgtcctccgccccgtcgtacctaccttcctccgttccccctacccgtccgtcgtaggtgttcgtcgtacgtgggtacggcgggtcgcggcgaggtccgg

SEQ ID NO: 30290 - DNA, 794 bp, Homo sapiens
  misc_feature: GYAE6OF01C33TK.33.11.A11.1.454.CMB.1.raw
tcagtacacacactcacgaccggtgctcgatttagctacgactgcaggggccactgtcttctccactacttctcaccctcctcgctcactgcacaggttcttgggccaattttatactgagtcagcccactctttgtcggggtctccggggaagacggtgagtcatactcctgcacccgcagcagtggcagcagtcgtacgactaactagtgtcgcacgtcggtaccagcttccggcccggctaccgttcccccaccgacgtgtacgtatttactaggaaacgttaaaccaacgtacccctcggtaccgggtcctaggtacgtttccggttaccttcggttacggtccgttcccggtaccggtaccgtacggtcccttacccgtaccgttaaactttcccgtaccgttcccctttaccctccgtaaccgttacctccgttcggtacgtacgtacggtaacgtacggttacgggaacggtacggtacgttacgtacgttaacttacgttacgttcgtaccgttactaccgttaagcgtaacgtaacccgaaccgtaccgtagttcgggttaccggtcggggtaccggggttaccggggaccttacggtaccgtaccggtacccgttcggtacggtacgtaccgaaccgtacccgggtacgttccgtaccccggtcccggttaccgtacccgttaccgttcccggttacccggttcccgacccgtttccgtacgtgggttttccgtaggtcccgtttaggacgggtccgggacggttcgaccggtcgacggtaccg

SEQ ID NO: 30291 - DNA, 670 bp, Homo sapiens
  misc_feature: GYAE6OF01C8YH0.33.11.A11.1.454.CMB.1.raw
  modified_base (188)..(188): a, c, t, g, unknown or other
  misc_feature (188)..(188): n is a, c, g, or t
tcagtacacacactcacgaccggtgctcgatttagctacgactgcaggggccactgtcttctccactacttctcaccctcctcgctcactgcacaggttcttgggcctaattttatactgagtcacgcccctacttcgtttggtcggggtcgtccggggaagacggtgagcatactcctgccacccgnagcgagtggcagcagtcgtcgaacaactagtgtcgcacgttcggtaccgacgtccgttccggcccggcctaccgttcccccaaccgtacgtgtagttaatttagagtaaacgttaaaccaacgtcccttcggtccggggtacctaggtacttcggttctcgtcggcctccgtcactcgcctcctactactcgtctccctctacactctctcgtagactagaacgtacgagacggacgagtcttaagtacttaattcgtagtacgtcgtacttagtacgtaactacgaaccctacgttagtttcgggtcgtttcgggaccgggcggggtacacgttccggtaccgtaccgttacgtacggacggtaccgaccgccggtaaccggtccgtaccccggtcccgttacgtcctacccggttccgttcccgtacccctcccacgtcgtaggtcgttcgttgtacgacggcggtacgctgcgcgtacg

SEQ ID NO: 30292 - DNA, 742 bp, Homo sapiens
  misc_feature: GYAE6OF01CK23X.33.11.A11.1.454.CMB.1.raw
  modified_base (366)..(366): a, c, t, g, unknown or other
  misc_feature (366)..(366): n is a, c, g, or t
  modified_base (394)..(394): a, c, t, g, unknown or other
  misc_feature (394)..(394): n is a, c, g, or t
tcagtacacacactcacgaccggtgctcgatttagctacgactgcaggggccactgtcttctccactacttctcaccctcctcgctcactgcacaggttcttgggcctaattttatactgagtcacgccccactcgtttggtcggggtcgtaccgggggaagacggtgagcatactcctgccacccgcagcagtggcagcagtcgtcaacaactagtgtgctacgtcggtaccgacgtccgttccggcccgggtactacccgttcccccaccgtacgtggtacgtaatttacgtagtaaaccgttaaccaaacgtcccgtcggtacgggtacctgtacgttcggttctcgtcgtccgtccgcgacncgtcctcctacctacttctctccttccnctacgtactctcgtacgtagtagaacgtacgtaggacggacgtacgtacgttagtacttacttcgtacgtcgtacgtactagtacgtaacgtaacctaacccgtacgtgtttacggtccggttacgggtccgggggaaccggggtcttaacggtccgttccggtaccggttcgtacgtaccggtacgacccggtacccgtacggtacccgtcccggtaccccttccggtaccctcccgttacccgttaccctacccccgttcccgttcccgtcgttaccgggtcgttggttacccggtacgggttacggtaccgggtcgggtacccgggtaaggcccggtacgggacg

SEQ ID NO: 30293 - DNA, 669 bp, Homo sapiens
  misc_feature: GYAE6OF01DFWSS.33.11.A11.1.454.CMB.1.raw
  modified_base (190)..(190): a, c, t, g, unknown or other
  misc_feature (190)..(190): n is a, c, g, or t
  modified_base (542)..(542): a, c, t, g, unknown or other
  misc_feature (542)..(542): n is a, c, g, or t
  modified_base (600)..(600): a, c, t, g, unknown or other
  misc_feature (600)..(600): n is a, c, g, or t
tcagtacacacactcacgaccggtgctcgatttagctacgactgcaggggccactgtcttctccactacttctcaccctcctcgctcactgcacaggttcttgggcctaattttatactgagtcacgccccacttcgttttggtcggggtctaccgggggaagacgggtgagcatactcctgccacccgnagcaggtggcagcatcgtacgaacaactagtcgtgcacgtggtaccagtccgttccggcccggctaccgttcccccactacgtgtagtatttagagtaaacgttaaccaaacgtccctaggttccgggtcctggtacttcggttctcgtacggtccgttaccgtcgaacgtcgtccttcctactattccgtcgtcccttccactaactcgttctcgtacgacttaacggacgtcgtaggaacgtacggtagtcttagttaacttaacgttcgtgtacgtacgttctagtacgaactaaccgaacctacgtagttcggtcgtacggccggggtcggactcgtctacggccgtntcggacgtccacgacccgcgggtccctccgtcccgttagtcctacgttcccgttcccncccgtaccctcgttcgttagtccggtttacggcgttagccgggtacggtcggaggtcggcgacgggtac

SEQ ID NO: 30294 - DNA, 521 bp, Homo sapiens
  misc_feature: GYAE6OF02HW5FT.33.11.A11.1.454.CMB.1.raw
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagcttcgcccgggcagttcccccaccactgtgatttatgaagttaaccaaagaccctctggggtcccctgatcggttctctggctccgtcgacagctcctccaattctgccttcctcaccatctctggactgaagactgaggacgaggctgtatattactgtcagtcctatgatagaaccacccatgtggttcgtcgggcgggggaccagtctgaccgtctgagtcgagcccaaggcctcgccccctcggtccacctctcgttcccaccctcctcagtgtgttgtctgagcggctggcagcg

SEQ ID NO: 30295 - DNA, 516 bp, Homo sapiens
  misc_feature: GYAE6OF02ISMRC.33.11.A11.1.454.CMB.1.raw
  modified_base (311)..(311): a, c, t, g, unknown or other
  misc_feature (311)..(311): n is a, c, g, or t
  modified_base (454)..(454): a, c, t, g, unknown or other
  misc_feature (454)..(454): n is a, c, g, or t
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagcttcgcccgggcagttcccccacactgtgatttatgaagttaaccaaagaccctctggggtccctgatcggttctctggctccgtcgacngctcctccaattctgccttcctcaccatctctggactgaagctgaggacgaggctgtatattactgtcagtcctatgatacgaaccaccatgtggttcgtcgggcggggaccagtctcgaccgtcctgagtcagcccgaggcncgcccctcggtcacgtctcgttcccgcctcctcacgtgtgtgtactgcgcggctggcaggcg

SEQ ID NO: 30296 - DNA, 525 bp, Homo sapiens
  misc_feature: GYAE6OF02ID5O0.33.11.A11.1.454.CMB.1.raw
  modified_base (257)..(257): a, c, t, g, unknown or other
  misc_feature (257)..(257): n is a, c, g, or t
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagcttcgcccgggcagttcccccacactgtgattttangaagttaaccaaagacccctctggggtccctgatcggttctctggctccgtcgacagctcctccaatttctgccttcctcaccatctctggactgaagctgaggacgaggctgtatattactgtcagtcctatgatagaaccaccatgtggttcgtcgggcgggggaccagtctgaccgtctgagtcacgcccaagctcgcccctcggtcactctcgttcccaccctcctcacgtcgtgttcgtacgtgacgccgggctggcgaggcg

SEQ ID NO: 30297 - DNA, 523 bp, Homo sapiens
  misc_feature: GYAE6OF02FRY1J.33.11.A11.1.454.CMB.1.raw
  modified_base (256)..(256): a, c, t, g, unknown or other
  misc_feature (256)..(256): n is a, c, g, or t
  modified_base (334)..(334): a, c, t, g, unknown or other
  misc_feature (334)..(334): n is a, c, g, or t
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagcttcgcccgggcagttcccccacactgtgatttangaagttaaccaaagaccctctggggtcccctgatcggttctctggctccgtcgacagctcctccaattctgccttccncaccatctctggactgaagctgaggacgaggctgtatattactgtcagtcctatgatagaaccacccatgtggttcgtcggcgggggaccagtctgaccgtcctgagtcagcccaagctcgccccgtcgtcactctcgttcccaccctcctcacgttcgtgtcgtacgtgacggcgggctggcgaggcg

SEQ ID NO: 30298 - DNA, 526 bp, Homo sapiens
  misc_feature: GYAE6OF02FGFTW.33.11.A11.1.454.CMB.1.raw
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagcttcgcccgggcagttcccccaccactgtgatttatgaagttaaccaaagaccctctggggtcccctgatcggttctctggctccgtcgacagctcctccaattctgccttcctcaccatctctggactgaagactgaggacgaggctgtatattactgtcagtcctatgatagaaccacccatgtggttctcgggcgggggaccagtctgaccgtcctgagtcagcccaaggcctcgcccctcggtccactctcgttcccaccctcctcagtcgtgttcgtactgacggcgggctcggcaggcg

SEQ ID NO: 30299 - DNA, 665 bp, Homo sapiens
  misc_feature: GYAE6OF02IAZH8.33.11.A11.1.454.CMB.1.raw
tcagtacacacactcacgaccggtgctcgatttagctacgactgcaggggccactgtcttctccactacttctcaccctcctcgctcactgcacaggttcttgggcctaatttttatactgagtcagccccactctttgtcggggtcgtccggggaagacggtgagcatatcctgcacccgcagcagtggcagcatcgtcgaacaactatgtgcactggtaccagtcttcggcccgggcaccgttccccaccactgtgtattttatagtaaacgtttaaaccaaaacgtaccccttcgtcggggtcccctggtactcggtttctcgtggcctccggtcgacacgccttcctccaattcctcgtcccttcctcacctatctctcggactagaacgacgtggacggacgaggtctagtatacttactgtcagttcctagtagaacttaacgaaccctaacctagtcggttcggttcgtcggggaccggggacctagttccgtcgtaccgtccgaggtacgtaccgacggtcccgaacggtccgtcccggtccccgttcgggtacctaccttccgttcccgttaccccctacccgtttccgtccgtacggttcgttccgtttacgtaccggttggacgggtcccggcggttcggaccgtagggtcccg

SEQ ID NO: 30300 - DNA, 522 bp, Homo sapiens
  misc_feature: GYAE6OF02H6R6Y.33.11.A11.1.454.CMB.1.raw
  modified_base (351)..(351): a, c, t, g, unknown or other
  misc_feature (351)..(351): n is a, c, g, or t
  modified_base (481)..(481): a, c, t, g, unknown or other
  misc_feature (481)..(481): n is a, c, g, or t
tcagtacacacactcacgaccggtgctcgatttagctacgactgcaggggccactgtcttctccactacttctcaccctcctcgctcactgcacaggttcttgggccaatttttatactgagtcagccccactctttgtcgggtctccggggaagacggtgagcatatcctgcacccgcagcagtggcagcatcgtcgacaactatgtgcactggtaccagcttcgcccgggcacgttcccccaccactgtgatttatgaagttaaccaaagccctctggggtccctgatcggttctctggctccgtcgacagctcctcaattctgccttctcaccatctctggactgaanactgagacgaggctgtatattactgtctagtcctatgatacgaaccaccatgtggttcgtcgggccggggacagtcgtcgaccgtctgacgtcacgcccgaagctcgcccctcggtccactctcgtcccncctcctctcgtgtcgtcgtcgtgacgcggcgtggcgaggcg

SEQ ID NO: 30301 - DNA, 561 bp, Homo sapiens
  misc_feature: GYAE6OF02IUMSN.33.11.A11.1.454.CMB.1.raw
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagcttcgcccgggcacgttcccccacactgtgatttatgaagttaaccaaagaccctcgtcggggtcccctgactcggttctcgtggctccgtcgacagcctcctccaatttcctcgtcccttcctacacctattcctctggactagaacgactggaggacgaggtctagtatattactgtcagtctatgatacgaaccaccagtgtggttcgtcgggcggggactacgtctcgaccgtctggacgtcgacgcccgaggcctccgccccgtcggtccactctccgtccctaccctcctctcgttgtcgtcgtacgtcggcggccgggtcgtcggcgaggtcg

SEQ ID NO: 30302 - DNA, 589 bp, Homo sapiens
  misc_feature: GYAE6OF02HH9YN.33.11.A11.1.454.CMB.1.raw
  modified_base (338)..(338): a, c, t, g, unknown or other
  misc_feature (338)..(338): n is a, c, g, or t
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagcttcgcccgggcacgttcccccacactgtgatttatgaaagttaacccaaagacccctcgtggggtcccctgatcggttctctggctccgtcgacagctcctcaattctgccttccncaccatctctggactgaagactggagacgagctagtatattactgtcagtcctatagaacttacgaacctacccattcggtggttccgtcgggcggggtacctaggtctcgaccgtcctgtacgtccgacgcccgaagccgtccgtccccgttcggtcccaccttccgttccgttcccctacccttcccgtcgtacggttcggtcgttcgtaccgttcggacggtcccggtcggtacggaccgagggtccg

SEQ ID NO: 30303 - DNA, 554 bp, Homo sapiens
  misc_feature: GYAE6OF02HQHEF.33.11.A11.1.454.CMB.1.raw
  modified_base (311)..(311): a, c, t, g, unknown or other
  misc_feature (311)..(311): n is a, c, g, or t
  modified_base (333)..(333): a, c, t, g, unknown or other
  misc_feature (333)..(333): n is a, c, g, or t
  modified_base (361)..(361): a, c, t, g, unknown or other
  misc_feature (361)..(361): n is a, c, g, or t
tcagtacacacactcacgaccggtgctcgatttagctacgactgcaggggccactgtcttctccactacttctcaccctcctcgctcactgcacaggttcttgggccaattttatactgagtcagccccatctttgtcggggtctccggggaagacggtgagcatatcctgcacccgcagcagtggcagcatcgtcgacaactatgtgcactggtaccagcttcgcccgggcacgttcccccacactgtgatttatgaagttaaccaaagcccctgtcggggtccctgatcggttctctggctccgtgacngctcctccaattctgcccttcncacctatctctgactgaagctgagacgngctgtatattactgtcagtctagtgatacgaccacctatgtcggttcgtcgggcggggtaccagtctcgaccgtcgtgagtcacgcccgagctccgccccgtcggtcaccgttccgtcgttccccgtcccttcccgtctacggttcgtcgttacgtacgttcggacggtccggcgtacgggaccgagggtccg

SEQ ID NO: 30304 - DNA, 637 bp, Homo sapiens
  misc_feature: GYAE6OF02I9DS9.33.11.A11.1.454.CMB.1.raw
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagcttcgcccgggcacgttcccccacactgtgatttatgaacgttaaccaaagaccctcgtcggggtcccctgatcggttctcgtggctccggtcgacacgtcctcctcctaattcctcgtcccttcctccacctactctcgtggtactagaaacgtctggacggacgaggcttgtaattacttaacgtgtactacgtactatagtaataacgaaccctaccctagtgttcggttccgtccggggtaccgggggaccgtacggtccgtacgtcccgtacctggacgtccgacgacccgaacggtccgtcccgcccccgttccgtaccgtaccttccttccgttcccctacccgttcccgtcgtacggttcgttcgttcggttacgtggtacggtccgggtcgtcggaccgacggtccg

SEQ ID NO: 30305 - DNA, 529 bp, Homo sapiens
  misc_feature: GYAE6OF02GEV5E.33.11.A11.1.454.CMB.1.raw
  modified_base (256)..(256): a, c, t, g, unknown or other
  misc_feature (256)..(256): n is a, c, g, or t
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagcttcgcccgggcagttcccccacactgtgatttangaagttaaccaaagaccctctggggtccctgatcggttctctggctccgtcgacagctcctccaattctgcccttcctcaccatctctggactgaagctgaggacgaggctgtatattactgtcagtcctatgatacgaaccaccagtgtggttcgtcgggcggggaccagtctgaccgtctgagtcacgcccaggcctcgccccgtgtccactctcgttcccacctccgtctagttgtgttcgtacgtcggacggccggctcggcgaggccg

SEQ ID NO: 30306 - DNA, 755 bp, Homo sapiens
  misc_feature: GYAE6OF02HBENH.33.11.A11.1.454.CMB.1.raw
  modified_base (178)..(178): a, c, t, g, unknown or other
  misc_feature (178)..(178): n is a, c, g, or t
tcagtacacacactcacgaccggtgctcgatttagctacgactgcaggggccactgtcttctccactacttctcaccctcctcgctcactgcacaggttcttgggccaattttatactgagtcagccccactctttgtcgggtctccggggaagacggtgagcatatcctgcacccgnagcagtggcagcatcgtcgacaactatgtgcactggtaccagtcttcgcccgggcacgttcccccacactgtgtatttagtgaaagttaaaccaaacgtaccccttcgtcggggtcccctgacgttcggttctcgtcggtccttccggtcgacacgtccttccctacctaatttccgtacgtcccctttcctaccaaccctattccgtacgtcggtaacctaggaaacgtccgttaggaacgggacgtaggtacttaggtaaactttacgttacgttcgttaccgtacgtttaccctagtacgtaacgttaaaccgaaaccccacccgtacgttacggtttacgggttaccggtccgggggtaccggggggtaaccctacggttacccgtcggtacccggttccgtacggtacggtaccgtaaccggacccgtaacggtcccgttcccgtcccccgttacggtccctaaccgttccgttaccccggttacccctaccccgttccgtacgttacggttcgttacggttcgttaccggtacggtacgggtccgggtaccgtcgggtaccggacggtccg

SEQ ID NO: 30307 - DNA, 628 bp, Homo sapiens
  misc_feature: GYAE6OF02HOGJE.33.11.A11.1.454.CMB.1.raw
  modified_base (258)..(258): a, c, t, g, unknown or other
  misc_feature (258)..(258): n is a, c, g, or t
  modified_base (336)..(336): a, c, t, g, unknown or other
  misc_feature (336)..(336): n is a, c, g, or t
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagtcttcgcccgggcacgttcccccacactgtgatttangaagttaaccaaagccctgtgggtccctgatcggttctctggcctccgtcgacagcctcctcaattctcgcccttccncacctatcctctggactgaacgctggaggacgaggcttgtaatacttacgtgtctagtcctatgaataacgaacccacctattcggttcggttcggtcggggacgggggtacctagtccgtccgaccgttcctacggtacgtcgaccgtaccccgtaacgggcctcccggtcccccgttcggtacctacccgttccgtccgttcccccgtacccgttcccgtccgtacggttcggtcgttacgttaccgtcgggaccgggtccggggtccgtacggggaccgtaagggtccg

SEQ ID NO: 30308 - DNA, 891 bp, Homo sapiens
  misc_feature: GYAE6OF02HJ7PS.33.11.A11.1.454.CMB.1.raw
  modified_base (239)..(239): a, c, t, g, unknown or other
  misc_feature (239)..(239): n is a, c, g, or t
tcagtacacacactcacgaccggtgctcgatttagctacgactgcaggggcacgtgtccttctcccacgtactttcctacgaccctccttccgccttcgactgccaacgaggtttaccttggggacccaaatttttaatacgtgagtaccagccccacgttcggtttggtcggggtcgtccggggaagttacggtgtagtcactatccgtgccaccgtcaggtctaggtcggacgacgngtaggtacgggttaccgggaacgtaacgttaggtccgggtcgggtactacgttacgggtacctacgtccgttcggcccgggtccgtaccgtaccccccgtaccgtactcggtagtaactttacgaacgtaacgttaacctaacggtacccttggtccgggtccgtgacgttcggttcctcggtagggtaccgtccgtacgacgtcggtccttccgtacctaagttctccgtaccctttcctaccgaacttgttaccgtcggtacggtaacgtacgtaacggtaccggtacggaacggtacggtaggttacggttacggttaacttagttacccgtagtttcctaaccggttacccgttaagtaggtaaaacccgtaacccggtaaaccccctaacgttaaccggtttccgggtttacggttacccgggtccggggtacggggtaacccgttagtacccggtacgtaaccccggttcgacggtaacgtcccggaaccgacccggtacgtaccgtcccgttacccgtacctacttacccgtccgttacccgtaccctcccgtttaaccgtcgttacggtttccgtaacgtttaccggtacgtttccgggacggggttaaccggccggtttaaccggccgggtacccgttacggg

SEQ ID NO: 30309 - DNA, 828 bp, Homo sapiens
  misc_feature: GYAE6OF02FL0JJ.33.11.A11.1.454.CMB.1.raw
  modified_base (184)..(184): a, c, t, g, unknown or other
  misc_feature (184)..(184): n is a, c, g, or t
tcagtacacacactcacgaccggtgctcgatttagctacgactgcaggggccactgtcttctccactacttctcaccctcctcgctcactgcacaggttcttggggccaatttttatactgagtcagcccccactctttgtccggggtctccggggaagacggtgagcatatcctgccacccgnagcagtggcagcatcgtcgacaactatgtgcacgtggtaccacgtccttccggccccgggctaccgttccccccacacttgtagtacttttaagtagaaacgttaaacccgaaacgtacccctcgttaccgggggttccccctaggtaacgttccggtttctcctcgggtccccttacccggtcgaactagtccctcccgtacctaactttccttcgtcccctttccccaccaacctactccgttcgtaggtaccgtagaacggtaccgttagggaacgggtaccggaggtcctaagttacttaaccgtttaccgtgtaccgtacgttacccgttagtacgtaaacgtaaccgtaaaccccgtaccccgtacgttacggttccggttacccgggtacccggggtaccggggggttaaccctacggttaccgttaccggtaacccggttccgtacggtaaccgttaccgaaccggacccggtaaccggttccgtacccgtaccccggttaccgtaccgtacccgttcccgttacccggttacccccgtccccgttacccgtacggtaccggttacggtacggttaccggttaccgtacggggtaccggtaccgggttccgtacccgggtaccgtaccgggtaccg

SEQ ID NO: 30310 - DNA, 1014 bp, Homo sapiens
  misc_feature: GYAE6OF02JNNCF.33.11.A11.1.454.CMB.1.raw
  modified_base (176)..(176): a, c, t, g, unknown or other
  misc_feature (176)..(176): n is a, c, g, or t
  modified_base (260)..(260): a, c, t, g, unknown or other
  misc_feature (260)..(260): n is a, c, g, or t
tcagtacacacactcacgaccggtgctcgatttagctacgactgcagggccactgtcttctccactacttctcaccctcctcgctcactgcacaggttcttgggccaattttatactgagtcacgcccactcttgtcgggtctccgggaagacggtgagcatatcctagcacccgngagccaggtggacaggcacgtcgtacgaactaacctagtcgtggacaccgtagggtaccacgttacgttccggaccccggggtntaccgttcccccccaacggtaccttggtagttaaccttttaagttacggaaaaccgttttaaaccgtaaaaccgtcccccggttacgttccgggggggttaaccccctcggttaacggttccggggttttaccctacccgtttacgggggtcccctttaacccccggggttacgaaaacccgttaaacgggtccccttttaaccccccgggtttaaccttaaaaccccggtttttaactaccggggttttaccccccgtttttaaccccccttccccggaaaaaccccgtttttacccgttcccgttttaaaaccccggggtaggtttaaaccccgttcgggggtttaaaaaacgccgggtacgggggtttaaacgggaaaaccccgggttacggttaacggggttttaacgtaaaaccgttttaccgtttaaaccggggcgggtttttaacccacggttttaacccgttaacggttaccgttaaacgtaaacccggtaacccccttaaccggtaaccggtttacgggtttaccggttccgggttaccgggggaccggggggtacctaccgggttacgcccggttaaccgtccggacggtacgtaccggtaacgaccgtacggtacctcccggtacccgttaccgccgttaccgttccggtcccttaccgggtccctcccgttaacgtccggttcggttacgttccggtacgttacgggcggtaacccgggtcgtacggggtaccaccggtacg

SEQ ID NO: 30311 - DNA, 703 bp, Homo sapiens
  misc_feature: GYAE6OF02FPH79.33.11.A11.1.454.CMB.1.raw
  modified_base (178)..(178): a, c, t, g, unknown or other
  misc_feature (178)..(178): n is a, c, g, or t
  modified_base (260)..(260): a, c, t, g, unknown or other
  misc_feature (260)..(260): n is a, c, g, or t
  modified_base (324)..(324): a, c, t, g, unknown or other
  misc_feature (324)..(324): n is a, c, g, or t
tcagtacacacactcacgaccggtgctcgatttagctacgactgcaggggccactgtcttctccactacttctcaccctcctcgctcactgcacaggttcttgggccaattttatactgagtcagccccatctttgtcggggtctccggggaagacggtgagcatatcctgcacccgnagcagtggcagcatcgtcgacaactatgtgcactggtaccagtccttcggcccgggcacgttcccccacacgtgtgatttangaaacgttaaccaaagtccctcgtcggggtccctgtacttcggttctcgtggctccggtcgacngcctcctcctaattcctcgtccctttcctccaccgtattcctcgtacggtactaggaacgtacgtggaacgggtacgaggtccttagttaacttattaccgttcgtactacgttacctagtacgtaacgtaacgaaccctacccgtagttcgggttcgggtttaccggtccgggggtaccgggggtaacctacgggttcgtaccggttacccgttccgttagggtaccgttacgaccggtacccgtaagggtcccgttccggtacccccgttcggtaccctaccgttccgttacccgttccccgtacccttcccgtccgtacggttacgttcggtcgttacgtcggacgggtccgggtccgtcgggaccgacggtaccg

SEQ ID NO: 30312 - DNA, 742 bp, Homo sapiens
  misc_feature: GYAE6OF02GI0HD.33.11.A11.1.454.CMB.1.raw
  modified_base (261)..(261): a, c, t, g, unknown or other
  misc_feature (261)..(261): n is a, c, g, or t
tcagtacacacactcacgaccggtgctcgatttagctacgactgcaggggccactgtcttctccactacttctcaccctcctcgctcactgcacaggttcttgggccaatttttatactgagtcagccccactctttgtcggggtctccggggagacggtgagcatatcctgcacccgcagcagtggcagcatcgtcgacaactatgtgcacgtggtaccagcttccggcccgggcacgttcccccacactgtgtatttangtaacgttaaccgaaacgtccctcgtcggggtcccctgacgttcggtttctcgtcggtcctccggtcgaacacgtccttaccctacctaatttccgtcgtcccctttaccctaccaccctacttccgtcgtacggtaactaggaaacgtacgtagggacggacgtacggtcttagttaacttaacgttacgtcgtactacgttaccttagtagtaactaaccgaaccctacccgtagttcgggtttcggttaccggtccgggggtaccgggggtacctacggttccgtaccggtacccgttcgtacggacgttaccgaccggtacccgtaacggtcctcccggtcccgttccggtacctaccgttccgttcccgttaccccctaccccgtttcctaccggttacggttcggtaccggtttaccggtaaccgggtacgggtccgggtaccggttaccgggtaccggacgggtcccgtaacgg

SEQ ID NO: 30313 - DNA, 964 bp, Homo sapiens
  misc_feature: GYAE6OF02IMVE7.33.11.A11.1.454.CMB.1.raw
  modified_base (165)..(165): a, c, t, g, unknown or other
  misc_feature (165)..(165): n is a, c, g, or t
  modified_base (184)..(184): a, c, t, g, unknown or other
  misc_feature (184)..(184): n is a, c, g, or t
tcagtacacacactcacgaccggtgctcgatttagctacgactgcaggggccactgtcttctccactacttctcaccctcctcgctcactgcacaggttcttgggccaattttatactgagtcacgcccctacttctttggtcggggtctccggggaagacggtnagcatatcctgccacccgnagcagtcggcagcatcgtacgactaactgtgtcgcacgtcggaaccagtcgttccggcccgggacaccgttccccccacactgtcgtaatttagagtaaacgttaaaccgaacgacccgttccggtcggggttaccctggtacttccggttctcggttacggaccgtcccgtaccggtacgaccggtcccttacccgtacttaaaccgttcccgttcgttaccccgtttacctcccgtaacccttaaccttcgttacccggttaggttaaccggaacgggaaacggttaaccgttagggtaaacggaaccgggtaacggtacggttaacggttaaccgtttaacgttacgtttacgttaccgtttaaccgtacgttaacgtagtaacgtaacgtaaccccgtaaaccgtcgttaggggttaccggggttaccggtacccggggggtacgggggtaacccgtacgggttaccggttacccgggtacccgttaccggttaacgggaacggtttacccgaacccggggaaccccggttacggggtaacccccgttcccccgggttaaccccccgggttacccgttaacccggttaaccccgttccccgttttaccccggggtttaccccccgttaccccggtttaaccccggttaacccgggttttacggtttcccgggtttaaggtttaccccggtttaccggggttaccgggtaacccggggttaaccggggtttacccccggggtaggggtttaaccccggggaaaacggggtccccggg

SEQ ID NO: 30314 - DNA, 670 bp, Homo sapiens
  misc_feature: GYAE6OF02G9V0A.33.11.A11.1.454.CMB.1.raw
  modified_base (263)..(263): a, c, t, g, unknown or other
  misc_feature (263)..(263): n is a, c, g, or t
  modified_base (544)..(544): a, c, t, g, unknown or other
  misc_feature (544)..(544): n is a, c, g, or t
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcacgtggtaccagcttccggcccgggcacgttcccccacactgtcgtattttanacgtaaagttaaaccaaacgtaccccttcgtacggggtcccctaggtacgttccgggttctcgttcgggccttccggtacgaacgacgtccttaccctccgtaatttccgtcgtccctttcctcctacctactccttacgtcggtactacgaagtacgtaggaacggacggtacggtctacgttattactttactcgtactacgtacctatacgtaataccgaaccacctgtcggttacggttcggtcggggtcggggacctacggttctacgtccgtacnggtacgtccgacgtccgaacgtccgtacccgccccgttcggtacctccgttaccttcccgttacccaccttccgtagtacggttctacgtcgttacgcggtcggtccggacgtacggtcgacggtc

SEQ ID NO: 30315 - DNA, 703 bp, Homo sapiens
  misc_feature: GYAE6OF02I2QG6.33.11.A11.1.454.CMB.1.raw
  modified_base (205)..(205): a, c, t, g, unknown or other
  misc_feature (205)..(205): n is a, c, g, or t
  modified_base (259)..(259): a, c, t, g, unknown or other
  misc_feature (259)..(259): n is a, c, g, or t
tcagtacacacactcacgaccggtgctcgatttagctacgactgcaggggccactgtcttctccactacttctcaccctcctcgctcactgcacaggttcttgggccaattttatactgagtcagccccactctttgtcggggtctccggggaagacggtgagcatatcctgcacccgcagcagtggcagcatcgtcgacaactntgtgcactggtaccagtcttccgcccgggcacgttcccccacactgtgatttangaagttaaccaagcccttgtcggggtcccctgacttcggttctccgttaggccttccggtacgacctacgtccttccctacctaactttcctcgtcccctttccacaccctattccgttacgtcggaacttacgaaacgtcttgggaacggacgtaggccttagttaacttatttacgtcggtactacggttaccttaagtacgtaactaaccggaaaccctaccctagttcgggttacggttccggtaccgggggaccgggggtactacggttccgttacggacccgttcgtggtacgtacgtaccggacccgtacggtccgtcccggtacccccgttggtaccctaccgttccgttcccgttccccgtacccttcccgtcggtacggttcgttcgttcgttaccgtcgggtacggccggtacgcgggtaccgtacggtccgg

SEQ ID NO: 30316 - DNA, 710 bp, Homo sapiens
  misc_feature: GYAE6OF02H67PZ.33.11.A11.1.454.CMB.1.raw
  modified_base (177)..(177): a, c, t, g, unknown or other
  misc_feature (177)..(177): n is a, c, g, or t
  modified_base (238)..(238): a, c, t, g, unknown or other
  misc_feature (238)..(238): n is a, c, g, or t
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
  modified_base (385)..(385): a, c, t, g, unknown or other
  misc_feature (385)..(385): n is a, c, g, or t
  modified_base (432)..(432): a, c, t, g, unknown or other
  misc_feature (432)..(432): n is a, c, g, or t
  modified_base (449)..(449): a, c, t, g, unknown or other
  misc_feature (449)..(449): n is a, c, g, or t
tcagtacacacactcacgaccggtgctcgatttagctacgactgcaggggccactgtcttctccactacttctcaccctcctcgctcactgcacaggttcttgggcctaattttatactgagtcagccccattctttgtcgggtctccggggaagcggtgagcatatcctgcaccgnagcagtggcagcatccgtcgaacaaactatgtcgcacgtggtaccagtcttcggcccgggnacgttcccccactactggtntactttanagtaattaaaccgaaagtccccttacgtcggggtacccctggtaatcggttctacgtggcctacggtcgtacagcctcctccaatttctgtcccttctcacctagtctctggactgaanctggagacgaggtctacgtattacttacgtgtacctagtacctagtnaagtaccaaaccgaccngttaggtcggttcgtaccgggggacggggtacctaggtcgtacgtaccgtcgtagaacgtaccgaaccggtacccgaaacgggtccctaccgggtacccccccgttagggtaccctaacccgtttcccgttacccggtttccccccgtacccgttacccggttcggtaaccggtttacgggttcggtttaaccggaccggtttacgggaaccggggttccgggtacccggttaacgggtacccggaaacggggttacccgg

SEQ ID NO: 30317 - DNA, 488 bp, Homo sapiens
  misc_feature: GYAE6OF01BHCUY.33.65.F10.1.454.CMB.1.raw
  modified_base (426)..(426): a, c, t, g, unknown or other
  misc_feature (426)..(426): n is a, c, g, or t
  modified_base (469)..(469): a, c, t, g, unknown or other
  misc_feature (469)..(469): n is a, c, g, or t
tcagtacacacactcacgaccggtgctcgatttagctacgctctaagggggagtcagtctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaagttcctagactcctgatctatggtgcatccactttgcaatcaggggtcccatctcgcttcagtggcagtggatttgggacagatttcactctcaccgtcaccagcctgcaggctaaaagattttgcaacttattactgtcaaaagtatgacagtgcccgntcactttcggccctgggaccaaagtggaaatcaaacgaactgnggctgcacatctgtcttac

SEQ ID NO: 30318 - DNA, 489 bp, Homo sapiens
  misc_feature: GYAE6OF01CCVBZ.33.65.F10.1.454.CMB.1.raw
tcagtacacacactcacgaccggtgctcgatttagctacgctctaaggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaaactccctgatcgtatgctgcgtccagtctgcaaagtgggtccatcaagttcagtgcagtggatctgggacagatttcactctcaccatcagcagtctgcaacctgaaagtattttgctaactttacttctgtcaacacagttacaattcctacccgtacacttttggcctaggggaccaagctggagatcaggcgaactgtagctgcacctacg

SEQ ID NO: 30319 - DNA, 495 bp, Homo sapiens
  misc_feature: GYAE6OF01AWMAW.33.65.F10.1.454.CMB.1.raw
tcagtacacacactcacgaccggtgctcgatttagctacgctctaaggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaatggtatcagcagagaccagggaaagcccccaaactcctgatctctgccgcatccgatttacacaatgggtcccatcgaggttcagtggcagtggatctgggacagatttcactctcaccataagcagtctggaacctgaagtattttaggaagtattactttctgtcaacagacttataagtaacccgtactacttttggaccaggggaccaaggctggatatcaagcgaacgtgtggctgcacatctgtcttc

SEQ ID NO: 30320 - DNA, 495 bp, Homo sapiens
  misc_feature: GYAE6OF01EGSAM.33.65.F10.1.454.CMB.1.raw
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggaaagcccctaaggtcctgatctatgctgcgtccagttttgcagagcggggtcccatcaaggttcagtggcagtggatcgtgggacagtatttcactctcaccatcagcagtctgcaacctgaagtattttgctaacttacttctgtcaacacaagttacaatctacccgttactacttttggcctaggggaccaagctggagatcgaggcgaacgtgtggctgcncnttcg

SEQ ID NO: 30321 - DNA, 479 bp, Homo sapiens
  misc_feature: GYAE6OF01AH5TK.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaactcctgatctatgctgcgtccagtctgcaaagtgggtcccatcaaggttcagtggcagtggatctgggacagatttcactctcaccatcagcagtctgcaacctgaagatttgctaacttacttctgtcaacacagttacaatctccgtacactttgccagggaccaagcgtggagatcgaggcgaactgtggctgcactacg

SEQ ID NO: 30322 - DNA, 501 bp, Homo sapiens
  misc_feature: GYAE6OF01DZB6H.33.65.F10.1.454.CMB.1.raw
  modified_base (253)..(253): a, c, t, g, unknown or other
  misc_feature (253)..(253): n is a, c, g, or t
  modified_base (462)..(462): a, c, t, g, unknown or other
  misc_feature (462)..(462): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctcctgtctgcatctgtcggagacagagtcaccatctcttgccgggcaagtcagagcatcgtcgctatttaaattggtatcagcanaaacaggcaagcccctaaactctgatctatgctgcgtccagtctgcaaagtgggtccatcaaggttcagtgcagtggatctggacagatttcactctcaccatcagcagtctgcaacctgaagtatttacgactaacttacttctcgtacaacactaagttacaacttcctcccgtactacttttacggcctagggaccaagcgtgganagtcgaacggtcgaacgtgtaggtcgtcgcgaccctacg

SEQ ID NO: 30323 - DNA, 550 bp, Homo sapiens
  misc_feature: GYAE6OF01BYYS7.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtcgctatttaaattgtatcagcagaaccaggcaagcccctaaactcctgatctatgctgcgtccagtttgcagagcgggtccatcgaaggttcagtggcagtggatcgtgggacagtattcactctacaccatcagcagtctgacaacgtagaagtatttcgactaacttactactagtacaacagactacaaccaaccacccctattacctaccgtttccggtaccccgtacgggaaccctacgtacggtaggtaacgttacggtaacccaaacccggtaacgttcggtacgggtacccttcggaccctacccgttaacg

SEQ ID NO: 30324 - DNA, 562 bp, Homo sapiens
  misc_feature: GYAE6OF01BV3DD.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctcccaccctccctgtctgcatctgtcggagacagagtcaccatctcttgccgggcaagtcagagcatcgtccgctatttaaattggtatcagcagaaaccagggcaacgcccctaaactcctgatctatgctgcgtccagtctgcaaagtggggtcccagtcaaggttcagtggcagtggatcgtgggacagtatttcactctcaccatcagcagtctcgcaacctgtaagtattttacgactaactttacttctacgtacaacactaacgttacctaacttcccttaccccgttaacgttaccgttttcgggacccgtaacggggacccaaacggtcgttacgggaagacgtccgaaggtacggtaaacgttcgggttacggactcgaccgtaccctacg

SEQ ID NO: 30325 - DNA, 525 bp, Homo sapiens
  misc_feature: GYAE6OF01DDKJV.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctcctgtctgcatctgtcggagacagagtcaccatctcttgccgggcaagtcagagcatcgtccgctatttaaattggtatcagcagaaccagggcaagcccctaaactcctgatctatgctgcgtccagtctgcaaagtcgggtccatcgaaggttcaggtggcagtggatcgtgggacagtatttcacttctcaccatcagcagtctagcaacctgaagtattttgacctaactttacttctgtacaactactaacgtttaacaattcctcccgttaactacgttttcggacccgtaggggacccaaggcgtaggagacgtcgaggtacgaacgttggtacggctcgccgactacg

SEQ ID NO: 30326 - DNA, 494 bp, Homo sapiens
  misc_feature: GYAE6OF01BL877.33.65.F10.1.454.CMB.1.raw
  modified_base (413)..(413): a, c, t, g, unknown or other
  misc_feature (413)..(413): n is a, c, g, or t
  modified_base (480)..(480): a, c, t, g, unknown or other
  misc_feature (480)..(480): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaactcctgatctatgctgcgtccagtctgcaaagtgggtccatcaagttcagtgcagtggattgggacagatttcactctcaccgtcaccagcctgcaggctgaagtattttgactaacttattactagtacaaaagtntagactagtcggcccgtctctacgttcggcccgtgggaccaaagtaggaaatcgaaacgactgtcgntgcacatctgtctc

SEQ ID NO: 30327 - DNA, 487 bp, Homo sapiens
  misc_feature: GYAE6OF01B9EBX.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaactcctgatctatgctgcgtccagtctgcaaagtgggtcccatcaaggttcagtggcagtggatctgggacagatttcactctcaccatcagcagtctgcaacctgaaagtattttgactaactttacttctgttcaacacagttaacaatcctcccgtacactttcggccagggaccaagcgtggagatcaggcgaactgtgctgcactag

SEQ ID NO: 30328 - DNA, 539 bp, Homo sapiens
  misc_feature: GYAE6OF01DML5B.33.65.F10.1.454.CMB.1.raw
  modified_base (215)..(215): a, c, t, g, unknown or other
  misc_feature (215)..(215): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggnaagtcagagcatcgtcgctatttaaattggtatcagacaagaaaccgagggacaacgcccctaaactcctgatctatgctgcgtcagtctgcgaaagtcgggtaccatctaaggtcagtgcagtgatgtaggacagtattcactctcacatcagcagtctagtaactgaattatttagactaacttacttctagtacaacactagttaacaacttcctaccgtacttacgtttcggaccgaacggggtaccaagtccgtagggaacgtaatacggaacgggtaccgtaaacgttcggtcggacttcggacctaccgtattcccg

SEQ ID NO: 30329 - DNA, 486 bp, Homo sapiens
  misc_feature: GYAE6OF01ELPNJ.33.65.F10.1.454.CMB.1.raw
  modified_base (481)..(481): a, c, t, g, unknown or other
  misc_feature (481)..(481): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaactatttaaattggtatcaacagaaaccagggaaagcccctaaggtcctgatctatgctgcgtccagtttgcagagcgggtccatcaaggttcagtggcagtggatcgtggacagatttcactctcaccatcagcagtctgcaacgtgaagtattttgactaacttactactgtacaacagagtacacaacacccctattcactttcgccgtggaccacagtgatgtacaccgactgtagctgcacctntctcg

SEQ ID NO: 30330 - DNA, 504 bp, Homo sapiens
  misc_feature: GYAE6OF01A5EWQ.33.65.F10.1.454.CMB.1.raw
  modified_base (500)..(500): a, c, t, g, unknown or other
  misc_feature (500)..(500): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccggcaagtcagagcatcgtccgctatttaaattggtatcagcagaaaccagggcaagcccctaaactcctgatctatgctgcgtccagtctgcaaagtgggtcccatcaagttcagtgcagtggatctgggacagatttcactctcaccatcagctagtctgactaacctgaagtattttgctagtttattactgtcagcagcgtagctaacgtggtacttggaccgttcggaccgaagggaccgaaggtaggaaactcgaaaacggtactaggtcggctagccaccgtntccg

SEQ ID NO: 30331 - DNA, 578 bp, Homo sapiens
  misc_feature: GYAE6OF01CVGEB.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcacatctcttgccgggcaagtcagagcatcgtcgctatttaaatggtatcagcaagaaccaggacaagacccctaaactcctagatctatgctgcgtccagtctgacaaaggtcgggtcccagtcaaggttcagtggcagtgatcgtggacagtattcactctcaacatcagcagtctagacctaacgtgaagttattttacgacttaaacgtttcttactagtacaaactactaacgtttacaacttcccttaccgtacttacgtttacggaccgtaacggggacctaaggtccgttaggggaagtacgttaacccggaacggggtaaccctaaacggtttcgggtaccgggtacgttaccggccctaaacccgttaacg

SEQ ID NO: 30332 - DNA, 510 bp, Homo sapiens
  misc_feature: GYAE6OF01DBPTA.33.65.F10.1.454.CMB.1.raw
  modified_base (341)..(341): a, c, t, g, unknown or other
  misc_feature (341)..(341): n is a, c, g, or t
  modified_base (500)..(500): a, c, t, g, unknown or other
  misc_feature (500)..(500): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcaagaaaccagggcaagcccctaaactcctgatctatgctgcgtccagtctgcaaagtgggtccatcaaggttcagtgcagtggatcgngggacagtatttcactctcacatcagcagtctgacaactagaagtatttgactaactttacttctgtacaacgtactaagttaactaactcctacccgttactaccgttttggaccgtacgggacctagcgtaggagatcgaggacgaacgtgtacggntcgcactacg

SEQ ID NO: 30333 - DNA, 562 bp, Homo sapiens
  misc_feature: GYAE6OF01CSPBQ.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctcctgtctgcatctgtcggagacagagtcaccatctcttgccggcaagtcagagcatcgtccgctattaaatggtatcagcagaaaccagggacaacgccccctaaactcctgatctatgctgcgtccagtctgcaagtcgggtccatcaagttcagtcgcagtggatcgtgggactagtactttcacttctacaccatcagctagtctcgacaactgaacgtatttacgacctaactttacttctacgtactaactactacgttaacctacttccttacccgttacttacgtttacgggaccgtaacggggaccctaaggtcgtacgggaacgtaacgtccggaacgggtaccgtaaacgttcgggtacggtacctcggacccgtaccgtacg

SEQ ID NO: 30334 - DNA, 540 bp, Homo sapiens
  misc_feature: GYAE6OF01EZL1U.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaatggtatcagcagaaaccagggcaacgacccctaaactcctagactctatgctgcgtccagtctgacaaaggtggggtacccatcaaggttcagtggcaggtggatcgtgggactaggtactttcacttctcaccatcagcagtctgactaacctagtaagtatttagactaactttacttctgtacaactactaacgttactaacttccttaccgtactaccgttttcggaccgtacggggaccaacgtcgtaggagtacgtcgacggtacgaacgtcggtcggactcgccacctacg

SEQ ID NO: 30335 - DNA, 510 bp, Homo sapiens
  misc_feature: GYAE6OF01ATG3P.33.65.F10.1.454.CMB.1.raw
  modified_base (495)..(495): a, c, t, g, unknown or other
  misc_feature (495)..(495): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagggtcaccatcacttgccgggcaagtcagagcataagcaactatttaaaattggtatcaaacagaaaaccagggaaagcccctaaaggtcctgatctatgctgcgtccagtttgcagagcggggtcccatcaaggttcagtggcagtggatcgtgggacagatttcactctcaccatcagcagtctgcaacgtgaaagtattttagctaacttactactgtacaacagagtcaacaaccaccctattccactttccggccctgggacccacgagtcggatcgtacaaccgaactgtggctcncaccatcgtgttacc

SEQ ID NO: 30336 - DNA, 547 bp, Homo sapiens
  misc_feature: GYAE6OF01BVJKD.33.65.F10.1.454.CMB.1.raw
  modified_base (94)..(94): a, c, t, g, unknown or other
  misc_feature (94)..(94): n is a, c, g, or t
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (401)..(401): a, c, t, g, unknown or other
  misc_feature (401)..(401): n is a, c, g, or t
  modified_base (414)..(414): a, c, t, g, unknown or other
  misc_feature (414)..(414): n is a, c, g, or t
tcagtacacacactcacgaccggtgctcgatttagctacgctctaaggggagtcagtctcagtcaggacacagcatggacatgagggtccccgntcagctcctggggctcctgctactcgtggctccgaggtgccagatgtgacatccagatgacccagtctccaccctcctgtctgcagtctgtcgganacagagtcacgatctcttgccggnaagtcagagcatcgtcgatatttaatggtatcagtacaagaaaccagggtacaacgcccctaaacgtccctagatcgtatgctgcgtcgagtctagacgtaaggtcgggtaccatacgtaagtacgaggtcgacaggtagacgtcgtagggactagtactttacactctacactatacacgcagtcngacacgtgaagtntttgactaacgttactctagtaccaatactagttaactacgttcctaccgtaactacgtttacgaccgtagggaccctaagccgtaggacgtagtcgacggtacgaagttcggtacgtatcggactacgtacg

SEQ ID NO: 30337 - DNA, 537 bp, Homo sapiens
  misc_feature: GYAE6OF01B6A91.33.65.F10.1.454.CMB.1.raw
  modified_base (376)..(376): a, c, t, g, unknown or other
  misc_feature (376)..(376): n is a, c, g, or t
  modified_base (389)..(389): a, c, t, g, unknown or other
  misc_feature (389)..(389): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaactcctgatctatgctgcgtccagtctgcaagtgggtcccagtcgaaggttcagtggctagtggatcgtgggacagtatttcactctcacatcagcagtcngctaactgaagtntttacgctaacttctactcgtacaactactagttaccacttcctaccgttactacgtttacggccgtaaggggaccctaaggccgttagggaagtacgtccgaacgggtaccgtaaacgttcggtacggactacgcctaaccgttacg

SEQ ID NO: 30338 - DNA, 563 bp, Homo sapiens
  misc_feature: GYAE6OF01D1V49.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaactcctgatctatgctgcgtccagtctgcaaagtcgggtccagtcaaggttcagtggctagtgatcgtgggacagtattcactctcacatcagctagtctgacaaccgtagaagtatttgacttaactttacttcttagtacctaaactaactaacgtttaactaacttccgttaccccgttaactaccgtttttacggacccgttaacgggggaaccctaagggtccgtaagggagtaacggtcgaacgggtaccgaaacgttggtacggacgtcgccaaccgtacg

SEQ ID NO: 30339 - DNA, 513 bp, Homo sapiens
  misc_feature: GYAE6OF01CADNE.33.65.F10.1.454.CMB.1.raw
  modified_base (501)..(501): a, c, t, g, unknown or other
  misc_feature (501)..(501): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaacagggcaagccctaaactcctgatctatgctgcgtccagtctgacaaagtcgggtacccagtcaaggttcaaggtggcagtggatcgtaggacagtattcactctcacatcagcagtctcgacaacctagtaagtatttacgactaacttacttctagtacaactaactacgttaactaactccttaccgtactacgtttcggccgtacgggaccaagcgtggagactcgagtcggggactggngctcgcactacg

SEQ ID NO: 30340 - DNA, 605 bp, Homo sapiens
  misc_feature: GYAE6OF01B0X4G.33.65.F10.1.454.CMB.1.raw
tcagtacacacactcacgaccggtgctcgatttagctacgctctaagggggagtcgagtctcagtcaggacacagcatggacatggacgggtccccgctcagctccgtggggcctcctgctactctggctccgaggtgccagatgtgacatccagatcgacccagtcctccaccctccctgtctgcatcgtgtcggagacagacgtcaccatctcgttgccgggcaagtcagagcatcgtccgctattaatgtatcagcagaacaggacaacgccctaactctgatctatgctgcgtacagtctgacgaaggtcgggtaccagtcgaaggttcgaggtcggacgtaggtggtactcgtcggggactaggtactttcacttactacacctagtccagtcgtagtactcgactaaccgtagtaacgttactttacgacgtaactttacttctacgtactaactaactaagttaacctaacttacccttacccgttaacttaccgtttacggaccggtaacgggaccctaaggaccgtagggtaagtacgtaccggaacggtaccgtaaaccgttcgggtacggtaccttcggaccctacccgttacg

SEQ ID NO: 30341 - DNA, 542 bp, Homo sapiens
  misc_feature: GYAE6OF01AL6TN.33.65.F10.1.454.CMB.1.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcgganacagagtcaccatctcttgccgggnaagtcagagcatcgtccgctatttaaattggtatcagcagaaaccagggcaacgcccctaaactcctgatctatgctgcgtccagtctgcaaagtgggtcccagtcaaggttcagtggcagtgatctggacagtattcactctcaccatcagcagtctgacaactagaagtatttgactaacttacttctagtacaactactagttaactaactccttacccgtactacgttttacggacccgtaaggggaccctaagtaccgtagggtagtaacgtacgaacgggtaccgaaacgtgggtacggtaccgtcgtcccgtaccgtacg

SEQ ID NO: 30342 - DNA, 613 bp, Homo sapiens
  misc_feature: GYAE6OF01AKJ6N.33.65.F10.1.454.CMB.1.raw
  modified_base (193)..(193): a, c, t, g, unknown or other
  misc_feature (193)..(193): n is a, c, g, or t
  modified_base (222)..(222): a, c, t, g, unknown or other
  misc_feature (222)..(222): n is a, c, g, or t
  modified_base (274)..(274): a, c, t, g, unknown or other
  misc_feature (274)..(274): n is a, c, g, or t
tcagtacacacactcacgaccggtgctcgatttagctacgctctaagggggaggtcagtctcagtcaggacacagcatggacatgagggtccccgctcagctcctggggctcctgctactctggctccgaggtgccagagtgtgacatccagatgacccagtctccaccctccctgtctgcatcctgtcgganacagacgtcaccatctcttggcccggganaagtcagagctatccgtccgacttaatttaaattggtatcagcagaaaccgngggaccaacgcccctaaactcctagactctatgtctcgtccgtacagtctggacaacggtcgggacccagtccgtaagggttcaggtggctaggtggacttcggagggactagtactttcacttctaccacacgtcacggctacgtcgtacgactaacgtaggtaagttacgtttcgacctaactttacgttacacgttaaccaaccgttactaacggttacctaacgttcccttacccgtaccgttacggtttcggaaccggacgggtaaccacggtacggtcggaagtacctcggacgggacccgtaagtcggttacggactctccggacttaccgg

SEQ ID NO: 30343 - DNA, 498 bp, Homo sapiens
  misc_feature: GYAE6OF01CEJBB.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaactcctgatctatgctgcgtcagtctgcaaagtgggtccatcaaggttcagtggcagtggatcgtgggacagtatttcaactctcaacatcagcagtctgacaacgtgaagtattttgactaactttactactagtcaacagacgtacaacaaccaccctattccactttccggaccctcgggaccacgagtgatcgtaccaacgactgtagctcgctactac

SEQ ID NO: 30344 - DNA, 546 bp, Homo sapiens
  misc_feature: GYAE6OF01B303M.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcaagaaaccagggcaagcccctaaactcctagatctatgctgcgtccagtctgacaaaggtcggggtcccatcaaggttcagtggcagtggatcgtgggacagtatttcacttctcaccatcagcacgtctcgactaacctagtaagtagttttagactaactttacttctacgtacaacactagttaactaacttccttacccgtacttacgtttcggaccgtacgggacctaacggcgtcggaagtacgtaccgagggtaccgaacgttcggtacggactcgccaccgtacg

SEQ ID NO: 30345 - DNA, 501 bp, Homo sapiens
  misc_feature: GYAE6OF01B8KTK.33.65.F10.1.454.CMB.1.raw
  modified_base (495)..(495): a, c, t, g, unknown or other
  misc_feature (495)..(495): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagaccccctaaactcctgatctatgctgcgtccagtctgcaaagtcgggtcccatcaagtcagtggcagtggatcgtggacagattcactctcaccatcagcagtctgacaacctgaagtattttgactaactttattactagtacaaagtatgactagtcggccgtctactacgttccggccgtaggacctaaaggtacgaaatacgaaacgactgtgctagacaccntcgtcg

SEQ ID NO: 30346 - DNA, 529 bp, Homo sapiens
  misc_feature: GYAE6OF01CF59T.33.65.F10.1.454.CMB.1.raw
  modified_base (215)..(215): a, c, t, g, unknown or other
  misc_feature (215)..(215): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggnaagtcagagcatcgtccgctatttaaattggtatcagcagagagaaggggaagttctagactcctgatctatgtgcatccactttgcaatcagggtcccatctcgcttcagtggcagtggtatttgggactagtattcactctcacgtcaccagcctgcaggctagaagtattttgactaactttattactagtacaaaagttatagactaggtcggccctctcctaccgtttcggccccgtagggaaccctaaaggtacggtaaataccgtaaaacggtaactggtacggtcgtacgaccacctatcgttacg

SEQ ID NO: 30347 - DNA, 548 bp, Homo sapiens
  misc_feature: GYAE6OF01DLULU.33.65.F10.1.454.CMB.1.raw
  modified_base (214)..(214): a, c, t, g, unknown or other
  misc_feature (214)..(214): n is a, c, g, or t
  modified_base (379)..(379): a, c, t, g, unknown or other
  misc_feature (379)..(379): n is a, c, g, or t
  modified_base (421)..(421): a, c, t, g, unknown or other
  misc_feature (421)..(421): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccggnaagtcagagcatcgtccgctatttaaattggtatcagacagaaaccagggcaacgcccctaaactcctgatctatgctgcgtcagtctagcaaaggtcgggtacccagtcgaaggttcaggtggacaggtggatcgtagggacagtattcactctacactatacngtcagtctgacaccgtagaagttattttcgacttaaccgttnttctatacaacactagttaacacttcctacccgttacttacgtttcggaccgtacgggaccaacggtcgtacgagtacgttacgagggtaccgaacgttcggtacgtaccttcggacctccgtaccg

SEQ ID NO: 30348 - DNA, 563 bp, Homo sapiens
  misc_feature: GYAE6OF01A9RT6.33.65.F10.1.454.CMB.1.raw
  modified_base (190)..(190): a, c, t, g, unknown or other
  misc_feature (190)..(190): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcgganacagagtcaccatctcttgccgggcaagtcagagcatcgtccgcttaatttaaattggtatcagcaagaaaccagggaccaagccccctaaactcctagatctatgctcgcgtccagtctgacaaaggtcgggtacccagtacgtaaggttcagtggctaggtggatcgtagggactagtactttcacttctacaccatcagcagtctgacctaaccgtgtaagtatttgattagtttattctagtcagcgagtcgtagcctaagtcggtcttacgggaccgttccggaccgtaaacgggtacccgtaagggttacgaaaacgtacgaaaaccgtacgtacggtacggtacctagaccctaccgtagttcccg

SEQ ID NO: 30349 - DNA, 570 bp, Homo sapiens
  misc_feature: GYAE6OF01D5DIW.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccggcaagtcagagcatcgtccgcttaatttaaattggtatcagcaagaaaccagggacaacgcccctaaactcctgatctatgctgcgtccagtctgacgtaaaggtcgggtacccagtcgtaaggttcaggtcggctaggtggatcgtagggactagtatttcactctcacctatcagctagtctcgactaacgtagtaagttattttacgaccttaactttactttctacgtacaaactactaacgttaactaacttccctacccgttactaccgtttacggaccgaacgggtacctaagcgtacggagtacgtcgaacggtaccgtaacgtcggtacggactacggacctacgtacg

SEQ ID NO: 30350 - DNA, 511 bp, Homo sapiens
  misc_feature: GYAE6OF01B19UJ.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaacgcccctaaactcctgactctatgctgcgtccagtctgcaaagtgggtcccatcaaggttcaggtggcagtggatcgtgggacagattcactctcaccatcagcagtctcgacaactgaagtatttgactaactttacttctcgtacaactactagttactaatcctaccgtactacgtttcggccgtacgggaccaagtcgtggatacgtcgaggacgtaactggtcggactcgcctcctacg

SEQ ID NO: 30351 - DNA, 650 bp, Homo sapiens
  misc_feature: GYAE6OF01EZE02.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcgttcggccgggacaagtcaggacgcacttcgtccgtcttaattttaaagttggttatcaagacaacgaaaaccgagggaccaacgaccccctaaactccgtagattactatgtcgtcgccgtctagtctgacgtaaaggtcggggtacccagtacgaaggttcgaggtcggctaggtggtatcgtagggactagtatttcacttctacacctatacagtcagttctacgactaacctagtaagttattttacgacttaacctttactttacgttacgtaaccaaactaaccttaacgtttaaacctaactttacccgttaccccgttaacttaccggttttaccgggaccggttaaaccgggggaacccgtaaggtaccggttaacgggtaagtacgtacggacgggtacgtaacgtcgggtacgtaccgtcgacctccgtacg

SEQ ID NO: 30352 - DNA, 606 bp, Homo sapiens
  misc_feature: GYAE6OF01AZ02E.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctcccaccctccctgtctgcatctgtcggagacagagtcaccatctcttgcagggcaagtcagagcatccgtcgtacttaatttaaagttggtatcgagacaagaaaccgagggcaacgtacccctaaactcctagatctatgctgctcagtctagacgtaaggtcgggtacccagtacgaaggttcaggtgcgtagtggatcgtaggactagtactttcactctacaccatacagctagtcgtacacctaacgtgtaattacgtttacacttaacctttactcttacgtaacaaaccgttacgtaacgttaacctaacttacccgtacccgtttaccttaccggttttaccggacccggtaaaccgggtaaccgtaacggtccgttaagggacgtacgtaccggtagggtaccgtaacgttggtaccgccgttgaccctaaccg

SEQ ID NO: 30353 - DNA, 510 bp, Homo sapiens
  misc_feature: GYAE6OF01EF73X.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaaactcctgatctatgctgcgtcagtctgacaagtgggtcccatcgaagttcagtggcagtgatcgtggacagatttcactctcaccatcagcagtctgcaacctgaagtattttgactaacttacttctgtactaacaactacgttactaactcttacccgtactacgttttacggaccgtacgggaccaagcgtaggagtatcgaggacgaacgtggtcgactcgcaccgtacg

SEQ ID NO: 30354 - DNA, 573 bp, Homo sapiens
  misc_feature: GYAE6OF01CN6UA.33.65.F10.1.454.CMB.1.raw
tcagtacacacactcacgaccggtgctcgatttagctacgctctaaggggggagtcagtctcagtcaggacacagcatggacatgagggtccccgctcagctcctggggctcctgctactctggctctgaggtgccagatgtgacatccagatgacccagtctccatcctccctgtctgcatctgtaggagacagggtcaccatcacttgccgggcaagtcagagcataagcaactatttaaattgtatcaaacagaaaccagggaaacgcccctaaggtcctgatctatgctgcgtccagtttgcgagacggccggggtacccagtacgaaggttcgagtggctaggtggatcggtagggacagtatttacactctaccaccatcaagcagtctgacaaacggtgaagtatttagacctaaactttacctaactagttaccaaacgtagactaccaaaccaacctaccccatttacctacgtttcccggaccctagggaccctagacggttaggattcggtaactaagttacccgaacgtttcgggtacggccttacggccctaaccgtacg

SEQ ID NO: 30355 - DNA, 559 bp, Homo sapiens
  misc_feature: GYAE6OF01ALXI4.33.65.F10.1.454.CMB.1.raw
  modified_base (310)..(310): a, c, t, g, unknown or other
  misc_feature (310)..(310): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctcccaccctccctgtctgcatctgtcggagacagagtcaccatctcttgccgggcaagtcagagcatcgtccgtcttaatttaattggtatcagcaagaaaccaggcaacgacccctaaactcctagatctatgctgcgtccagtcngacaaggtcgggtaccagtcaaggttcagtggctaggtggatcgtggactagtagtttcactcctacaccgtactacacgtacacgtctacgactaaccgtagtaacgttatttcgacctaactttactctacgtacaacactacgttacaacttcctacccttactacgtttcggaccgtacgggacctaaggcgtacggagtacgtacgacggtacgaacgtcggtacgacgtcgaccgtccgtacg

SEQ ID NO: 30356 - DNA, 747 bp, Homo sapiens
  misc_feature: GYAE6OF01C93UQ.33.65.F10.1.454.CMB.1.raw
  modified_base (222)..(222): a, c, t, g, unknown or other
  misc_feature (222)..(222): n is a, c, g, or t
tcagtacacacactcacgaccggtgctcgatttagctacgctctaagggggagtcagtctcagtcaggacacagcatggacatgagggtccccgctcagctccgtggggctcctgctactctggctccggaggtgccagatgtgacatccagatcgacccagtcctcccaccctccctgtctgcatctggtcggagacagagtcaccatctctggccggganaagtcagagcatccgtccgtacttaatttaaagttggtatcgagcaagacgaaccgaagggaaaccacccccaaactccgtagtactcctcgtcgccgactactaccgtaatttaaccgaacgtaacggttcggggtacccctagttcggtaggtttcgaggttcggacgtaggtggtacgtacggtacggggaactacgttactttaccgactttaccgtaactaaccctaagttaacgcgtaacggttaccgtaacggtaaacccgttagggtaaagtttaggttttaagggaaacgttaactttaccgtttactacggtaacctaacgtaacgttaactttaacgtaaacccggttaaccccgtttaacgttaccggttttacggggaacccggtaacgggggtaacctaacgggtacgtaaggggtaacgtaacgtaaccggaaacgggtacgtaaacggttgggtaccggccgttaacggtacccctaacgtacctttcggttaccgttccgttaacccg

SEQ ID NO: 30357 - DNA, 701 bp, Homo sapiens
  misc_feature: GYAE6OF01BLVGR.33.65.F10.1.454.CMB.1.raw
tcagtacacacactcacgaccggtgctcgatttagctacgctctaagggggagtcagtctcagtcaggacacagcatggacatgagggtccccgctcagctccgtggggctcctgctactctggctccgaggtgccagatgtgacatccagatgacccagtcctccaccctccctgtctgcatctgcggagacagagtcaccatctcttgccggacaagtcagagcatccgtccgtacttaatttaaattggtatcagacaagaaaccaggacaacgcccctaaactcctgattcatgctagctcagtctagacgtaaaggtcgggtaccctagtacgtaaggttcgagtggacgaaggttggaacttcggtaggggtaacctaggttaactttaccgaccttcctacccgtaacctacgtaccgtaacggtccgtaaacggttcccttacggaacccgttaaaccgttagttaaacgtttaacgtttttaccgaaaccctttaacgttttaactttaccgtaacgttaaccctaaaccgtaaccgttaacgtttaaacctaaacctttacccgttacccgttaaccttaccggttttacggaacccggtaacggggacctaaacgtccggtaagggtacgtaacgttccggaaacggaccgttaacgtacggttacgacccttacggtccctacgtaccg

SEQ ID NO: 30358 - DNA, 548 bp, Homo sapiens
  misc_feature: GYAE6OF01CJFYE.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttggccggcaagtcagagcatcgtcgctatttaaattggtatcagcagaaaccagggcaagcccctaaactcctgatctatgctgcgtccagtctgacaaagtcgggtccagtcaaggttcaggtggcgagtggatcgtgggacagtatttcactctacaccatcagcagtctgactaactgtaatatttgaccttaactttactcttagtacaaactactaacgttaactaacttccttacccgttaactaccgttttacggacccgtagggaccctaaggccgtaggaagacgtacgacgggtacgtaaacgtcgttacgggactcgcctaccgttaccg

SEQ ID NO: 30359 - DNA, 719 bp, Homo sapiens
  misc_feature: GYAE6OF01B9W9U.33.65.F10.1.454.CMB.1.raw
tcagtacacacactcacgaccggtgctcgatttagctacgctctaagggggtaggtcagtctccagtcaggacacagcatggacatgagggtccccgctcagctcctggggctcctgctactctggcgtccgacggtgaccaggatgtgacatccacgatcgacccacgtcctcctaccctccctgtctgctagtcctgtcggacgacagacgtcgaccgatctcgttcggccggtactaagtctagacgcgtatcgtaccgtaacttagttttaaactcggtactcacgacgaacgtaaaccgacgggaccaaacggtacccccttaaaaacgtccgtaaggtaccgttacctaagttcggcgtacgtccgtaaccgtaggtccgtagtacggtaaagggttccgggtacccttagtaccgtaaggttcaacggttggacgaggtcgtactacggtacgggaactaagttacgtttcgaaccttcttaccacgtactcgaacgtactacgtacgtacgtaactaacctaggtaaacgtttcgtttagacgttaaggtttaacttaacggtcgtactacgggtacaacgggtaccgttaggaccgtaacggtaccgtaccctaaccgaccgtttaccgggaccgtaacggtaaccgtaccgttacggtacggtaactaaacgttaaacgacgtagtacggtacgtacgtacgcgttacg

SEQ ID NO: 30360 - DNA, 616 bp, Homo sapiens
  misc_feature: GYAE6OF01CO0GT.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctcccaccctccctgtctgcatctgtcggagacagagtcaccatctcttcggccgggacaagtcagagcatccgtccgacttaatttaaagttggtatcgagacaacgaaaccgagggaccaacgtaccccctaaactcctgactctatcgctgcgtccagtctgacgaaacgggtcgggtaccctagtacgtaacggttcgaggtcggacgtaggtggacgttcgtagggaactaggttactttcgaccttccaccaccatccacgtcacgttcgtacgaacctaaccgtagtaaagttcgttttacgaaccttaacctttactcttacgtacaaactactaacgttactacctccttaaccgtacttacgttacgggaccgacgggtacaacggtcgtacggagtagtccggacggaaccgttacgtagggtcgtactccgactaaccgttcg

SEQ ID NO: 30361 - DNA, 863 bp, Homo sapiens
  misc_feature: GYAE6OF01E2B7Z.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccaggtatgtagactactccgagtagtaccgaaccctacgttccctacccctacccccttcccgttcgtttcccttactacttcgttagggtaagggaacgacgaaggtactacccaacctactaccgtacgttccgggcccgggaacgtaaggtaggaaggacgacttaagttaaaccgtaaccttttagttaagtaaggtttaggttactacgacgacgaaaccgaaacggacggaacaaccccgtaacccctaaacctccgtatacttactagtcgtcgtcggtccctacgtacgttcgtacgaaacggttaaacgggggttcccgggtaaccctacgttaaccggttaacggttccgtaggggtcggacgtaggggtacgtacgttacgggtacgggaacgtaggttttaccttacctacccttccctaacccaacctacgttacgacgtacgttacttccgtaccgaaacccttacggtaaagtaacgtttttagtttaccgaacccttttaaaccttttccttacgttccgtaaaccaacttacggtttaaaccttaaacctaccgtttacccccgtttaacccgttaactttttccgggttacccgggaaccgggtaaccgggaaaccctagggtccggtaaaggacttaacggaccgggtaacgggaacccgttaacggttcggggtaccctcggtacccaaccccgtacttacgtttccgg

SEQ ID NO: 30362 - DNA, 704 bp, Homo sapiens
  misc_feature: GYAE6OF01EJ7K5.33.65.F10.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagtacacacactcacgaccggtgctcgatttagctacgctctaaggggggagtcagtctcagtcaggacacagcatggacatgagggtccccgctcagctcctggggctcctgctactctggctccgaggtgccagatgtgacatccagatcgacccagtcctcccaccccttccctgtctgcatctggtcgganacagatcaccatctcttgccggganaagtcagagctatccgtcgtacttaatttaaagttggtatcagacaagaaaccgagggaccaacgtacccctaaactcctagtactctatcgctacgccgtccagtcgtaggacgtaaagggtcggtacccagtacgtaagggttcaggtggacgtaggtggattcggacgggtactaggttactttaccgacgttctaccgtaacctactaccgagtccgtaagttccgtacggaacctaacccgtagggttaaactttacgtttttaccggaaaccttaaccgtttttacccgtttctaaccggtttaaccaaacccgttaaccgttaacgtttaacccttaaccgttccccgttaacccggttaaactttacccgggtttacgggaacccggtaacggggttaaccctaaagggtccggtaaggtaacggacgttacggtaacggaccgtacggtgtacggtactacgccgtactacgg

SEQ ID NO: 30363 - DNA, 591 bp, Homo sapiens
  misc_feature: GYAE6OF01DUUC4.33.65.F10.1.454.CMB.1.raw
  modified_base (216)..(216): a, c, t, g, unknown or other
  misc_feature (216)..(216): n is a, c, g, or t
tcagtacacacactcacgaccggtgctcgatttagctacgctctaaggggggagtcagtctcagtcaggacacagcatggacatgagggtcccccgctcagctcctggggctcctgctactctggctccgaggtgccagatgtgacgtccagatgacccagtctccatcctccctgtcttcatctgtaggagacagatcaccatctcttggccggnaagtcagagcatccgtccgtacttaattttaaattggtatcagacaagaaaccagggacaacgacccctaaactcctgactctatcgctcgcgtccagtctgacgtaaaggtcggggtacccagtaccgaaggttcgaaggtcggcgagtggatcgtagggactagtattcactcgtacaccactacacgctacgtctacgacctaaccgtagaagtttacttttacgaccttaaacttttaccgttctcgtaacctaacgtaactaacttacctaacttccgtacccgttacttacgtttcggaccgtacgggacctaacggtcggtagacgtatacggcggacgaacgtggtcgactcgacctacgtacttcg

SEQ ID NO: 30364 - DNA, 558 bp, Homo sapiens
  misc_feature: GYAE6OF01BMCTX.33.65.F10.1.454.CMB.1.raw
  modified_base (215)..(215): a, c, t, g, unknown or other
  misc_feature (215)..(215): n is a, c, g, or t
  modified_base (304)..(304): a, c, t, g, unknown or other
  misc_feature (304)..(304): n is a, c, g, or t
  modified_base (394)..(394): a, c, t, g, unknown or other
  misc_feature (394)..(394): n is a, c, g, or t
  modified_base (444)..(444): a, c, t, g, unknown or other
  misc_feature (444)..(444): n is a, c, g, or t
  modified_base (535)..(535): a, c, t, g, unknown or other
  misc_feature (535)..(535): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggnaagtcagagcatcgtcgctatttaaattggtatcagcaagaaaccagggcaacgccccctaaactcctgatctatgctgcgtccagtcngacgaaaggtcggggtacccatacgaaggttcaggtggcaggtggatcgtagggacagtactttcacgtcttcacctatcagctaggtcngacgaggtactaaagtattttgactaactttattactagtactaaaagtntagtactaggtacgcccgtattcctacgttccggaccgttacggaacctaaaggtacgtaaagtaaccaaagtaccgttaggtacggtacncggtaaccacctagttcgttacg

SEQ ID NO: 30365 - DNA, 582 bp, Homo sapiens
  misc_feature: GYAE6OF01D5XJM.33.65.F10.1.454.CMB.1.raw
  modified_base (213)..(213): a, c, t, g, unknown or other
  misc_feature (213)..(213): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcacatctcttgccggnaagtcagagcatcgtcgctatttaaattgtatcagcaagaaaccagggacaacgcccctaaactcctagatctatgctgcgtcagtctagacgtaaaggtcgggtacccagtcgtaaaggttcaggtcggcaggttggatcgtagggactagtactttcactctacaacctactacagctagtctacgactaacctagtaagttatttacgtactaactttacttctacgtacaactactaagttaacctaacttcctacccgttactacgttttacgggaccgtaacgggaccgtaacggtacgtaggtaagtaacgttacgaacggtacgtaacgttcggtacggtacgtacgaccgtacctaaccg

SEQ ID NO: 30366 - DNA, 728 bp, Homo sapiens
  misc_feature: GYAE6OF01EWNZ2.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccggacaagtgagagcaagttacgaaccttagtttagaatttggtatacgagtacgagacgaccgaaggaaaccgaccccctaaactccgtagacttctcgtcgaccgctacgtccgtaactttacacgtaacgtcgggtaccctaggtacggtacggttacgtaggtcggtacgtaacggtggtacttcggtagggtaactacgtactttaccgtacttctacccaactaacgtaacgacgtacgttaccgtaacggtaaccgtaggtaacgtttagtttaacggtaacgttacttacttcgttagtaacctaacgtacgtaacgtttaacgtaaccgttaacccgttaattaaccggttttcggaacccggtaacggggtaaccgtaacgggttaccgtaagggtacgtaaacgtaaccgtaaacggtaccggttaaacgtacggttaccgggacgtaccccggtaaccgtaaccctttagttacccgtttacgttaacccgttcgttaaacccccg

SEQ ID NO: 30367 - DNA, 556 bp, Homo sapiens
  misc_feature: GYAE6OF01CODVO.33.65.F10.1.454.CMB.1.raw
  modified_base (215)..(215): a, c, t, g, unknown or other
  misc_feature (215)..(215): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggnaagtcagagcatccgtcgcttaatttaattggtatcagacaagaaaccgagggacaacgcccctaaggtcctgatctatgctgccgtctagtttgcgaggacggccggggtacccagtcgtaaggttcaggtggacgtaggtggatcgtggactaggtactttcgacttctacaccatcgagtctagtctagactaacgtgtaagttatttacgactaacttactactacgtacaacacgtacgtaccaaccaacctaccctattcctaaccgttccggaccctacggaacctagtacgtaggacttcggaccaaccgtacgtgtacgctacgctacgtcg

SEQ ID NO: 30368 - DNA, 587 bp, Homo sapiens
  misc_feature: GYAE6OF01EQAKU.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctctgccgggcaagtcagagcatcgtccgacttatttaaattggtatcagcaagaaaccagggaccaacgacccctaaactcctagactctatgctgcgtccagtcctgactaaaggtcgggtcccatacgaaggttcaggtggactaggtcggtatcggtagggactaggtactttccgaacttctacaccatacacgctagtctacgacaaccctagtaacgttattttacgaccttaactttacctttactagtactaaacctactaagtttaacctaacttaccttacccgtacttaccgttttcggacccgtaacgggtacctaagtcgtaggtagtacgtacgacggtacgaacgtggtacggatcgcctacgtaccg

SEQ ID NO: 30369 - DNA, 736 bp, Homo sapiens
  misc_feature: GYAE6OF01BDR46.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttcggccgggcaagtcagagcatcgtccgctatttaaattggtatcagcaagaaaccgagggcaacgcccctaaactcctgactctatgctcgcgtccagtctgacgaaaggtcgggtacccagtacgtaagggttcaggtcggccgtaaggtcggagttccggtaggggtaacctaaggtaacttttaccgaaccttcctaccgaaccctacgttaccacggtccctaacggttccctacggaccctaaacccgtagtaaacggtttatttttacggtaaccttaaacccgtttttacgtttacttaccggttaaccaaacccgttaaccgttaaacggttttaaaccctaaccgtttacccgtttacccccggttaaccgtttaccggtttttaccgggaaccccgggttaacgggggtaaacccgtaaacgggttaccggttacggggaacgttaacgtacccggaacgggtacccggtaaacggttcgggttacggtaccgttaccggacccgtaacccgttaacg

SEQ ID NO: 30370 - DNA, 797 bp, Homo sapiens
  misc_feature: GYAE6OF01B5ZCI.33.65.F10.1.454.CMB.1.raw
  modified_base (277)..(277): a, c, t, g, unknown or other
  misc_feature (277)..(277): n is a, c, g, or t
tcagtacacacactcacgaccggtgctcgatttagctacgctctaagggggagtcagtctcagtcaggacacagcatggacatgacgggtccccgctcagctccgtggggctcctgctactctggctccggaggtgccagatgtgacatccagatcgacccagtcctcccaccctccctgtctgcatccgtggtcggagacaggactccacctatcctcgttcggccggacaagtcagacgcacgtcgtaccgtatttaagtttaaagttggtaacncgaagaccgaaacggaaaacccgtagggaccaaaccggtaccccctaaaacgtccctagaacttactacgtcgtccgttacgccgttaccgtagttccgacgggtaaccgtaaaaggggtccggggtaaccctaagttaccggtaaaaggttccggaagggttacggcggtaggtaggtactaccgggtagggactaaacggtttacttccgtaaccgttccttaccgaacccttagtacgaaccggtacgtacggttaccgtaacgaaccgtaaaccgtagttaaacggttttacgtttacggaaaccctttaactttaccgtttaggtaaccttaaacccgtaacttaacgggttaaccgttaaacccttaccttaccccgtttaaccgttaccgtttaacgggttcccgggaaaccggttaacggggaaccctaaagggtccgttaagggaacgtaccgtaacgggtacggaaccggttacgtacgggacgtacggtacccaaccggtaattcccgg

SEQ ID NO: 30371 - DNA, 646 bp, Homo sapiens
  misc_feature: GYAE6OF01B1S96.33.65.F10.1.454.CMB.1.raw
tcagtacacacactcacgaccggtgctcgatttagctacgctctaagggggagtcagtctcagtcaggacacagcatggacatgagggtccccgctcagctcctgggactcctgctgctctggctcccagataccagatgtgacgtccagatgacccagtcctccatccctccctgtctgcatcaggtgggagacagagtccaccatcacttggccgggcgaggtcgggactattttactaagtttttggcctggtatcagcagagaaggaaggggaagttcctagactcctgatctatggtgcatcctactttgctaatcgacggggtccctagtcctcgtcttcgaggtcggcgtaggtggtagtttgggactaggtactttcgactcctaccgaccgttccaccgtacgtcccgtagacccgtacggtcctaggtaaacggtttacttttacgtaactaaacttttacgttaacgttaagttaactaaaaagttcgtaaggtacgtacgggttacggtccccgtacgttacccgttacccgtttcgggaccccgttacgggaaaccgtaaaggtaacggtaaactaccgaaaacgtacgtcggtacgacgtacggacctaacgtacttcgtcgttcttacccg

SEQ ID NO: 30372 - DNA, 580 bp, Homo sapiens
  misc_feature: GYAE6OF01CLZUW.33.65.F10.1.454.CMB.1.raw
  modified_base (348)..(348): a, c, t, g, unknown or other
  misc_feature (348)..(348): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (410)..(410): a, c, t, g, unknown or other
  misc_feature (410)..(410): n is a, c, g, or t
tcagtacacacactcacgaccggtgctcgatttagctacgctctaagggggagtcagtctcagtcaggacacagcatggggggggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatccgtccgcttaatttaaattggtatcaagcaagaaaccgagggacaacgcccctaaactcctagactctatcgctgcgtccagtctagacaaggtcgggtacccatcgaaggttnagtggcagtggatcgngggacagtnttcactcncacntacagcagtctagacactgaagttntttcgactatttatactagtaactaaaagtgagtacgtacgtcgtccctcttacctaccggttttcccggcccgttaaagggaaaccgttaaaggaacggttaaacgaacccgtaaaacggtacgttacggtacggtctaccggaccttaaaccctcgttcctttaccgg

SEQ ID NO: 30373 - DNA, 765 bp, Homo sapiens
  misc_feature: GYAE6OF01ADFJ3.33.65.F10.1.454.CMB.1.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
  modified_base (337)..(337): a, c, t, g, unknown or other
  misc_feature (337)..(337): n is a, c, g, or t
tcagtacacacactcacgaccggtgctcgatttagctacgctctaagggggagtcagtctcagtcaggacacagcatggacatgagggtccccgctcagctcctggggctcctgctactcgtggctccgaggtgccagatgtgacatccagatcgacccagtcctccactccctccctgtctgcttcgtgtcgganacagagtccaccatccacgttcgcagggcgagtggaggactagtttaacggttaaatttttaagttgtacagacaacggaaacncgggacaaaccgtacccctaaactccgtgaacttcgtagtcgctacggtccgtaccnggtcctaggaacgtaacggtcgggtaccagttaccggaggttcgaggtcggacgtagggtcgtaacgtcggtaggtaactacgttactttccgaaccttctaacctacccgtagtaccgtacgccgttagtaccacggtaaccctaaccggtttaagtaaaccgtttacctttacgtaaacccttttaaccttacgtttaccgaacgttaaccctaaacgttaaccttaacgtttaaccttaaccccggtttcccgttaaacccgtttaacggtttacccggtttaaccggggaacccgggtaaccggggtaaccctaacgggttacggtaaccggtaaggtacccggtacggaaccggggttacgacgggttccgtaccggtacgttacccgaacttacccggttacttccgtttaacccttccccg

SEQ ID NO: 30374 - DNA, 725 bp, Homo sapiens
  misc_feature: GYAE6OF01BIJCX.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctcccaccctccctgtctgcatcgtggtcggagacagagtccaccattctcttggccgggacaagtcagagcatcgtccgtattaagtttaaagttggtatcgaagacaagaaaccgagggacaaccgtacccctaaactcctagacttctatcgtcgtcgccgtaccgtagtccgtaggaaccggtaaacgggttcccgggtaccctaagtaccggttaaaggtttccgaggttcgggacgtagggtacggtacgttcggaggggtaactaaggttaccttttcgaaccttcctacgaaccctagttaccgaggtaccctacggttacgaccgtaaccgtaaaccgttaggtaaacgtttatttaccggtaaacctttaacttttaccgtattaacccgggtaacaaaccgttaacgttaaccggtttacctaaacccgttcccttaccgggtttaacccttacggtttacccggacggttacgggaaccctaggtaccgtagggtacccgagtcccgggaaggtaccgttacggtcgtacggtactcgtaaccctcgtacg

SEQ ID NO: 30375 - DNA, 654 bp, Homo sapiens
  misc_feature: GYAE6OF01B2M2S.33.65.F10.1.454.CMB.1.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
  modified_base (420)..(420): a, c, t, g, unknown or other
  misc_feature (420)..(420): n is a, c, g, or t
tcagtacacacactcacgaccggtgctcgatttagctacgctctaagggggagtcagtctcagtcaggacacagcatggacatgagggtccccgctcagctcctggggctcctgctcctctggctccgaggtgccagatgtgacgtccagatcgacccagtctccatccctccctgtcttcatctgtagganacagagtcaccatcacgttggccggganaaggtgagagctaattaagaaccttagtttagaatttggtatacagacaggaacgaccaagggaaaccgacccccaaatccctagactcctcgtcgccgacactaccgtaacttaaccaacgtaaggtcgggtacccagtcggtaggttcgaggtggacgaggtgatcgtaggactagtactttcgactctacaacctanaagcacgtcacggtaactaggtaagtaagtttaggaatacttacgttacgtagtacctaaagacgttaacttaacgttaaccgttaaacccgttacttaccggtttacgggaacccggtaacggggttaacccaaggtaccgttaagggaacgtacgtaacgaaacggtccggtaacttgggtaccggttccttaacgaccgtacttcgtagtttacctcccgtagtttccccg

SEQ ID NO: 30376 - DNA, 511 bp, Homo sapiens
  misc_feature: GYAE6OF01A8W4Y.33.65.F10.1.454.CMB.1.raw
  modified_base (122)..(122): a, c, t, g, unknown or other
  misc_feature (122)..(122): n is a, c, g, or t
  modified_base (390)..(390): a, c, t, g, unknown or other
  misc_feature (390)..(390): n is a, c, g, or t
  modified_base (400)..(400): a, c, t, g, unknown or other
  misc_feature (400)..(400): n is a, c, g, or t
tcagtacacacactcacgaccggtgctcgatttagctacgctctaagggggagtcagtctcagtcaggacacagcatggacatgagggtcccccgctcagctcctggggctcctgctactcnggttctccgaggtgccagatgtgacatccagatgacccagtctccatcctccctgtcttcatctgtaggagacagagtcaccatcacttgccgggcaagtgagagcattagaacctattgaattggtatcagcagacgacaggaaacacccccaactcctgatctctgccacatccgatttacacagtcgggtcccagtcgagttcagtggcaggtgatcgaggacagtattcactctacacatagcagtcaggtaacctagtaagtntttaggaatntacttctgtacaacagtacttatacgtaacccgtatacgtttggaccgagggaccagcgaggtagactacgagacgaatcgtaggctacgtaccactattctcgtcttacc

SEQ ID NO: 30377 - DNA, 753 bp, Homo sapiens
  misc_feature: GYAE6OF01DQL6O.33.65.F10.1.454.CMB.1.raw
  modified_base (134)..(134): a, c, t, g, unknown or other
  misc_feature (134)..(134): n is a, c, g, or t
  modified_base (235)..(235): a, c, t, g, unknown or other
  misc_feature (235)..(235): n is a, c, g, or t
tcagtacacacactcacgaccggtgctcgatttagctacgctctaagggggagtcagtctcagtcaggacacagcatggacatgagggtccccgctcagctccgtggggctcctgctactctggctccgaggtnccagatgtgacatccagatcgacccagtcctcccaccctcctgtctgctacgtccgtggtacggagacaggactcacctacgttctcgtcgggccgggtanaacggtacagacgctacgtcgtaccgtattaaagtttaagtggtatacgagacgaaacgaaacggcggtaaccaacccgtaccctaactcgtagaacttctagtcgctcgacgtcgtagttcgagtaacgtacggggtccgaacctagtcggtaaaggttcgaaggtggactagggtaggacttcggggtaagaacgttacgttaccttaccgtactaccgttaccacgttacaccgtaggtacgttcgtaccggtacgaaggtaaagttacggtaaacgtttcttaacgtaaaccgtttactttaaacgtacgtacgtaaacgtaacgtacgtaaacccacctaaaccccgtaaacccccttacgttaacccttacccggttaccccgggtttacccggaacccgggttacgggttaacccaaacggtttggggtaacccttaaggtaacccggttaaaccggtaaccccggttacgtcggggtaacgtaccccgtaacaaccccgtcgttaaccgg

SEQ ID NO: 30378 - DNA, 657 bp, Homo sapiens
  misc_feature: GYAE6OF01AEG7B.33.65.F10.1.454.CMB.1.raw
tcagtacacacactcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtcctcccaccctccctgtctgcatctgtcggagacagagtcaccatctcttggccgggacaagtcagagcatccgtccgtacttaatttaaagttggtactcgaagaccaagaaaacccgagggaccaaacggtaccccctaaaactcctagactctatcgctcgcgtccgagtctaggacgtaagggtcgggtacccagtaccgaaggttcgaggtggcgtaggtggaacgttcggtagggaactagtactttccaccttcctaccacctatcgagctacgttcgacgacctaaccgtaggtaaacgttatttaccgacttaaccttttcgtttactcgtaacaacctaacttaacgttaacctaacttcccttacccgttaccttaccggtttacggacccggtaacgggtaaccgaaggtcggtacgggtaacggtacgtaccggaacgggtaccgttaacggttcggtacggtccgtacgtacctaccgtacg

SEQ ID NO: 30379 - DNA, 885 bp, Homo sapiens
  misc_feature: GYAE6OF01BAACN.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctcccaccctccctgtctgcatctgtcggagacagacgtcaccattctcgttcggccgggacaagtcgagagctacgtccgtaccgtactttaaagttttaaagttggtaactacgaacgaccgaaacggaaaccgtagggaccaaaccggtacccccttaaaacgtcccgtagtaaccttcgtacgtcgtaccgtcggtacccggttaccgtaacggttcctacgggtaaccggttaaaacggggttccccgggggttaaccccaaaggttaacccggttaaacggggttaccggtaaacggggttcggggaaccgttaggggttaaccggtaacgtttaccgggggtaacgggaaccgtttaaccggttaacgttttacccaccgtttaccctaacccgtaccgtaaccgtacgtaacggtaccgtacggttaccgtaacgtaacccctaaacggttagttaaacgttttacgtttaccgtaactttaacccgtttacgttacgttacgtaaccctaaacgtaacgttaaccttaaccgttaaccgttacccgtttacccgttaaccgtttaccgggtttaccgggaaacccgggttaaccgggtaaaccgtaaccggggttaccggtaacgggtaaaccggtacgttaacccggggtacggtaaaccggttaacggttacggggttactaccggttaccgtaaccgttaccgttacccgg

SEQ ID NO: 30380 - DNA, 833 bp, Homo sapiens
  misc_feature: GYAE6OF01CO1TT.33.65.F10.1.454.CMB.1.raw
tcagtacacacactcacgaccggtgctcgatttagctacgctctaagggggagtcagtctcagtcaggacacagcatggacatgagggtccccgctcagctccgtggggctcctgctactctggctccgaggtgccagatgtgacatccagatcgacccagtcctcccaccctccctgtctgctatcgtgtcggagacagacgtcaactatctcgttcggccgggtacaagtcaagcgactacgttccgtacgtacttaatttaaagttggtatacgagacaacgaaaccgagggaccaacgtacccctaaacgtcctagtaactctaacgtcgaccgttcgaccgtaccagttccgtacggtaaccgtaaacgggttccgggtaccctaagttaccggtaaaggtttacgaacgggtcggtaccgtaaaggttccggtaacgttacggttacggggtaaactagtttaaccgtttaccctaaccgtttcccgtaacctaaccccgttaagttaccgaaacggttaccttaacggttacccgtaacgtaacccgtaaaccgtttaggtaaacgttttaccgttttaacgaaccctttaaaccttttacccgtttacgtaaaccgttaaccgtaaaccttaaccgtaacggttttaaacccctacgtttaccccgttaacccgtttaacgttttacccggtttaaccgggaacccggttaaacgggggtaaaccccttaaagggtacccggttaaacgggaagtttaaccgacggggtaaccggtaacgttaccggtacggtacggaccgttaccggtaacctaccccgttaag

SEQ ID NO: 30381 - DNA, 691 bp, Homo sapiens
  misc_feature: GYAE6OF01DXUOI.33.65.F10.1.454.CMB.1.raw
  modified_base (180)..(180): a, c, t, g, unknown or other
  misc_feature (180)..(180): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctcccaccctccctgtctncatctgtcggagacagagtacaccatctcgtcggccgggacaagtcaagagctactccgtccgtacttaattttaaaagttggtatacacggacaaacgaaaccgagggacaaccgacccctaaactcctgactctatcgctcgccgtactacgtctagtacgtaaacggtcgggtacccagttacgtaaggtttcgagggtacgtacgtaggttaggtacgttcggacggggtactaacggttacttttaccgaaccttccgttaccaacccgtattaccgaacgtacccgttaaggttcctaacgaaccctaaaccgtagtaacgtttactttaccgtaactttaaccgtttacctttacgtacgtaaccctaaagtaaccgtattaacctaccgttccgttaccccgttagttaccggttaccggaaccggtaacgggaccctagggacgtaggtagtacggtaacggacgtacgtacggttcgtacggtccttacgacccgtatacg

SEQ ID NO: 30382 - DNA, 635 bp, Homo sapiens
  misc_feature: GYAE6OF01AB9OI.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatcagtgggagacagagtcaccatcacttggccgggcgagtcgggactattttactaattttttggcctggtatcagcagagaggaagggaagttccgtagactcctagatctagtggtcgctactccctactttcgactaacgtcgacggggtcccagttccgtcgtccttcgaggtcggcgtaggtggtagtttgggactagtatttcacgtctaccgtacccgtacacctacgtccctacggtcgaacggtacgttaggtaaacgtttacgttttacggaaccttaaactttaacttaacgttacgtaactaaaagtagttaacgaacgtacggtaccggtacccgtcgttaccgttaccgttccggacccgtacgggaacctaaacgggtacgaaacgtaccgaaacggtactagggtacgactacgacctaactactcgttcgtcttaccg

SEQ ID NO: 30383 - DNA, 692 bp, Homo sapiens
  misc_feature: GYAE6OF01CMMSH.33.65.F10.1.454.CMB.1.raw
  modified_base (464)..(464): a, c, t, g, unknown or other
  misc_feature (464)..(464): n is a, c, g, or t
  modified_base (484)..(484): a, c, t, g, unknown or other
  misc_feature (484)..(484): n is a, c, g, or t
  modified_base (668)..(668): a, c, t, g, unknown or other
  misc_feature (668)..(668): n is a, c, g, or t
  modified_base (677)..(677): a, c, t, g, unknown or other
  misc_feature (677)..(677): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccaagactcgaccctgtcctcccaccctccctgtctcgcatcgtgtcggagacgagcgtaccacctatctcgttcggccggactaagtacagacgctacgttccgtcgtactttaagtttaaagttggtactacgagtaccgaaagaacccgaggaaccaaccgtacccctaacgtcctagtactctacgtcgcgtcgtacgtcgtacggtcgtacgtaacggtacgggtccggtaccctaagttccgtaaaggtttcgaggttcggagtagggtacgtacgtcggtagggtacctagttaccctttcaaccttaccnccgaatccggttagacggtntaccgtctaccgaaccgttacgtaagttacgttttcgttaaccgtaacctttaccgttttacgtagtaacctaaccgaacctaactttaacgtacctacccgttcccgttacttaccgttacggtaccgaaccgggtaggacgactagggtagacgttaccgtagaacggttccaacgggttcnccggccttntaaacccgtgtaccg

SEQ ID NO: 30384 - DNA, 587 bp, Homo sapiens
  misc_feature: GYAE6OF01AKO2N.33.65.F10.1.454.CMB.1.raw
  modified_base (264)..(264): a, c, t, g, unknown or other
  misc_feature (264)..(264): n is a, c, g, or t
  modified_base (371)..(371): a, c, t, g, unknown or other
  misc_feature (371)..(371): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctcccaccctccctgtctgcatctgtcggagacagactccaacctattcctcgttggcccgggacaagtccgagagcatcgtccgtcttaatttaattggtancagcaagaaccgaggaccaacgaccccctaaacgtcctagtactctatcgctcgcgtacctagtctgacgtaaggtcgggcctatcgaaggttcaggtgacgtaggngtagtcggtaggactaggtactttcacttctacacctatacacgtctagtcgtacgacctaacgtagtaattactttacgaccttaacgttcttctacgtaacaactactacgttaactaacttccgtacccgttactacgttaccggacgaacgggacctaggacgtcggagtacgtacgacggtacgtacgtaggtcgtatcgaccgtacctcg

SEQ ID NO: 30385 - DNA, 733 bp, Homo sapiens
  misc_feature: GYAE6OF01DE26M.33.65.F10.1.454.CMB.1.raw
tcagtacacacactcacgaccggtgctcgatttagctacgctctaagggggagtcagtctcagtcaggacacagcatggacatgagggtccccgctcagctcctgggctcctgctactctggctccgaggtgccagatgtgacatccagatcgacccagtcctcccaccctcctgtctgcatctgtcggagacagatcaccatctcgttcggccggatacgtcagacgcacgtccgtccgtacttaatttaaagttggtaactcgaagacgaacgaaccgacggaccaaccgtacccctaaacgtccgtagattctagtcgtcgtcgtcgtacacgttccgtagaacgtaacgggtccggtacctacgtacgtaacggttcgacgggtcgcgtagggtacggtacgtacggtacgggtaactaacggttactttaccgtaccttaccgtaaccgtaaccgtacgtaaccgtacgtaccgtaaccgtttaccgtaacgtaacccgtaaaccgttaggttaaacgtttacgttttacgaaccttttaacctttacgtttaaccgtacgttaacctaaaccttaacgttaaccgtttaaccttaaccgttacccgtttaccccgtttaacgtttaccgggtttaccggaacccgggtaaacgggtaccgtaacggtcggtacggactacggttacgacggttacgtaacgtcggtcgtacgtacgccgtaactacg

SEQ ID NO: 30386 - DNA, 627 bp, Homo sapiens
  misc_feature: GYAE6OF01A59Z8.33.65.F10.1.454.CMB.1.raw
  modified_base (478)..(478): a, c, t, g, unknown or other
  misc_feature (478)..(478): n is a, c, g, or t
  modified_base (595)..(595): a, c, t, g, unknown or other
  misc_feature (595)..(595): n is a, c, g, or t
  modified_base (605)..(605): a, c, t, g, unknown or other
  misc_feature (605)..(605): n is a, c, g, or t
  modified_base (623)..(623): a, c, t, g, unknown or other
  misc_feature (623)..(623): n is a, c, g, or t
tcagtacacacactcacgaccggtgctcgatttagctacgctctaaggggggagtcagtctcagtcaggacacagcatggacatgagggtccccgctcagctccgtggggctcctgctactctggctccgaggtgccagatgtgacatccagatcgacccagtcctcccacccctccctgtctgctatcgtggtaggagacgaggtccaccatctacgttcggccgggactaacgtacgagacgtacgaataacgtaacctaaactttaattttaaagttacggtaataaccgaaacgaaacggaaaccggaaacgggaaccgtaccccgttaaggtcctagtatcgtactcgcgtacgtcgtaccgtagttcgacgtacggcgggtaccggtacctaagtacgtaaggtcgtacggtggacgtaggtggtacgtcggaaggtactacgtcttacctctacctaccactagcagtacngtctagactagtatagttattcaacttactactgtactacaactagactaccaacctacctacctatccgtacctacgaccgtacgacgtagacggtagtcgtacgtaaccacggtncggtgtaccncgtaccacttctccgttntccc

SEQ ID NO: 30387 - DNA, 715 bp, Homo sapiens
  misc_feature: GYAE6OF01DW7SX.33.65.F10.1.454.CMB.1.raw
tcagtacacacactcacgaccggtgctcgatttagctacgctctaagggggagtcagtctcagtcaggacacagcatggacatggagggtcccccgctcagctccgtggggctcctgctactctggctccgaggtcgccagatgtgacatccagatcgacccagtcctcccacccctccctgtctgctatctggtcggagacgagtacgtccaacctattccgttcgtcggcccgggacaagtcgagacgctacgttccgtccgttactttaaagttttaaacgttggtaactacgaagtaccgaaacgaaaaccggcggaaccaaacccgtaccccctaaactcctagacttcgtatcgacgtcgccgtacctagtcctaggaaccgtaagggttccggtaacctagttacggtaacgttcgagtggacgtaggtgtagtcggtaggacgtattaccgtttcaccgttaccactaacctacaccgtagacgtacggttcaacggtacctaaaccgttagtaacgttttactttaccgtaaacctttaaccttttacgtacgtaaccgtaactaacgtaacgttaacgttaacctacccgttaccgttacccgttaagttaccggttacgggaccggtacgggaacctagggtacgtaacgggaactaacggtaaccgaaacggtgtcggtacacgtaccgaacctcgtgttacc

SEQ ID NO: 30388 - DNA, 774 bp, Homo sapiens
  misc_feature: GYAE6OF01DK369.33.65.F10.1.454.CMB.1.raw
  modified_base (172)..(172): a, c, t, g, unknown or other
  misc_feature (172)..(172): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatcccagatcgacccacgtcctaccccncccctcccttgtctcgactactcgtcggtacggaacgacgagtacgtaccacctacttccttcgttcgggcccggggactaacggtaccgaggacgaccgtacgttcccggtaccgttaactttaagtttttaaacgttggtactacgaacgaccaaacggaaaccggacgggaacccaaccgtacccccttaaactccgtacgtacttaccttagtcgtcgtccgaccgttactacgttacgacgtaccggtaaagggtcccgggtacctagtacgtaacgttcgaggtcgagtaggagtacgtcgtacgggatacgttattccctactacctcctaacctataccagtactatccgtactaaccgtaaccgtagttaacgtttacttttaacggtaacttttacctacgttacgtaaacctacgtaaaccgttaacgttaacctaccgtttaccccttaacccggttttaaccttaccggtttaccggaaccggggtaacccgtaacgttaccggtacgggtaacggtaacggtacgtacgggtaaccggaccggttaacggtacggttccggaactccgtaacctcctaacggttcccg

SEQ ID NO: 30389 - DNA, 791 bp, Homo sapiens
  misc_feature: GYAE6OF01A0HPU.33.65.F10.1.454.CMB.1.raw
  modified_base (220)..(220): a, c, t, g, unknown or other
  misc_feature (220)..(220): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctcccaccctcctgtctgcatctgtacggagacagactcaccatctcgttggccggganaagtcagacgctatccgtccgtacttaatttaaagttggtatacaagacaacgaaaccgagggaccaaaccgaccccctaaaactcctagtacttactagtcgccgtacggtaccgtaccagtccgtagaacgtaaagggttcccgggtaccctaagttaacgtaaggttcgaagggtcggacgtaggtacggacgtcgttacgggaactaaggttactttaccgaaccgttacctaacctaccgtaacttacgaaccgtacgtaacgttaccgtacgaacccgttaaaccgtaggttaaacgtttacgtttacgaaccttttaaaccgtttaccttacgttaaccgttaaccctaaaccgtaactttaaaccgtttaaacccgttaaccgttaccccgtttaaacccccggttttaacgttacccgttttaaccgggaaccccggtaaaacggggtacccaaagggttaccggttaacgggaaacgttaaccggtacccggtaaagggtaacccgttaacggttacggttacccggaaccgtttacccggaaccttaacccggtttaccg

SEQ ID NO: 30390 - DNA, 646 bp, Homo sapiens
  misc_feature: GYAE6OF01CMFYN.33.65.F10.1.454.CMB.1.raw
  modified_base (195)..(195): a, c, t, g, unknown or other
  misc_feature (195)..(195): n is a, c, g, or t
  modified_base (218)..(218): a, c, t, g, unknown or other
  misc_feature (218)..(218): n is a, c, g, or t
  modified_base (638)..(638): a, c, t, g, unknown or other
  misc_feature (638)..(638): n is a, c, g, or t
tcagtacacacactcacgaccggtgctcgatttagctacgctctaagggggagtcagtctcagtcaggacacagcatggacatgagggtcccccgctcgagctcctggggcctcctgctactctggctccgaggtgccagatgtgacatccagatcgacccagtcctcccaccctccctgtctgcatctgcgganacagagtcacatctctgccgganaagtcagagcatccgcgtacttaatttaaagtgtatacagacaacggaaaccgagggaccaacgtaccccctaaatccctagactctaagcgctcgacctcctagtcctagacgtaaacgggtcgggtaccctaagttacgtaaacggttcgagggttcggacgtaaggttacgggaacttcgggtacgggaacgttaagtaacgttttacctaacctcttacccgaaccgtactacgtacgtacgtacgttccgtacgtacctaacccgtaggtaaacgtttacgtttacgtacttaacctttacttacgtacgtaccaacgtactaacgtaactacttaccgttaccttacgttacgttacggaccggtacggactagacgtagacgtagcgagtaccgtaagtcggtacgtcgtacncgtcgtcg

SEQ ID NO: 30391 - DNA, 827 bp, Homo sapiens
  misc_feature: GYAE6OF01B89CH.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctcctctggctccgaggtgccagatgtgacgtccagatcgacccagtcctccatcctccctgtacttcatctgtaggagacagagtccactatctacgttggccggacaagtgagagactaattacgaaccttagtttaggtaattggtaatacgacgacgtaggaacggaaccgtaacgggaaacccgaaccccccgtaaaacgttcccgtaaggtacttaccgtaccgtcggacccgacgtaaccgtaccggttaaactttaccaacggtaaaggttcccgggtaaccctaagttcggtaaaccggttcgtaagggtacggtacggtaaggttaccggaattccgggtacgggaacgtaacggtttaacctttaccggtaaccttccgttaaccgaaacccgtaacgtaacggtaccttaaggttaccgtaaaccggttaacccgttaaggttaaaacgtttacggttttaacggaaagtttaaccttaacgttaccgtacggtaaccgtaaacgtttaacgttaaaccgtttaataaaccccgggtttaaccttaacggttacccggtttaacggaaccggtaaccggggtaacctaacggtacggtaacggtacgaaacgtaaccggaacggttacccgtaaaggttcggtaaccggtgtaacccgacccgttaacttacgttcgttaaccgttccttacgttaacccg

SEQ ID NO: 30392 - DNA, 690 bp, Homo sapiens
  misc_feature: GYAE6OF01EFPWE.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtcgccagatgtgacactccagatcgacccagtcctccacttccctccctgtctgctatccgtggtaggacgacgacggtaccacctatccgtacgttcggaccggacgaagtcgagacgactaataacgactaaacttaatttaaaggtcgtaactaaccgaaacgaaacggaaaccggtaacgggaaacctacccgttaagtccttagtacttacgtactcgtcgtcgtacctacgtaggtacacgacggtcggtcccggtacctagtacggtaggtcgaggtcgagtaggtgtacgtcggtaggactagtacttctactccactctagtcgactcgtacgtcaaggacctaaggtagtaacgtttacttactaaccttaacttacgtataccgtaataacctaggtaaccaaccctaaccgtaacccgtccttaacgttccgtacccgttacccgggaccgtacggtacctacgtacggttacgaccggttaccgtaaccggtacgtacgggtcgttaccgacttacccggtaccttaacgtcctttacccggtccc

SEQ ID NO: 30393 - DNA, 678 bp, Homo sapiens
  misc_feature: GYAE6OF01D9U5I.33.65.F10.1.454.CMB.1.raw
  modified_base (133)..(133): a, c, t, g, unknown or other
  misc_feature (133)..(133): n is a, c, g, or t
  modified_base (195)..(195): a, c, t, g, unknown or other
  misc_feature (195)..(195): n is a, c, g, or t
  modified_base (225)..(225): a, c, t, g, unknown or other
  misc_feature (225)..(225): n is a, c, g, or t
  modified_base (454)..(454): a, c, t, g, unknown or other
  misc_feature (454)..(454): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtnccagatgtgacatccaagatcgacccagtcctcccaccctccctgtctgctatctgtcgganacagagtcacctatcctcgttcggccgganaagtccagagctatccgtccgtacttaattttaaagttggtaatcaagaccaacgaaaccgaggaccaaccgacccccttaaactcctagtacttcgtagtcggcttacgtcccgtacgtacgtccgtacgtaaccgtaaacgggttccgggtacccaagttacgtaggttacgaggtcggaacgtggagtacgtcgtacggacttagtactttaccactacctacacnctacgagctacgtctacgactaacctaggtacttatttaccgaacgtttaccttactttacgtaccgtaacctaacgtaaccgttagttaacctaaccttacccgttaacccggttactttaccggttccggaaccgggtaccgggtaccgtaacggtcggtaagtagtacgtacggtacgtacggtaaacgttcggacggtacctacggtaccaccgttaccg

SEQ ID NO: 30394 - DNA, 787 bp, Homo sapiens
  misc_feature: GYAE6OF01BT6G3.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctcccacccttccctgtctgcacttcgtggtcggagaccgagacgtacacctatccttcgttcggcccgggacaagtccagagctacgtccgttccgactttaagttttaaacttggtactacgacgaccgaaacggtaaaccggacgggaccgtaaaccggaaccccccttaaacgtccgtagtacgttacctagttcggctacggtccgtaccgtagtcctaggtaaccgtaacgggttccggggtaccctagttaaccgtaaggttacgtaggtacggtacgtaggttcggtacgttcggtacgggtaactagttaactttcctaaccttaccttaccgacctacgtaccgtacgtaccgtagttacccgtacgtaacctaacccgttagtaacgtttactttaccgttaaccttaacccgttttacgttacgttaccgttaactaacccgtaactttaaccgtaaaccttaaccttcccgtttaaaccccgttcgtttaaccgttaccgggaccggtaaccgggtaaccgtaacggtccggtaaggtaacggtaccgtacggtaccgggtaacccgttacgggttacgtacgggacccgttcgtaaccccgtagttacccg

SEQ ID NO: 30395 - DNA, 785 bp, Homo sapiens
  misc_feature: GYAE6OF01EMHFX.33.65.F10.1.454.CMB.1.raw
  modified_base (455)..(455): a, c, t, g, unknown or other
  misc_feature (455)..(455): n is a, c, g, or t
tcagtacacacactcacgaccggtgctcgatttagctacgctctaagggggagtcagtctcagtcaggacacagcatggacagtgacgggtccccgctcagcctccgtggggcctcctgctactctggctccggaggtcgccagatggtacgacactccgagactaccgaccctacgttccctcccctacccttcccgtcgtctcgactacgtcgtacggtacggagaccgagacgtaccacgtactccttcggtcggaccggactaacgtcgagacgctacgtccggttaccgtaatttaagttttaaggtggttacacgacgaacgaaaccggaacggacggaacctaacccgtaaccttaaccgtcgtagacttcgtacgcgtaccgtcgtaccgttcgaagttcgacggtaaacggtaccgggttccggtacctaaggtacggtacggttnacgggtgacggtggtacgtcgacggtaacggacttagttaccttaccaccgttacgaccgtaacacggtaccgagttacgtacgtaccgaacgtaccgtaacgtagttacgttttgtacgggttaacttggtttaacgttacgttaacgtacggttaaccgacgggtttacgggttaaccttacgggtttactaacccgtccgggttaacccggtcgggttaaccggaacccggttaaagggtaaacggaacgggttaacggtaaacgtaccgttaaacgggtacgtaggttcgggacgttactaccccgtaagttccgtaccttacggg

SEQ ID NO: 30396 - DNA, 622 bp, Homo sapiens
  misc_feature: GYAE6OF01EX940.33.65.F10.1.454.CMB.1.raw
tcagtacacacactcacgaccggtgctcgatttagctacgctctaaggggggagtcagtctcagtcaggacacagcatggacatgagggtccccgctcagctcctggggctcctgcctactctggctccgaggtgccagatgtgacatccagatgacccagtcctccaccctccctgtctgcatctgtcggagacagacgtccaccatctctggccgggcaagtcagtagctatccgtccgtacttaattttaaagttggtatcgacgacaacgaaaccgagggaccaacgaccccctaaactccgtagacttacgtatcggtacgtcgcgtaccgtagtctacgacgtaaaggtcgggtcccagtacgaaggttcaggtggactaggtcggatcggtagggactagtactttccactcttacacctatcacgtacacgttactacgactaaccgtaggtaacgttatttacgacttaacgtttaccttactacgtaccgtaactaacgttaacttacgtaactcccttaccgtacttaccgttcggaccggtaccgggtaacacggtacggtacggtagtacgcggacgtcggtaccgtggcggtacctaggccacctacg

SEQ ID NO: 30397 - DNA, 799 bp, Homo sapiens
  misc_feature: GYAE6OF01BXDEP.33.65.F10.1.454.CMB.1.raw
tcagtacacacactcacgaccggtgctcgatttagctacgctctaaggggggagtcagtctcagtcaggacacagcatggacatgagggtcccccgctcagcctccgtgggggcctcctgctactcgtggctccgagggtgccagatgtgacatcagactgacccacgtcctcccacccctccctgtcctgcatcgtggacggagtacgagtactactaccactcgtcgttcggccgggaactaacgtcgacggtacgtcgaacgttccgtaccgttaactttaaagtttaaacgttggtaactacaaggacgaaacggaaaccggacggaaccgaaccgtaacccctaaacctccgtataacttctaatcgtactacggtccgtacgtacgtcgtagtaaccgtaaacggggttccgggtaacctacgttaacggtaacggttacgggtaacgggtcggggtacggacggtagtaccggtagggaacgttaagttaccgttacgtacctaccacctaacctacgtacaacgcgtacggtacacgtaactaaaccgttagtaaacggttactttaacgtaaccgttaaccgttacgttacgtacaaccttaaactaaaccggttaactaacctaaccgttacccgttaacccgttaaccgttaccggtttaaccggaacccgggtaaggtaacccggtaacggttaccggtaacggtaacggtaacgttacggggacggtaacggtacggttacggttaaccgtcgggtaaccctaaccggttccgtacggttttaccg

SEQ ID NO: 30398 - DNA, 586 bp, Homo sapiens
  misc_feature: GYAE6OF01AZ6AE.33.65.F10.1.454.CMB.1.raw
  modified_base (329)..(329): a, c, t, g, unknown or other
  misc_feature (329)..(329): n is a, c, g, or t
  modified_base (435)..(435): a, c, t, g, unknown or other
  misc_feature (435)..(435): n is a, c, g, or t
  modified_base (527)..(527): a, c, t, g, unknown or other
  misc_feature (527)..(527): n is a, c, g, or t
  modified_base (547)..(547): a, c, t, g, unknown or other
  misc_feature (547)..(547): n is a, c, g, or t
  modified_base (555)..(555): a, c, t, g, unknown or other
  misc_feature (555)..(555): n is a, c, g, or t
  modified_base (567)..(567): a, c, t, g, unknown or other
  misc_feature (567)..(567): n is a, c, g, or t
  modified_base (576)..(576): a, c, t, g, unknown or other
  misc_feature (576)..(576): n is a, c, g, or t
tcagtacacacactcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtcctcccaccctccctgtctgcatctcgtacgggagacacgagtccacctatcctcgttcggcccgggacaacgtcagacgcacgtccgtccgtacttaagtttaaagttggaatcagacaacggaaccgagggaccaaccgtacccctaaacctcctagactcgtacncgtctcgtccgtacagtctaggacgaacgggttcgggaccctaagtacgtaaggtcagggtcgagtcggtagatcggtaggactagtacttccacgtctaccactntacacgtctacgtcacgacctaacggtagtaactttcgttacgtacttaacttcgttactacgactaacgtactactacctatcctaccgtnttacgtcggacgtacggacngtggtagnacgcgaggtccngtgcgtacncgactcgtcg

SEQ ID NO: 30399 - DNA, 742 bp, Homo sapiens
  misc_feature: GYAE6OF01BCQ2Q.33.65.F10.1.454.CMB.1.raw
  modified_base (196)..(196): a, c, t, g, unknown or other
  misc_feature (196)..(196): n is a, c, g, or t
  modified_base (234)..(234): a, c, t, g, unknown or other
  misc_feature (234)..(234): n is a, c, g, or t
tcagtacacacactcacgaccggtgctcgatttagctacgctctaagggggagtcagtctcagtcaggacacagcatggacatgacgggtccccgctcagctccgtggggctcctgctactctggctccgaggtgccagatgtgacatccagatcgacccagtcctcccaccctccctgtctgcatcgtgtcgganacagacgtccacctatccgttcgttacggcccgggtanaacgtcgaagacgccaacgttccgtacctacgtttaattttaaaggtcggttacacgtaggaaccgaaaacggaaaccggacgggaccctaaaccggtaccccttaaacgtcccgtaaggtacttacgtacgtcggccgttacggtaccctacgtaggttactacgggtaacgtaaacgggtccgggtaccctagttacggtaacgtcgtaggtacgacgtaggtcggttaatccggggtaagactagttaacctttacacccgttactaccgacctacgtacgacgtactaggtaccttaacgggacctacgttaaggtaacctttacgttacgtaaacctttacgtttaccgtaactaccgtaacctaaacgaacgtttacgtaacctaccgttacctaccgttaccgtacggttaccgacggtaacgggtacctaggtactcgggtaactcggtaacgacggttacccgtaacgggttcgtaccgtccaacgtccgtacgttacg

SEQ ID NO: 30400 - DNA, 692 bp, Homo sapiens
  misc_feature: GYAE6OF01AIJIP.33.65.F10.1.454.CMB.1.raw
  modified_base (193)..(193): a, c, t, g, unknown or other
  misc_feature (193)..(193): n is a, c, g, or t
  modified_base (467)..(467): a, c, t, g, unknown or other
  misc_feature (467)..(467): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctcccaccctcctgtctgcatcgtgtcgganacagacgtcaccactctcgttcggccggactaacgtcgagacgctacgtccgtccgtacttaatttaattggtactcgaacgactaacggaaaccgacggaaccaaccgtacccctaaactccgtgtactctacgtcgcgtcgaccgtacctacgtctacggacgtaacgggtccggtaccctagtacgtagtacgaggtcggtagtcggtactacggtacggactagttcttacctactccgtaaccacctactacgagtacgtacgttaccncggtaacctaccttaaggtaactttacgtttaaccgacctttaacgtttacctacgttactaacctaactaacgttaaccttaccctaacgttcccccttaacgtttaccgtttacggttaccggaaccggtaaccggtaccgtaacgtaccgtaagggacctagaacggttaccggaaccgtttcggacggttcgaccgtaccgtaaccctcgtcgtttacccg

SEQ ID NO: 30401 - DNA, 614 bp, Homo sapiens
  misc_feature: GYAE6OF01BZMUH.33.65.F10.1.454.CMB.1.raw
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (307)..(307): a, c, t, g, unknown or other
  misc_feature (307)..(307): n is a, c, g, or t
  modified_base (349)..(349): a, c, t, g, unknown or other
  misc_feature (349)..(349): n is a, c, g, or t
  modified_base (597)..(597): a, c, t, g, unknown or other
  misc_feature (597)..(597): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctcccaccctccctgtctgcatctgcgganacagngtcacattctcttgccggcaagtcagngcatcgtccgcttaattaattggtactcgagcaacgaaccagggccaacgaccccttaaatcctagattccatcgctgcgtcngtactgacaacggtcggtcccaagtctaaggttcaggtacgntacggtggactcggtaggacgagttacctttacgacttcgtacacctaacgttcaacgtcacgttccgtacgtacgaaccgttagaaacggtttacgtttacaccgttaaacctttcctttacgtacgtactaaacgacttaacgtacctactaccttccccggttaattaccggtttccggacggtaaacgggacctaacggtcgtacggggaattacgcccggtagtacccgaacgttaggtccgngttaccgactccgtacg

SEQ ID NO: 30402 - DNA, 738 bp, Homo sapiens
  misc_feature: GYAE6OF01E3LTK.33.65.F10.1.454.CMB.1.raw
  modified_base (228)..(228): a, c, t, g, unknown or other
  misc_feature (228)..(228): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctcccaccctccctgtctgcatctgtcggagacagagtccaccattctcgttgccgggcaagtcaggngcagtccgtccgtattaatttaagttggtatacagacaacgaaaccgaggacaacgtaccccctaaactccgtagacttctactcgtcgtcgtccgtacctgtcgtggaacgtaacggtccgggtaccctacgtacgtaacggttcaggtcggtacgtagggtcggtacgtcggtacgggtactaacggttactttaccaccttacctaaccctaaccctaacgttaccggaagttaccgtacggtttaccgtacgtaacccgttaaccgtaaggttaaacgtttacttttaccggaaccctttaaaccttttacgtttaccgttacgtaacctaaacctaacgttaacgtttaaccgtaacctttacccgttaacccgttaaccgtttaccggttaccgggaacccggtaaccggggtaacctaaccgggtacggtaccgggtaacgtacgtacgggtaaccggtacggtaacggttcggtacgggtcctacgtacctacccgttaccg

SEQ ID NO: 30403 - DNA, 690 bp, Homo sapiens
  misc_feature: GYAE6OF01DKICL.33.65.F10.1.454.CMB.1.raw
  modified_base (227)..(227): a, c, t, g, unknown or other
  misc_feature (227)..(227): n is a, c, g, or t
tcagtacacacactcacgaccggtgctcgatttagctacgctctaagggggagtcagtctcagtcaggacacagcatggacatgagggtccccgctcagctcctggggctcctgctactctgctccgaggtgccagatgtgacatccagatcgacccagtcctcccaccctccctgtctgcatctgtcggagacagagtcaccatctcgtcgccggcagtcagagcntccgtcctattactttaaagtggtatcagacaagaaaccagggacaacgacccctaaactctagatctatgtctcggtaccgtacctagttcgtacggacgtaaaacgggttcggggtaacccctagttaccggtaaaggtttacgaggttcggacgtagggttagggtacggttccgtaggggtactaacggtttactttacctaccgttcctaccaaccgtactacgtacgacgtacgtctacgacctaaccgtagtaacttacgttttacgacctttaacctttaccttacttcgtaacctaaccttacgtaacgtttaacctacgttcccttacccgttaccgttacgttttacccgggaaccggtaacgggtaacccgtaaggtaccgtaagggtagtaacggttacggaacgggttaccgtaacggtccgttacggccgtaccgccgtacttaaccg

SEQ ID NO: 30404 - DNA, 868 bp, Homo sapiens
  misc_feature: GYAE6OF01BAQ1C.33.65.F10.1.454.CMB.1.raw
  modified_base (138)..(138): a, c, t, g, unknown or other
  misc_feature (138)..(138): n is a, c, g, or t
  modified_base (178)..(178): a, c, t, g, unknown or other
  misc_feature (178)..(178): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagntgtgacatccagatcgaccagtcctccacccttcctgtcncgcactcgtggtcgagacgagacgtccactatctcgtcggaccggactaagtcagacgactactccggtaccttagtttaaacttttaaggtacggtactaaccgaaggaaccaaaccgtaaaaccggcggggtaacccctaaaacgtaccccccgttaaactcccgtagtaactttacctacggtacgtccgtccgtaccggtaccggttagttacaaccgggttaacggtaaacccggggttacgggtacccctaaagttaacggttaagggtctaaggggtccgggattacggtaggtacggttaccggtaaggggtaaaccttaaggtttacttacccgaccgttaaccctaaccgacccgtaacgtacgtaacgtaccggttaacgtacgtaccgtaaaccgtaacggttaacggtaaacgttttaccgtttaaacgttaaaccgttaaccgtttacccgtttacgttaaccgtaaacctaactaaaccgtttaacgttaaccgttaacctttaaccccgttaacccggtttaccggtttaaccggttaccgggtaccggggttaaaaccggtaaccggtaccgggtaacggttaacggtaacggttacggtaaccggttaacccgggaaacgtttaccggtacggtaccggttaacccgtacgaccccgttaagtttaacccgg

SEQ ID NO: 30405 - DNA, 708 bp, Homo sapiens
  misc_feature: GYAE6OF01AW2IB.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctcccaccctccctgtctgcatctggtcggagacagacgtccaccattcctcgttggcccgggacaagtcaagtacgctactccgtccgtacttaatttaaagttggtaatacgagacaaacgaaaccgagggaccaaacgtaccccctaaactccgtagtactctagtcgctcgcgtccagtcgtagacgaaggttcgggtacctagtacgtaaggttacgaggtcggacgtaggtgtacgtcggtaggtaactacggttacttaccgaccttctaccgactacgtccgtaagaccgtagtcctacgtaacctaacccgtagtaaagtttacgtttacgtaacctttaacgtttaccttctaaccgttactaaaccgtacttaaccgttaacctaaccgttcccgttaacccgttaacttacccggttacggaacccgggttaaccgggaactaaccggtcggttaacggaacgtaacggttaccggacggtaacccggttagttaccgggtacggtacccgttaaccgcgttaacccgttaccgg

SEQ ID NO: 30406 - DNA, 786 bp, Homo sapiens
  misc_feature: GYAE6OF01BVL63.33.65.F10.1.454.CMB.1.raw
tcagtacacacactcacgaccggtgctcgatttagctacgctctaagggggagtcagtctcagtcaggacacagcatggacatgacgggtccccgctcacgctccgtggggctcctgctactctggcctccggaggtacagtatgtgacataccgagactcgacctagtcctcccaccctccgtgtctcgctagtcgtacggtcggacacgagacgtccactacgtcttcgtcggaccggactacgtacgagacgccgtacgttccggtaccgttaacgttttaaacgtttaaagttcggtaactacgaacgtacgaaaaccggaaaccggaggacccctaaaccccgtaacccctaacgttcccgtaagtacttccgtaagtccgtaccgtccgtaaccgtctacgttacgtaaggaaccggtacggtccgtaacctaagtacggtacggtatacgggtacggtagtacggtagtaccggtacggacggtactacgttctttacccgacttaccaccgacgtacgtacgacgtacgtacgtcgtaaccgtaactacgtagttaacgttacttactaaccgtacgtttccgtaacgtactaacctaagtacccttaacgttaacctacccgttttaccccggtaacgttaccggttacggttaacccgggtaccggaaagtacccgtacgtaacggtaagggttacccgtaggtaccggtaacgggttacccgttaaggtcgggtaccctaccggaccccgtaacgttaaccgttccgtttaccgg

SEQ ID NO: 30407 - DNA, 817 bp, Homo sapiens
  misc_feature: GYAE6OF01DII5Z.33.65.F10.1.454.CMB.1.raw
  modified_base (193)..(193): a, c, t, g, unknown or other
  misc_feature (193)..(193): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccaccctccctgtctgcatctgtcggaganagagtccaacctatcctcgttggaccgggacaagtcagagtcagtccgtaccgtactttaattttaaatggtaactacgagacaaacggaaaccagggaaccctaaacggtaaccccccttaaaacgttcccgtaagaactttccgttaagtcgtaccgttcgacccggttaccgtaagtttacccgaaggtaacccggtaaaaagggttcccggggttaaccctaacggttaacccggttaaaaagggttttcggaacgggttacgggtaaccgacggggtttaaggaaccggtttacgggttaaacggggaacccgttaaaggtttaaaccccgtttttccgaactttaccccgttaaccgaaccctaacgttaaccacggtaacgtacgttaccgttaacgtaacccgtaaacgtacgtaacgtttaacgtttacgtaaccttaactttaccgtttactaccgtaactaactaacgtaacgttaacctaacgttacccgtaacccgttaacttaccggtttacggaacccggtaacgggtaccgaacggtacgtacgggttaagacgttaccggaacgggtaccgtaacgtcggtaacgtcgtacctaccgtacgttaccg

SEQ ID NO: 30408 - DNA, 739 bp, Homo sapiens
  misc_feature: GYAE6OF01ERFXK.33.65.F10.1.454.CMB.1.raw
  modified_base (189)..(189): a, c, t, g, unknown or other
  misc_feature (189)..(189): n is a, c, g, or t
  modified_base (194)..(194): a, c, t, g, unknown or other
  misc_feature (194)..(194): n is a, c, g, or t
tcagtacacacactcacgaccggtgctcgatttagctacgctctaagggggagtcagtctcagtcaggacacagcatggacatgagggtccccgctcagctcctgggctcctgctactctggctccgaggtgccagatgtgacatccagatgacccagtctcccaccctcctgtctgcatctgtcgganacagntcactatcctcgttcgccggacaagtcagacgcacgttcgtaccgacttaagttttaagttggtaatcgaagccaaacgaaaaccggtaggggaccctaaaccggtaaccccccttaaaacttcccgtaaggtactttaccgttaagtccggtccgttacggtcccgttaccgtaagttccgtacggtaaccgtaaacggggttccggggtaccctaacgtaccgtaacgggtttcgacgggttggaccgttaagggtacggtatcggggttaagggaaccttacggtacttttaccaacccgtttcctaacctaacccgtacttaccgaaggtcctaacggtttcctacggtaacctaacccgttaggttaactttacgtttaacgtacccttaaccgttttccttaccgtagtaaccctaaagtaccgttaacgttaactaccgttcctaccgttactacgtttacggaccgtaacgggtacctaggtacgtagtacgtacacggtacggaccaaggttcgacggctaccggactcgttaccg

SEQ ID NO: 30409 - DNA, 876 bp, Homo sapiens
  misc_feature: GYAE6OF01CKKUO.33.65.F10.1.454.CMB.1.raw
  modified_base (95)..(95): a, c, t, g, unknown or other
  misc_feature (95)..(95): n is a, c, g, or t
  modified_base (274)..(274): a, c, t, g, unknown or other
  misc_feature (274)..(274): n is a, c, g, or t
tcagtacacacactcacgaccggtgctcgatttagctacgctctaaggggggagtcagtctcagtcaggacacagcatggacatgagggtccccnctcagctccgtggggcctccctgcctactcgtggccgtccggaggtcgccaagatgtgaacactccaagataccgaccctacgttccctccccaccccttcccgtgtctcgcacttctggtcggagacgacgtacgtaccacctactccgttcgtcgggccggtaacgacgtcaggacnctacgttccgtaccgttaactttaaagttttaagtcggtactaccgaagtaaccgaaacgaaaccgacgggaacccaaccccgaaccccctaacgtcctagacttacctcggccgaccgtctacggtacctattaaaccgagtacggttcccggacctaggtaccggtacggttaccaggggtggtacggtagtaccggtacgtcgggacggtaactaggtttaacctttacccgtacccttaaccgaccccgttaaacgtaaaggttaacccgtaccggttaacgttaccgggttaaacccgttaacggtaaagtttaaaagggtttacgttttaacggggaaacttaaccgttttacccgtttacggttaaacccgtaaggtaaaaccctttaacggttaaacgtttaaaccccggtaacccgtttaaacccccggtttaacgtttaccggggtaacccggggtacccgggtaaaacccgggttattaaaccggggtaacgggtaacgtacgtaactaacggggtaaaccgtacgttaccggtggtacccgtacgttaccccgaacttaccggttatttcccgttccgttaccgtacccg

SEQ ID NO: 30410 - DNA, 778 bp, Homo sapiens
  misc_feature: GYAE6OF01B5XLY.33.65.F10.1.454.CMB.1.raw
  modified_base (185)..(185): a, c, t, g, unknown or other
  misc_feature (185)..(185): n is a, c, g, or t
tcagtacacacactcacgaccggtgctcgatttagctacgctctaaggggggagtcagtctcagtcaggacacagcatggacatgagggtccccgctcagctcctggggctcctgctactctggctccggaggtgccagatgtgacatccagatcgacctagtcctcccaccctccctgtctgcntcgtggtccggaagacgagacgtaccacctattccttcgttcggacccggggtacaacggtcaggacgacacgttccgtaccgtacttttaaagttttaaagttcggtaactcgaacgactaaacggaaaccgtacgggacctaaacccgtacccccttaaacgtccgtagtaacttcctagtcgtactccggtcggtacctagttccgtaggtaaccgtaacgggtccgggtacctacgtacgttaacgggtacgaggtacgtaggtaggtagtacgtacggtacgggaacgtagttaccttaccaaccgttcctaacctaaccgtacctacgtacgtaacgtacgtaccgtaaccggtaaccctaaagttaacggttaaagtttaacggtttaacgtaacgttaacgtttacgtttacgtacgtaacgtaacttaaacgttaacgtttaacgttaaccgttaaccgtttaccgttaacgtttacggaacccgggttacggtaaccgtaggtaacgtaggtaacgtaacgtaacgtacggtacggttaacggtcggtaacggacgttaaccgaccgtaccgttagttaccgg

SEQ ID NO: 30411 - DNA, 884 bp, Homo sapiens
  misc_feature: GYAE6OF01ASRRL.33.65.F10.1.454.CMB.1.raw
tcagtacacacactcacgaccggtgctcgatttagctacgctctaagggggagtcagtctcagtcaggacacagcatggacatgagggtccccgctcagctccgtggggctcctgctactctggctccggaggtgccagatgtgacatccagatcgacccagtcctcccaccctccctgtcctgctattcgtcggtacggaagacgagtacgtaccaacctacttccgttcgttaccgggcccgggtaactaaacggtccgaaggtacggaccgtaccgttcccggttacccgtaacgttttaaagtttttaaaacggtttagggttaactacggaacgaccgtaaaaaccggaaaacccggacggggtaaccctaaacccggtaacccccctttaaaaccgttcccgttagtaacttccgttaagtcggtccgtccggtacccgttcggaacgttccgtaacggttaaccggtaacgggtttcccggggtaaccctaggttaacggtacggtttacgaggtacggtacgtaggtacggtacggtacggggtacgtaacggttactttacttaccgtaccgttacctaccgtactaccgtacgtaccggtacttacggtccgttaccggtaacctaacggttacgtaaggttttacccgttaagttaacctttaacccgtttacttaccgttaaaccgttaactaaaccttaacttaacgttaacccgttaaccgttacccgttaccgtttacccctttaacggggttccggtaacccggttaaaccgggtaaccgtacgggtacgtacgggtacggtaactccgggtaacgggtaacgttaacggttcgttacccgggtactaaccgtacccgtcccgttacg

SEQ ID NO: 30412 - DNA, 779 bp, Homo sapiens
  misc_feature: GYAE6OF01BLQX1.33.65.F10.1.454.CMB.1.raw
  modified_base (133)..(133): a, c, t, g, unknown or other
  misc_feature (133)..(133): n is a, c, g, or t
  modified_base (138)..(138): a, c, t, g, unknown or other
  misc_feature (138)..(138): n is a, c, g, or t
  modified_base (179)..(179): a, c, t, g, unknown or other
  misc_feature (179)..(179): n is a, c, g, or t
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (728)..(728): a, c, t, g, unknown or other
  misc_feature (728)..(728): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtnccagntgtgacatccagatcgacccagtcctccaccctccctgtcngcatctgtcgganacgngacgtcaacctatctcgtcggcccggacaacgtcaggactctacgtccgtccgtatttaaacgtttaaagttcggttaactcaacgtaccgaaacggaaaccggacggacctaacccgtaacccccttaaacgtccgtagtaaccttcgtaacgtcggaccgttccggtccgttaccgtaagttccgtaacgggaaaccggttaaaaccggggttccgggtaacccccttaagggtaacggttaaacgggttacgtacggtcgggaaccttagggtacgtaaccgttagggacggtaacttagttaccctttaccaccttccgttaaccacctacgttaccggaacttccgtaaaggtttcccgacggtaaaccttaaccgttaagtaacggttttcctttaacgaacctttaccgtttacttcgtaacgtaaccaactaacctttaacgtaacttacccgttacccgtttacccgtaacgtttaacggttccgggaacccgggtaagtaccgtaacggtcgtaacgggtanacggtaacgcggtaacgtaacgtcggtacggaccctcgaaccgttcctacg

SEQ ID NO: 30413 - DNA, 701 bp, Homo sapiens
  misc_feature: GYAE6OF01EVV4R.33.65.F10.1.454.CMB.1.raw
  modified_base (211)..(211): a, c, t, g, unknown or other
  misc_feature (211)..(211): n is a, c, g, or t
  modified_base (243)..(243): a, c, t, g, unknown or other
  misc_feature (243)..(243): n is a, c, g, or t
  modified_base (327)..(327): a, c, t, g, unknown or other
  misc_feature (327)..(327): n is a, c, g, or t
  modified_base (687)..(687): a, c, t, g, unknown or other
  misc_feature (687)..(687): n is a, c, g, or t
tcagtacacacactcacgaccggtgctcgatttagctacgctctaagggggagtcagtctcagtcaggacacagcatggacatggacgggtccccgctcagctccgtggggctcctgctactctggctccgaggtcgcctagatgtgacagtccagatcgaccagttcctccctaccctccgtgtctcgcatcgtgtacggagtacagacncactattcctcgtcggaccggatacgtgagancgtatccgtacctattaatttagtgtatcgagacgaacgaaccgacggaccaaccgtaaccccttacgtcctatacttacgtancgtacgtccgtaccgtacgtagtcgtacgaaaccgtacgggtaccgtacctagtaacgtagtcgagcgcaggtcgagtcgaggtactagtaccttacactctaccgactagtccaaggtctactacgtaccgaaccgtaaacgtgttaacggtttttacctaccgtaaacctttactttacgtaaccgtactaaacccggaactaacgtttaacccgttaactaaccgtttccccggtaaatttccggttacggttacccgggaaacccgtacgggtaaacctaaggtttaccggggacgtttaaacggacgttaaacggggaccgtttaagacccggttaggccttaccggtaaccccnggttaaccccctgg

SEQ ID NO: 30414 - DNA, 675 bp, Homo sapiens
  misc_feature: GYAE6OF01DNM58.33.65.F10.1.454.CMB.1.raw
  modified_base (123)..(123): a, c, t, g, unknown or other
  misc_feature (123)..(123): n is a, c, g, or t
  modified_base (482)..(482): a, c, t, g, unknown or other
  misc_feature (482)..(482): n is a, c, g, or t
tcagtacacacactcacgaccggtgctcgatttagctacgctctaagggggagtcagtctcagtcaggacacagcatggacatgagggtccccgctcagctccgtggggctcctgctactcgngctccgaggtcgccagatgtgacatccgagactacgaccacgtcctcccgacccttcctcgtctgctattcgtcgtacggagacgaagacgtacacctatcgttccgtcggccggaacacgtcagtacgacgtacgtccgtacgtactttaaagttttaagtcgtactcgaacgtacgaaacgaaaccggacggacgaaccgtaacccctaacgtcgtatacgtcgtagtcgtcgtacggtcctacgtacgtcgtacggaacgtaacggtcgacctacgtacgtaagtcgagtgacgtggtcgagtcggtagaacgtacgttaccttgaccgttacaccgtacgtactacgcgtaacgngttaccgacgtacgtaaaggtttataacgtttcgtaaactacttaacttaccagttaactaacgacgaacgtacctaccgaaacctaaccgtttacccctagttcctaacccgggtcgtaacccgtacgaacgtacgcggtattaaccggacgtaaccggtccgtagtcggtacgaccctcggaacctcgtcg

SEQ ID NO: 30415 - DNA, 718 bp, Homo sapiens
  misc_feature: GYAE6OF01CHP14.33.65.F10.1.454.CMB.1.raw
  modified_base (328)..(328): a, c, t, g, unknown or other
  misc_feature (328)..(328): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatggtgacatcccagtactcgacccagttcctcccaccctccctgtctgccattctggtcggagacagagtccacatctcgttcgccgggacaagtcaggacgcatccgtcctctttaattaatttggatcagacgaacgaaaccgagggacaaccgtaccccttaaactcccgtagtacttcttaactcncgtcggtaccgtcctacgtccgttaggaacgtaagggtcccggggtaccctaagttccggtaaacgggtttccgagggttacggccgtaacgggtaggtacgtcggttaccgggaacgtaggttaaccgtttcaaccgttcccggttaccaaccgtactccgtaagtacgtccgttactcggtaactaccgtacgggtttaacgttacgttttaacgaccgtttaacttttacgttacttacgttaaccaacgtaacttaggttaaaccttacttacccgttacccttacggtttaccgtttcgggacccgtacgggggtaccctaggtccgtaggtacgttacgacggtaccgacgttacggtcggtcggtaccacgtcgaaccgttcg

SEQ ID NO: 30416 - DNA, 519 bp, Homo sapiens
  misc_feature: GYAE6OF02IYMWO.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgtcggcaagtcagagcatcgtccgctatttaaattggtatcagcagaaacccagggacaacgacccctaaactcctgatctatgctgcgtccagtctgcaagtgggtccatcaaggttcagtggacagtgatcgtggacagtatttcactctcaccatcagcagtctgccaacctgaagtattttgactaacttctttctgtacaacacctagttaccaattcctaccccgttaatacctttagggccgtaaggggtacccaagcgtgggaactatacgaggacgtaactggtcggcctcgtacacctacg

SEQ ID NO: 30417 - DNA, 480 bp, Homo sapiens
  misc_feature: GYAE6OF02GQT40.33.65.F10.1.454.CMB.1.raw
tcagtacacacactcacgaccggtgctcgatttagctacgctctaaggggagtcagtctcagtcaggacacagcatggacatgagggtccccgctcagctcctgggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaactcctgatctatgctgcgtccagtctgcaaagtggggtcccatcaaggttcagtggcagtggatctgggacagatttcactctcaccatcagcagtctgcaacctgaagattttgctaacttacttctgtcaacacagttacaatctccgtacacttttgccagggaccaagcgtggagatcaggcgaactgtggctggtcactac

SEQ ID NO: 30418 - DNA, 490 bp, Homo sapiens
  misc_feature: GYAE6OF02F91KF.33.65.F10.1.454.CMB.1.raw
  modified_base (464)..(464): a, c, t, g, unknown or other
  misc_feature (464)..(464): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaactcctgatctatgctgcgtccagtctgcaaagtcgggtccatcaaggttcagtggcagtggatcgtgggacagatttcactctcaccatcagcagtctgcaacctgaagtattttgactaacttacttctgtacaacacagttacaattcctaccgttactacttttggaccagggaccaagctgganatcaggcgaactggtggctgcactac

SEQ ID NO: 30419 - DNA, 478 bp, Homo sapiens
  misc_feature: GYAE6OF02FX3SR.33.65.F10.1.454.CMB.1.raw
  modified_base (453)..(453): a, c, t, g, unknown or other
  misc_feature (453)..(453): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctattaaattggtatcagcagaaaccagggcaagcccctaaactcctgatctatgctgcgtccagtctgcaaagtgggtccatcaaggttcagtggcagtggatctgggacagatttcactctcaccatcagcagtctgcaacctgaagtattttgctaacttacttctgtcaacacagttacaatcctccgtactactttgccagggaccaagctgganatcagcgaactggtggctgcactac

SEQ ID NO: 30420 - DNA, 484 bp, Homo sapiens
  misc_feature: GYAE6OF02G0ERV.33.65.F10.1.454.CMB.1.raw
  modified_base (432)..(432): a, c, t, g, unknown or other
  misc_feature (432)..(432): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaactccctgatctatgctgcgtccagtctgcaaagtggggtcccatcaaggttcagtggcagtggatctgggacagatttcactctcaccatcagcagtctgcaacctgaagattttgctaacttacttctgttcaacacagttacaatctcccgtanactttggccagggaccaagctggagatcaggcgaacgtgtggctgcactacg

SEQ ID NO: 30421 - DNA, 491 bp, Homo sapiens
  misc_feature: GYAE6OF02GZVS1.33.65.F10.1.454.CMB.1.raw
  modified_base (460)..(460): a, c, t, g, unknown or other
  misc_feature (460)..(460): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaactcctgatctatgctgcgtccagtctgcaaagtggggtcccatcaaggttcagtggcagtggatctgggacagatttcactctcaccatcagcagtctgcaacctgaagtattttgctaacttacttctgtcaacacagttacaatcctaccgtactactttcgccgagggaccaagcgtgganatcgaggcgaactggtggcgtcgacactacg

SEQ ID NO: 30422 - DNA, 564 bp, Homo sapiens
  misc_feature: GYAE6OF02I27Z8.33.65.F10.1.454.CMB.1.raw
  modified_base (211)..(211): a, c, t, g, unknown or other
  misc_feature (211)..(211): n is a, c, g, or t
  modified_base (349)..(349): a, c, t, g, unknown or other
  misc_feature (349)..(349): n is a, c, g, or t
  modified_base (495)..(495): a, c, t, g, unknown or other
  misc_feature (495)..(495): n is a, c, g, or t
tcagtacacacactcacgaccggtgctcgatttagctacgctctaaggggagtcagtctcagtcaggacacagcatggacatgagggtcccgctcagctcctgggctcctgctactctggctccgaggtgccagatgtgacatccagatgacccagtctccaccctccctgtctgcatctgtaggagacagagtcaccatcacttgccggnaagtgagagcattagaaccttattgaattggtatcagcagagaccaagggaaaccccccgaaaactcctagatctctgccgcaatccgatttaacacaatgggtcccaatcgaggttcagtgcagtgatcgtgggacngtactttcacttcaccaccataagctaagtcctaggaacctggtaaactgttttagggaattagttaacttcttagtcaacgtaacgatttaaatacgtaaccccgttaacagtttttacgggacctaacggggtacaaacgggtntacgggatacgttacgaaggaccgtaagtcgttagggcctggaccaaccgtattcgtaccgttcttacg

SEQ ID NO: 30423 - DNA, 490 bp, Homo sapiens
  misc_feature: GYAE6OF02IXJBD.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaaactcctgatctatgctgcgtccagtctgcaaagtgggtccatcaaggttcagtggcagtggatcgtggacagatttcactctcacatcagcagtctgcaacctgaagtatttgctaacttacttctgtcaacactagttacaattctaccgttactactttggacctagggacccaagcgtggacgatcgaggcgtaactggtggctgcactac

SEQ ID NO: 30424 - DNA, 494 bp, Homo sapiens
  misc_feature: GYAE6OF02I9J43.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaaactccctgatctatgctgcgtccagtctgcaaagtgggtcccatcaaggttcagtggcagtggatcgtgggacagatttcactctcaccatcagcagtctgcaacctgaagtattttgctagtgtattactgtcagctagtacggtagttctatctccgacgttcggaccaagggaccaaggtaggaaatacgaaacgaactggtggctgcaccatcg

SEQ ID NO: 30425 - DNA, 511 bp, Homo sapiens
  misc_feature: GYAE6OF02IFGRG.33.65.F10.1.454.CMB.1.raw
  modified_base (302)..(302): a, c, t, g, unknown or other
  misc_feature (302)..(302): n is a, c, g, or t
  modified_base (373)..(373): a, c, t, g, unknown or other
  misc_feature (373)..(373): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaactcctgatctatgctgcgtccagtcngcaaagtgggtccatcaaggttcagtggcagtggatcgtggacagtatttcactctcaccatcagcagtcngcaacctgaatattttgactaactttacttctgtacaactactagttaacaacttcctacccgtacttacgtttcgaccgacgggaccaagtcgtaggagactcgacggacgaacgtggtacggcgtacgccactacg

SEQ ID NO: 30426 - DNA, 790 bp, Homo sapiens
  misc_feature: GYAE6OF02HLNCR.33.65.F10.1.454.CMB.1.raw
  modified_base (224)..(224): a, c, t, g, unknown or other
  misc_feature (224)..(224): n is a, c, g, or t
  modified_base (271)..(271): a, c, t, g, unknown or other
  misc_feature (271)..(271): n is a, c, g, or t
tcagtacacacactcacgaccggtgctcgatttagctacgctctaaggggaggtcgagtccttcacgtcgaggaccaacgacgtccattgggacatgagggtccccgctcagctcctggggctcctgcctactcgtaggtcgtccgaggtgcctaggttactgttgacctatttccgaaggatcgacccagtctccgaccctccctagttcgtggctattcggngtccggagaccaggacgttcggacccagtccgtctttcggcccgggntaaggttccacgagtcaattcccgttaccgctttaatttaaagttggtatcgagtcgacgaaccagggcctaacgaccccgtaaagtcctggatcgtatcgactgaccgtccaagtctgacgtaaagggtcggggtaccctagtacgtaagggttacacggttggtacgaagggttcggtactaccggtagggtaacctacggtaattttaccgaaccttaccgttaccgaaacccgtaacttacccgtaacgtaccgtaacggtttaccttacggaaccctaaaacccgtaggtaaacgttaacgtttttacggacgttaaaccgtttacgttaccgttacggtaacccgtaaacgttaaccgttaaacgttttaaaccaaacgtttccgttaaccccgttaacgtaaccgtttacgggaaccgtaacggggtaccgtaacggttacggtaacggtaaccggtacgtacggtaacgggacccgtacgttccggtacgtccgtaccgtaccaccgtaac

SEQ ID NO: 30427 - DNA, 487 bp, Homo sapiens
  misc_feature: GYAE6OF02GVKFT.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctattaaattggtatcagcagaaaccagggcaagcccctaaactcctgatctatgctgcgtccagtctgcaaagtgggtccatcaagttcagtggcagtgatctggacagatttcactctcaccatcagcagtctgcaacctgaagtattttgactaacttacttctgtacaacactagttacaatctcccgtactacttttgaccgtagggaccaagcgtggacgatacgaggcgaacgtgtggctgcactac

SEQ ID NO: 30428 - DNA, 542 bp, Homo sapiens
  misc_feature: GYAE6OF02IA266.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaactccctgatctatgctgcgtccagtctgcaaaggtgggtccatcaaggttcagtggcagtgatcgtggacagatttcactctcaccatcagcagtctgacactgaatattttgactaactttacttctagtacaactactagttaactaacttaccttacccgttaactacgttttacggacccgtaggggtacccaacggtccgtagggaacgtacgtaccgaacgggtaccgaacgttggtaggtaagtcggtaccacctaacg

SEQ ID NO: 30429 - DNA, 584 bp, Homo sapiens
  misc_feature: GYAE6OF02GHQOV.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctcctctggctccgaggtgccagatgtgacgtccagatgacccagtctccatcctccctgtcttcatctgtaggagacagagtcaccatcacttgccgggcaagtgagagcattagaacctatttgaattggtatcagcagagaccaggtaaacgcccccaaatcctagactctctgccgcactccgatttacacaatcggggtccccagtcgaggttcaggtggcagtggatcgtgggacagtattcactctcacataagcagtctaggaacctgaagtatttaggaatattacttctgtacaactagtaactttataacgtaacccgttactaccgttttcggaccgtaaggggtaacccaaaggtaccgttagggaagtacgtacgaaacggtccggtaaacgttggttacgggccttaggacccgtaacccgtaacgttccgttacgtttaccgttaccttaaccg

SEQ ID NO: 30430 - DNA, 601 bp, Homo sapiens
  misc_feature: GYAE6OF02JB89W.33.65.F10.1.454.CMB.1.raw
  modified_base (213)..(213): a, c, t, g, unknown or other
  misc_feature (213)..(213): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcacatctcttgccggnaagtcagagcatcgtccgctatttaaatggtatcagcaagaaaccgagggaccaacgacccctaaactcctgatctatcgctcgcgtcctagtctagacgtaaaggtcggggtcccagtcgtaaggttcaggtcggactaggtggatcgtgggtacaggtatttaccacttcctacaccatcagctagttctagacctaaccgtagtaattattttacgacttaaccgttacttcgtacgttacctaaacacttaacgttaacctaacgttaccttacccgttaacttaccgtttacggaccgtaacgggtaccaaggtaccgtagggaactaagttaccgaacgggtaccgtaacgtcggtccggtacgtacggtacctaccgtacg

SEQ ID NO: 30431 - DNA, 505 bp, Homo sapiens
  misc_feature: GYAE6OF02FGK33.33.65.F10.1.454.CMB.1.raw
  modified_base (500)..(500): a, c, t, g, unknown or other
  misc_feature (500)..(500): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaacgcccctaaactcctgatctatgctgcgtccagtctgcaaagtgggtccatcaaggttcagtggcagtggatcgtgggacagatttcactctcacatcagcagtctgcaacctgtaagttatttagttaactttacttactgtacaacactagttacaatcctacctactactttcggccgacgggaccagcgtggaagatacgaggacgaacgtcggtcggctcgccacctnttccg

SEQ ID NO: 30432 - DNA, 508 bp, Homo sapiens
  misc_feature: GYAE6OF02F9SD4.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaactcctgatctatgctgcgtccagtctgcaaagtgggtccatcaaggttcagtggcagtggatcgtgggacagtatttcactctcaccatcagcagtctgaccaacctagaagtattttgactaacttacttctgtacaacacagttacaattcctacccgttactacgttttcgccgaacgggaccaacgtcgtggagatacgaggacgaacgtggtcggctcgcacctacg

SEQ ID NO: 30433 - DNA, 573 bp, Homo sapiens
  misc_feature: GYAE6OF02FUB03.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaacgcccctaaatcctgatctatgctgcgtccagtctgcaagtgggtccatcaaggttcagtgcagtggatcgtgggacagtatttcactctcaccatcagcagtctcgacaacctgaagtacttttgactaacttacttctacgtactaaacctactacgtttaaccaattcccttacccgttaacttaaccgtttttcgggacccgtaacggggtacccaacggtccgttacgggaacgtaacgttaccgaacggtaccggtaaaccgttcgggttacgggtccttacggaccctaacccgtaacg

SEQ ID NO: 30434 - DNA, 559 bp, Homo sapiens
  misc_feature: GYAE6OF02IK4CT.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcacatctcttgcccgggcaagtcagagcatcgtccgctatttaaattggtatcagcagaaaccagggcaacgacccctaaactcctgatctatgctgccgtccagtctgcaaaggtgggtccatcaaggtcagtgcgagtgatcgtggacagtatttcactctcaccactcagcatcgtcgaccaaccgtagaagttacttttgacttaaccttacttcctagtacaaactacgtaagttactaacttacctacccgttaactaccgttttacggaccgtaacggggaccacggtaccgtcggaacgacgttaccgaagggtaccgaacggttcggtacggtcgtcggtaccaccgttaccg

SEQ ID NO: 30435 - DNA, 551 bp, Homo sapiens
  misc_feature: GYAE6OF02I58EX.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaaactcctgatctatgctgcgtccagtctgcaaagtggggtccatcaaggttcagtggcagtggatcgtgggacagatttcactctcaccatcagcagtctagcaacctgaacgtattttgactaactttacttctgtacaactacagttaacaattccttacccgttaactacctttttcggacccgtacggggacccaacggtccgtagggacgtaacgttccgaacgggtaccgtaaacgttcggttacgggcctacggtaccacccgttaacg

SEQ ID NO: 30436 - DNA, 514 bp, Homo sapiens
  misc_feature: GYAE6OF02F59JE.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaactcctgatctatgctgcgtccagtctgcaaagtgggtcccatcaaggttcagtggcagtggatcgtgggacagtatttcactctcaccatcagcagtctgacaacctgaagtattttgactaaattacttctatactaacactagttacaacttcctacccgttactacgttttgaccgtacgggaccaacggtcgtggagtacgtcgaggcgaacgtggtcggcgtcgacacctacg

SEQ ID NO: 30437 - DNA, 515 bp, Homo sapiens
  misc_feature: GYAE6OF02I2MI1.33.65.F10.1.454.CMB.1.raw
  modified_base (387)..(387): a, c, t, g, unknown or other
  misc_feature (387)..(387): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaagcccctaaactcctgatctatgctgcgtccagtctgcaaagtggggtccatcaaggttcagtggcagtggatcgtgggacagatttcactctcaccatcagcagtctgcaacctgaagtnttttgactaacttacttctgtacaacactagttacaactcctacccgtacttacgtttacggcctaggggaccaagtcgtagggagacgtcgacggcgtaacgttggtacggtctcggaccacctacg

SEQ ID NO: 30438 - DNA, 538 bp, Homo sapiens
  misc_feature: GYAE6OF02FQQS2.33.65.F10.1.454.CMB.1.raw
  modified_base (363)..(363): a, c, t, g, unknown or other
  misc_feature (363)..(363): n is a, c, g, or t
  modified_base (470)..(470): a, c, t, g, unknown or other
  misc_feature (470)..(470): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcttctgtcggagacagagtcaccatcacttgccaggcgagtgaggacattcggaaatttttaaatggtttcagcagaaaccaggaaagcccctagactcctgattcacgaggcatccaattcggaaatacggggtcccaaggaaggttcaggtggaggtggagcgtgggacagtacttttacccncaccatcagcagcctgcagcctgaagatcttgacaactatatactgacaactagtaataataactcctaccgtatactttcggaccgaaggggaccaaggctagganactacgaacgtactggtacgcttaggacctacctagttccttgtccttacacgtttccctcccgtacc

SEQ ID NO: 30439 - DNA, 501 bp, Homo sapiens
  misc_feature: GYAE6OF02IRJ4F.33.65.F10.1.454.CMB.1.raw
  modified_base (301)..(301): a, c, t, g, unknown or other
  misc_feature (301)..(301): n is a, c, g, or t
  modified_base (344)..(344): a, c, t, g, unknown or other
  misc_feature (344)..(344): n is a, c, g, or t
  modified_base (390)..(390): a, c, t, g, unknown or other
  misc_feature (390)..(390): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctcctgtctgcatctgtcggagacagagtcaccatctcttgccgggcaagtcagagcatcgtccgctatttaaattggtatcagcagaaaccagggacaagcccctaaactcctgatctatgctgcgtcagtcngacaagtgggtccatcaagtcagtggcagtgatctgggacagntttcactctcaccatcagcagtctgacaaccgtgaacgtattttanactaacttacttctagtcaacactagttacaattcctaccgtactacgtttcgcgagggaccagcgtggactagtcgacggcgtaacgtcgtacggctcggtacacctacg

SEQ ID NO: 30440 - DNA, 558 bp, Homo sapiens
  misc_feature: GYAE6OF02F7G9T.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccggcaagtcagagcatcgtccgcttatttaaattggtatcagcagaaaccagggcaagcccctaaactcctgatctatgctgcgtcagtctgacaaagtgggtcccatcaaggttcagtggcagtggatcgtgggacagtatttcactctacaccatcacgcagtctcgaccaacctagtaagtattttacgactaacctttacttctagtacctaacaacctagtttaacctaacttcctacccttaacttaccgttttcggacccgtacggggtaccaacggtaccgtaggacgacgtaccgaagggtaccgtaacgtcggtacggtactacggacctaccgtacg

SEQ ID NO: 30441 - DNA, 634 bp, Homo sapiens
  misc_feature: GYAE6OF02HIIJ8.33.65.F10.1.454.CMB.1.raw
  modified_base (215)..(215): a, c, t, g, unknown or other
  misc_feature (215)..(215): n is a, c, g, or t
tcagtacacacactcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccggnaagtcagagcatcgtccgcttaatttaaagttggtatcagcaagaaaccgagggacaacgacccctaaactcctagactctatcgctcgcgtccagtctgactaaggtcgggtacccagtaccgtaaggttccgaggtcggacgtaggtaggtacgttacgtagggtaactaggttactttcacgttcctaccacctatacacgactacgtctacgtaccgtaacgtagtaagtttacgtttacgaccttaaacctttcttacctagttaaccaaacttactaacgttaactaacttacccttacccgttaacgttccgtttacgggacccggtaaccgggtaccgtacggtaccggtaggtacgtacgtaccggaacggtacgtacggtggtcggtaccgtacgacccgtacgtaccg

SEQ ID NO: 30442 - DNA, 548 bp, Homo sapiens
  misc_feature: GYAE6OF02IZNE3.33.65.F10.1.454.CMB.1.raw
  modified_base (214)..(214): a, c, t, g, unknown or other
  misc_feature (214)..(214): n is a, c, g, or t
  modified_base (250)..(250): a, c, t, g, unknown or other
  misc_feature (250)..(250): n is a, c, g, or t
  modified_base (507)..(507): a, c, t, g, unknown or other
  misc_feature (507)..(507): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccacctccctgtcctgcatctgtcggagacagagtcaccatctcttgccggnaagtcagagcatcgtccgctatttaaattgtatcancagaaacagggacaacgcccctaaaactcctagactctatgctgccgtccagttctgactaaaggtcgggtacccagtccgaaaggtttcaggtggacgtagtaggactcgtagggactagtactttcgactctactacatcagctacgtctagacctaactagtaagtattttcgacttaactttacttctagtacaactacagttaacactcttacctacttacgtttcgaccgtacggactacgtacgtagganacgtaccgagacgtaactggtacgacgtcgaccacgtaacg

SEQ ID NO: 30443 - DNA, 523 bp, Homo sapiens
  misc_feature: GYAE6OF02IEVIF.33.65.F10.1.454.CMB.1.raw
  modified_base (190)..(190): a, c, t, g, unknown or other
  misc_feature (190)..(190): n is a, c, g, or t
  modified_base (514)..(514): a, c, t, g, unknown or other
  misc_feature (514)..(514): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcgganacagagtcaccatctcttgccgggcaagtcagagcatcgtcgctatttaaattggtatcagcagaaaccagggcaacgcccctaaaactcctgatctatgctgcgtccagtctgcaaagtggggtccatcaagttcagtggcagtggatcgtggacagtatttcacttctcaccatcagcagtctcgacacctagaagttattttgactaacttacttctgtacaacactatttacaattacctacccgttaactacgttttcggaccgtagggacctaacgtcgtaacgggagagtcgaggaccgtacgtcggtacggcgtcnccgactacg

SEQ ID NO: 30444 - DNA, 597 bp, Homo sapiens
  misc_feature: GYAE6OF02IPVJK.33.65.F10.1.454.CMB.1.raw
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccaccctccctgtctgcatctgtcgganacagagtcacatctctgccggnaagtcagagcatcgtcgctatttaaatggtatcagcagaaacaggacaacgaccctaaactcctagatctatgctgccgtcctagtctacgacgtaaggttcggggtccctagtcgtaacggttctaaggtcggacgtaaggtggtaactcgtagggactaggtactttaccactaccgtacactactacgacgtactacgttctcgacctaacgtagtaagttattttacgaccttaacttcttactacgtacaaactactaacgttactaacttcccgttaccgttaccttacgtttacgaccgtaacgggtacctagtacgttacgggacgtatccggtaacggtcgtaacgttcggtaccggtcgtacgaccacgttacg

SEQ ID NO: 30445 - DNA, 656 bp, Homo sapiens
  misc_feature: GYAE6OF02JHY6E.33.65.F10.1.454.CMB.1.raw
  modified_base (206)..(206): a, c, t, g, unknown or other
  misc_feature (206)..(206): n is a, c, g, or t
tcagtacacacactcacgaccggtgctcgatttagctacgctctaagggggagtcagtctcagtcaggacacagcatggacatgagggtccccgctcagctccttgggctcctgctactctggctccgaggtgccagatgtgacatccagatgacccagtcctcccaccctccctgtctgcatctgtcggagacagatcacatctnttcgccggacaagtcagagcagtccgtcgcttattaattggtatcagcaagaaacgacgggacaacgaccctaaacctcctacatctatgctagcgtccagtctgacgtaacggtcggggtacccagtacgtaacggttacgtaggtggaccgtaggtacggtacgtacgtaggggtacctaaggtacgttttaccaacgtttcctaccgtaacccgtacttacgaacggtctacggttactaccgtactaaccgtagtaaacgttagttttacgtaaccttaaccgtttacctttacgtacgttaccgtaaacctaactaacgtttaactaacttaccgttaccctaacgttaccgttttacggaccggtaacgggtaccgaaggttaccgtaaggtacgtacgtaccgacggtacgacgttggtaccgtcgtacgtccgtaacgttcg

SEQ ID NO: 30446 - DNA, 601 bp, Homo sapiens
  misc_feature: GYAE6OF02IOYPS.33.65.F10.1.454.CMB.1.raw
  modified_base (313)..(313): a, c, t, g, unknown or other
  misc_feature (313)..(313): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgcccggcaagtcagagcatccgtccgcttatttaaattggtatcagcaagaacccagggacaacgacccctaaactccctagatctatgctgccgtcagtttcgnagaggccgggtcccatcgaagttcagtggacaggtggatcgtgggactaggtactttccacgttcctaccgacctactccgaagacctaacgttcctaggtacctaaacggtgtaaacgttgttttacgaccttaaaccttaccttaactgtaaccgtaaacaggtacgtaacaaccaaacctacccctaattacctaaccgtttccggccctagggaccctacgtacggttacggaactcgtaccctaaacggtacttcggtaggaccctagacccctaacgtaccg

SEQ ID NO: 30447 - DNA, 757 bp, Homo sapiens
  misc_feature: GYAE6OF02H0N4F.33.65.F10.1.454.CMB.1.raw
  modified_base (259)..(259): a, c, t, g, unknown or other
  misc_feature (259)..(259): n is a, c, g, or t
tcagtacacacactcacgaccggtgctcgatttagctacgctctaaggggagtcagtctcagtcaggacacagcatggacatgagggtccccgctcagctcctggggctcctgctactctggctccgaggtgccagatgtgacatccagatgacccagtctccaccctcctgtctgcatctgtcggagacagagtcacatctcttgccgggcaagtcagagcatcgtccgcttatttaaatggtatcagcagaaaccgnggacaacgacccctaaactcctgatctatgctgcgtctagtctagacgtaaggtcgggtacccaagttaccgaaggttcgaaggtcggactaggtacggacgttccgtagggtaacctaaggttacttttacccgaccgtaccgtttaccaaccctaacgttccaacggtcaacgttcgtaccgaccgtaaacccgtttggaaacgtttacgtttttaccggtaaccgtttaaaccttttaacccgttttacctttaccggttaacctaaaccgttaaaccgtttaacgttttaaaacccgtaaccgttttacccctttaaccccggtttaaacccgtttaccggttttttaccccgggaacccgggttaaccgggggtaacccgtaaacgggtccgttaacggggtaacgttaaccggttaaccggtaaccggggtaacccgttaacggttacgggttaccggtccgtttaaccgggtacccctaacccgttaaccg

SEQ ID NO: 30448 - DNA, 544 bp, Homo sapiens
  misc_feature: GYAE6OF02H4XD4.33.65.F10.1.454.CMB.1.raw
  modified_base (215)..(215): a, c, t, g, unknown or other
  misc_feature (215)..(215): n is a, c, g, or t
  modified_base (233)..(233): a, c, t, g, unknown or other
  misc_feature (233)..(233): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggnaagtcagagcatcgtccncttatttaaattggtatcagacagaaaccagggacaacgacccctaaatccctgattctatgctgcgtcagtctagacgaaaggtgggtacccagtcgtaagtcgagtggcgagtggatcgtagggactagtattcactctacaccatcagcagtcagtacaacctagaagttattttcgactaacttacttctgtacaaaccaactagtaactaactccttaccgttactacgtttacggaccgtaacgggaccaaggccgtaaggaagtcgtacgaggacgtaacgtggtcggtactggacctactacg

SEQ ID NO: 30449 - DNA, 512 bp, Homo sapiens
  misc_feature: GYAE6OF02FKAWY.33.65.F10.1.454.CMB.1.raw
  modified_base (223)..(223): a, c, t, g, unknown or other
  misc_feature (223)..(223): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagngcatcgtcgctatttaaattgtatcagcagaaaccagggcaacgcccctaaactcctgatctatgctgcgtccagtctgacaaagtcgggtccatcaaggttcagtggcagtggatcgtgggacagtatttcactctcacatcagcagtctcgaccaacctgtaagttattttacgactaaccttactttctagtacaacactacgttacaatccttaccgtactacgtttggaccagggaccaagcgtaggatagtacgaggtacgacgtggtcgcgtgaccactacg

SEQ ID NO: 30450 - DNA, 592 bp, Homo sapiens
  misc_feature: GYAE6OF02IPI81.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacgtccagatgacccagtctccatcctccctgtcttcatctgtaggagacagagtcaccatcacttgccgggcaagtgagagcattacgaaccttatttgaattggtatcagcagagacgaggaaacgaccccaaactcctagactctctcgccgctactccgtaatttacacgaacgttcgggtaccagtcgaggttcaggtgctagtggatcgtaggacagtattcactctcacataacgcagtctacggaactagaacgttagtttaggaagtacttacgtttactacgtacaacgtagtaactttaacgtaacgttaacccgttacgttaacgtttacgggaccgtaacggggaacctaagtcgtaggtaagacgtacaacgggactaacgttggtacggtacgtagaccctaaccgtcttacgttacgttaccctcgttaacccg

SEQ ID NO: 30451 - DNA, 690 bp, Homo sapiens
  misc_feature: GYAE6OF02G8S39.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccaccctccctgtctgcatctgtcggagacagagtcaccatctcttgccgggcaagtcagagcatccgtcgcttatttaaattggtatcagcaagaaaccgagggaccaacgacccctaaacctcctgatctatgctgccgtcctagtctgacgtaaaggtcggggtaccctagtacgtaacggttcgaggtcggacgtaggtaggtacgtacggtacgggaactaggtacttttccgacccgttactacccaacctacttacgacgtaccgtagttcgtacggaacctaaacccgttaagtaaacggttactttttacgacccttaaaccgttttacctttacgttaccgttaactaaacccgtaacgttaacgtttaaccaactttcccgttaaccccggttactttaaccgttttaccgggacccgtaaccgggggtaaccctaacggtaccggtaacggtaacggtaacgtacggtacggtaacgtaacggttcggtacggtccgtacgtacccgtactaccg

SEQ ID NO: 30452 - DNA, 604 bp, Homo sapiens
  misc_feature: GYAE6OF02HSPW3.33.65.F10.1.454.CMB.1.raw
  modified_base (225)..(225): a, c, t, g, unknown or other
  misc_feature (225)..(225): n is a, c, g, or t
  modified_base (275)..(275): a, c, t, g, unknown or other
  misc_feature (275)..(275): n is a, c, g, or t
  modified_base (309)..(309): a, c, t, g, unknown or other
  misc_feature (309)..(309): n is a, c, g, or t
tcagtacacacactcacgaccggtgctcgatttagctacgctctaaaggggggagtcagtctcagtcaggacacagcatggacatgagggtccccgctcagctcctggggctcctgctactctggctccggaggtgccaggtatgtgactatccagatgacccagtctcaaccctcctgtctgctatcgtggtcggagacagacgtcgaccatctcttgccgggnaagcagacgcatcgtccacttaatttaaattggtatcagcaagaaaccgnggaccaacgaccctaaactcctaggacttctagngctcgcgtccagtcgtgtacgtaaaggtcgggtaccagttacgaagttcagtggacaggttcggatcgaggacaggtctttcacttctactacctatacgagactacgtactacgactaaccgtagtaacgttacttttacgacttaacttacttactacgttacaactaacgtacttactaacttacctaccgttaaccttacgtttacggtaccgtaacgggacctaacggtacgtagggtacgtacggtacgtaggtacgtacgtcggtacggtcgtacgtaccgacgtacg

SEQ ID NO: 30453 - DNA, 535 bp, Homo sapiens
  misc_feature: GYAE6OF02HBPRV.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatcctcttgccgggcaaggtcagagcatcgtcgctattaatgtatcagcagaacagggcaagcccctaaactcctagatctatgctcgcgtccagtctgacaaggtcgggtaccatcgaagtcagtgctagtgatcgtggactagtatttcacgtctacgactatcacgctagtctagacctaacgtagaagttactttcgacttaacttcttctagtacaactactacgttaactacttaccgttaccctacgttactttcggaccgtagggtaccaaggtcgtaggactacgtcgaacggacgtaacgtcggtacgcgtcgactaccgtacg

SEQ ID NO: 30454 - DNA, 531 bp, Homo sapiens
  misc_feature: GYAE6OF02F1JM5.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattggtatcagcagaaaccagggcaacgcccctaaactcctgatctatgctgcgtccagtctgacaaagtcgggtccatcaagttcagtggctaggtggatcgtgggacagtatttcacttcctacaccatcagactagtctgaccaacctagtaacgtattttgactaactttacttctgtacaacactagttacattcctaccgtactacgttttcggaccgacgggacctacggcgtaggagtacgtacgacggtacgaacgttggtccggtcgtcgactaccgtac

SEQ ID NO: 30455 - DNA, 627 bp, Homo sapiens
  misc_feature: GYAE6OF02HYB10.33.65.F10.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagtacacacactcacgaccggtgctcgatttagctacgctctaagggggagttcgagtctcagtcaggacacagcatggacatgagggtccccgctcagctcctggggctcctgctactctggctccgaggtgccagatgtgacatccagatgacccagtctcccacctccctgtctgcatctgtccggagcagntcaccntctctgccggcaacgccagcgcactcgtccgcttaatttaattggtatcagctaacgaaacgaggacaacgtcccctaaaactcctgtaacttcgtagtcgactgccgtcctagtctcggactaaagggtcggggtaccagtacgaaggttcgtaaggtcggactaggttacggagtcgtagggaacaggttactttccgacttcctacaccgtacgtccgacgtctacgtctcgacctaacgtagtaagttactttacgactaacctttactacgtactaccaactaacgtattaacctacgttcccgtaccgttacgttactttggaccgtaacgggtacctaacggtcggttacggtaacgtactaccgggacggtaaccgtacgggttcggtacggtacgtacgtacctaaccggttacg

SEQ ID NO: 30456 - DNA, 666 bp, Homo sapiens
  misc_feature: GYAE6OF02IJT1S.33.65.F10.1.454.CMB.1.raw
  modified_base (191)..(191): a, c, t, g, unknown or other
  misc_feature (191)..(191): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctcccaccctcctgtctgcatctgtcgganacagagtcacatctctgcggcaagtcagagcatccgtccgcttaatttaaattggtaatccgagcaacgaaacgagggacaacgacccctaactcctagacttctagtcgtctgtccgtacctacgtactaacgtaaacgggtccgggtaccctatacgtaacggttcaggtcggacgtaggtcggtagtcggtaggaacgtagttaactttccactctacctactactcgagcgtacgtacgtacgacctaaccgtagtaagttacgttttacgtaccttaacctttaccgtttacgttaaccgtacctaaacgtaaccttaaactttaaccgtaacccgttacccgtttaacccgttaacctttaccggttttaccgggaaccggtaaccggggtaaccacggtacggtacggaagtaacggtacgtaacggtacgtaacgttcggtacggtccgtacgactacctagttacc

SEQ ID NO: 30457 - DNA, 771 bp, Homo sapiens
  misc_feature: GYAE6OF02IPTMZ.33.65.F10.1.454.CMB.1.raw
  modified_base (214)..(214): a, c, t, g, unknown or other
  misc_feature (214)..(214): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctccaccctcctgtctgcatctgtcggagacagatcacatctcttgccgganaagtcagtgacagtccgtccgacttaatttaaaagttggtaatcgaagacaaacggaaaccgagggaccaaacgtacccccttaaaactcccgtagacttactagtcgctacgccgtacgagttccgtagacgtaaagggtccgggtaccccaagttaccgaaaggttccaagggtcggtaccgtaagggttacggtaacttcgggtagggtaaacctagttaccttttaccgaaccgtttcccgtaaccaacccgtaactaccgaagtaccgtaagttcctacggaacccttaaaccgtaggttaaacgtttacgttttaccgaaacctttaaaccttttaccgttaactaccggttaaactaaacccgttaagttaaaccgttaaccgttaaaccgtttcccgttaaccccgtttaacgtttaccgttttaacgggacccggttaaacggggacccctaaagggtccggttaaacggtaaccggtaacgttcccggaaacggtacccgttaaacggtcgggttaccggaccgttacggaacccgttaccgttacg

SEQ ID NO: 30458 - DNA, 661 bp, Homo sapiens
  misc_feature: GYAE6OF02GA43M.33.65.F10.1.454.CMB.1.raw
  modified_base (232)..(232): a, c, t, g, unknown or other
  misc_feature (232)..(232): n is a, c, g, or t
  modified_base (262)..(262): a, c, t, g, unknown or other
  misc_feature (262)..(262): n is a, c, g, or t
  modified_base (433)..(433): a, c, t, g, unknown or other
  misc_feature (433)..(433): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccaccctccctgtctgcatctgtcggagacagagtcaccatctctgccggacaagtcagagcatcgtcncttaatttaatgtatcagacaacgaaaccngggaccaacgtacccctaaatccctgactctatcgctgccgtccagttctagacgtaaaggtccgggtaccccagtaccgtaaaggttccgaaggtcggactaggtaggaacttcgtaggggaacctaaggttacttttaccaacttcccgtacctaaccgtactacgacncgtacgttccgtacgacctaaaccgtagttaaagttacgtttacgtaaccttaactttaccttacgtacgtaactaaacctactaaccgttaacacttacccgtaaccgttaaccgttacgtttaccggaccgtaagggtacccgtaaggtaccggtaacggaggtaaccgtaccgtaacggtaccgtaacgttcggtacgggtaccgtacggacctaacccgttacg

SEQ ID NO: 30459 - DNA, 558 bp, Homo sapiens
  misc_feature: GYAE6OF02FWE2R.33.65.F10.1.454.CMB.1.raw
  modified_base (215)..(215): a, c, t, g, unknown or other
  misc_feature (215)..(215): n is a, c, g, or t
  modified_base (234)..(234): a, c, t, g, unknown or other
  misc_feature (234)..(234): n is a, c, g, or t
  modified_base (263)..(263): a, c, t, g, unknown or other
  misc_feature (263)..(263): n is a, c, g, or t
  modified_base (400)..(400): a, c, t, g, unknown or other
  misc_feature (400)..(400): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctcccaccctccctgtctgcatctgtcggagacagagtcaccatctcttgccggnaagtcagagcatccgtccncttaatttaatggtatcagcaagaaaccnggacaacgacccctaaatcctgactctatcgctgctccagtcagactaaaggtcggtacccagtacgtaaggttcaggtggacgtaggtggatcggtaggactagtacttccacttctaccaccatacagctagtcncacctaactagtaagttatttacgaccttaactttctctagtaccaatactagttaacacttcctaccgtacttcgtttacggaccgtacggacctaggtcgtggactagtaccgaggtaccgtaacgtcgggtacgacctacggtacctacgtaccg

SEQ ID NO: 30460 - DNA, 698 bp, Homo sapiens
  misc_feature: GYAE6OF02H0ZJB.33.65.F10.1.454.CMB.1.raw
  modified_base (193)..(193): a, c, t, g, unknown or other
  misc_feature (193)..(193): n is a, c, g, or t
tcagtacacacactcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtcctcccaccctccctgtctgcatctgtcgganacagagtcacatctcttcgccgggacaagtcagagcagtccgtccgtacttaatttaaagttggtatcgacgcgaacgaaaccgagggacaaccgtacccctaaactcctagtatctatcgtcctcgccgtccgtagttccgtgacgtaaacggtcggggtaccctagttaccgtaacgggttctaggtcggacgtagtacgggtacttcggtagggaactaagttactttaccgtaccttacctacctaacctactacgacgtaccgtacgtcctacgacctaaccgttagtaacgttacgttttacgtaccttaacctttacgttactacgttaacaacgtaactaacgtttaacctaacgtaccccgttacccgttaaccgtttaccggttttacggaaccgggtaacgggtacccgaacggtacggtaggtaacgtacgttaccggaacggtaccggtaacggttcggtacccgggtacccgaccgtacccgtattacccg

SEQ ID NO: 30461 - DNA, 594 bp, Homo sapiens
  misc_feature: GYAE6OF02GB8AG.33.65.F10.1.454.CMB.1.raw
  modified_base (219)..(219): a, c, t, g, unknown or other
  misc_feature (219)..(219): n is a, c, g, or t
  modified_base (383)..(383): a, c, t, g, unknown or other
  misc_feature (383)..(383): n is a, c, g, or t
  modified_base (395)..(395): a, c, t, g, unknown or other
  misc_feature (395)..(395): n is a, c, g, or t
tcagtacacacactcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctcccaccctccctgtctgcatctgtcggagacagagtcaccatcctcttgccggganaagtcagagcatcgtccgctatttaaattggtatcagcaagaaaccaggacaacgacccctaaactccctgatctatcgctgcgtccagtctgacaaggtcgggtcccatacaaggttcaggtcggacgagtaggatcgtagggacagtatttcactctcaccntcagcatcgtanacctaacctgtaaacgttatttacgacttaacttaccttctacgtaccaaacctaacttaacgttaacctaacttccgttaccccgttaacttacccggttttaggaccgtaacggggtacctaacggtcgttagggaacgtacgtacgaacgggtaccgtaacgttcgggttaggtccgtacgtaccgtacccttacg

SEQ ID NO: 30462 - DNA, 539 bp, Homo sapiens
  misc_feature: GYAE6OF02FLPPR.33.65.F10.1.454.CMB.1.raw
  modified_base (222)..(222): a, c, t, g, unknown or other
  misc_feature (222)..(222): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccggcaagtcagngcatcgccgctattaaattggtatcagcaagaaaccatggacaacgcccctaaactcctgatctatgctgcgtccagtctgacaaaggtcggggtcccagtcgaaaggttcgaggtggcgaggtggacgtcgtgggaacagtactttcactctacaccaatcagcagtcagcaactagtaacgtntttanacctaacttcttctcgtacaactactagttaacaacttcctacccttactacgtttacggcctacgggacctaagcgtaggaacgtacgtacgacggtacggtactaggtcggacctggactacccg

SEQ ID NO: 30463 - DNA, 629 bp, Homo sapiens
  misc_feature: GYAE6OF02GZHUS.33.65.F10.1.454.CMB.1.raw
  modified_base (229)..(229): a, c, t, g, unknown or other
  misc_feature (229)..(229): n is a, c, g, or t
tcagtacacacactcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtcctcccaccctccctgtctgcatctgtcggagacagagtcaccatcctctcggccgggacaagtcagngcagtccgtccgattaatttaaattggtatcgagacaacgaaaccgagggaccaacgacccccttaaactccgtgactctatcgctgccgtcagtctcgacgtaagggtcgggtaccagtacgaaggttcaggtggacgtaggtcggacgttcgtagggactaggttactttccgacgttcctaccgtacctacgtcacgcgtacgttccgtacgtacctaaccgtaggtaacgttagtttacgtaaccttactttcttacgtacgtactaactacgtacgttactaaccgttaccttacccgttaccttacgtttaccggacgtaaccgggtacctacggtcggtaggacgtagtacgacgggaactacggtggtaccggtacgtccgaccgtacgtcg

SEQ ID NO: 30464 - DNA, 579 bp, Homo sapiens
  misc_feature: GYAE6OF02IWR6M.33.65.F10.1.454.CMB.1.raw
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (375)..(375): a, c, t, g, unknown or other
  misc_feature (375)..(375): n is a, c, g, or t
  modified_base (431)..(431): a, c, t, g, unknown or other
  misc_feature (431)..(431): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcacatcactgccgggcaagtcagagcataagcaactattaaattggtatcaaacagaaaccaagggaacgaccctaaggtctgatctatgctgcgtcagttnanagagcggccatacgagttcgagtcgatagtggatcgtgggactagtacttcacttcctactacctatacagacngtacgtgacgtaacgtagaagttatttacgacttaacgttacctagttctaccaanagtacgtacaaccgaaccaccctattacccgtacgtttacccggacccgtacggtaacctacgtaacggttacggtaacgttaccggtacctaaacccggtacgttagggtacggtccgtacgaccctaaccttacggtacccttacg

SEQ ID NO: 30465 - DNA, 788 bp, Homo sapiens
  misc_feature: GYAE6OF02HRJD3.33.65.F10.1.454.CMB.1.raw
  modified_base (194)..(194): a, c, t, g, unknown or other
  misc_feature (194)..(194): n is a, c, g, or t
  modified_base (228)..(228): a, c, t, g, unknown or other
  misc_feature (228)..(228): n is a, c, g, or t
  modified_base (291)..(291): a, c, t, g, unknown or other
  misc_feature (291)..(291): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtggacatccagatcgacccagtcctcccaccctccctgtctgcatctgtcgganacagacgtcaccatcctcttgccggcaagtcagngcatcgtccgcttaatttaaattggtatcagcaagaaaccagggcaacgacccctaaactccngatctatgctcgtccgtcgacgtctagacgtaaaacggtcggggtaccctagttacgtaaacgggttccgaaggttgggaccgtaggttaggtaacgttacgtacggggtaactacggttacgttttaccacctttaccgtacctaacctacgttaccgaacgtccgtaaacggttcctaccggtaacccgtaaacccgttaacggtaaaggtttacctttttaaggtaccctttaaaaccgttttaccgtttacctaaccggttaacctaaaaccgttaaaccgttaaacgttttaaacccttaaaccgtttacccgtttacccccgtttaacgtttaacccggtttttacgggaaccccgggttaacgggggtaacccgttaacgggtaacggttaacggggtaaacgttaccggtaaccggtaaccggggtacccggtttaacggttacgggttacggttaccccggttaacggtaccccgttaacccgttacg

SEQ ID NO: 30466 - DNA, 514 bp, Homo sapiens
  misc_feature: GYAE6OF02IURT5.33.65.F10.1.454.CMB.1.raw
  modified_base (189)..(189): a, c, t, g, unknown or other
  misc_feature (189)..(189): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (477)..(477): a, c, t, g, unknown or other
  misc_feature (477)..(477): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccacctccctgtctgcatctgtcgganacagagtcacatctcttgccgggcaagtcagagcatcgtccgctattaaattggtatcagcagaaaccagggcaacgcccctaaactcctgatctatcgctgcgtccagtcctagacaaaggtcgggtccatcaaggttcagtgcaggtgatcgtgggactaggattttccactctactacccatacancagtcncgctaacctgaagtatttcgactaacttacttctagtacaacactacgttacatcctcctactcgtttacgacgtacgggacaagtcgtgganagtacgacggacgacgtcgtggtactgacctactacg

SEQ ID NO: 30467 - DNA, 701 bp, Homo sapiens
  misc_feature: GYAE6OF02GAG1G.33.65.F10.1.454.CMB.1.raw
  modified_base (674)..(674): a, c, t, g, unknown or other
  misc_feature (674)..(674): n is a, c, g, or t
tcagtacacacactcacgaccggtgctcgatttagctacgctctaaaggggggagtcagtcctcagtcgaggaccacagtcatggacatgagggtccccgctcagctccgtggggctcctgctactctggctccgaggtgccgagtactgtgactattaccagatcgacccagtactccactcctccctgtctgcgatcgtggtaggaggacggacggtcaccatctaccttcggccggactagtcagagactaataagactaaacgttaatttaaagtgtaactacaaacgtaacgaaaaccgaacgggtaaaccgtaccccggtaacggtccgtagactacgtaggtacggtcgtcggtccggtccgttaggtttcgacggaagggacgggccgggtacctaaggttacggtaagggttcgaggtggacgtaggttcggacgtcggtaggaactagttactttaccgacctcctaccgaactacgtaccagtccgtagttcgacgtaacgtacggtaagtaagttactttacgaaccttaactttacgtacttcgaacctaaagtacgtaacgtaacctaacctaaaccctacccgttattaacccgttaccggttaccggaacccgtacgacctagtacggtagacgttacgaacctaacgtgtggtaccnccgttacgacctacgttacgtcttacg

SEQ ID NO: 30468 - DNA, 655 bp, Homo sapiens
  misc_feature: GYAE6OF02HX8WL.33.65.F10.1.454.CMB.1.raw
  modified_base (472)..(472): a, c, t, g, unknown or other
  misc_feature (472)..(472): n is a, c, g, or t
  modified_base (650)..(650): a, c, t, g, unknown or other
  misc_feature (650)..(650): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtccccaccctccctcgtctcgcactctcgtcggacgacagagtcaccactctcttcgtccggcgacgtacagagacagtcgtccgtactaatttaaagtttaggttagtacgtagacgaacgaaaccgacgggacgaacgacccgtaaccctaacctcgtatactacttagtccgtctaccgtcctacgtacgtagtacgtaacggtacgggtccggtacctacgtaacggtacgtaggtacggcgagtaggtagtacgtacggtacgtactacgttactactacctaccacgactacgacgtacgtacgtntacgaccgtaactacggtaattacgttacgtacctaacgtttaacttctacgtaactaactaacgttaacgttaccgtaaactcccgttaccgttaccttaccgggtttacaccgggaaccgacgacgtacggtcgaagcgtacgacggtacgtagtacgtggacctacgcctaccgnttacg

SEQ ID NO: 30469 - DNA, 546 bp, Homo sapiens
  misc_feature: GYAE6OF02F78Z5.33.65.F10.1.454.CMB.1.raw
  modified_base (190)..(190): a, c, t, g, unknown or other
  misc_feature (190)..(190): n is a, c, g, or t
  modified_base (390)..(390): a, c, t, g, unknown or other
  misc_feature (390)..(390): n is a, c, g, or t
tcagtacacacactcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccaccctcctgtctgcatctgtcgganacagagtcaccatctcttgccgggcaagtcagacgcagtccgccgtacttaatttaaacgttggtatcagacaacgaaaccagggacaacgtacccctaaactcctagatctatgctgctaccagtctgacaaggtcgggtccaagtcgaacggttcaggtggacaggtcgatcgtagggactagtatttcactctcacnctcagcatcgtcgactactagtaagtattacactaacttctctactactaacactagttaacaacttccgttaccgtacttacgtttcggacgtacgggactaacgcgtaggtaactactacgaggacgtaacgtggtacggctacgcaccgtacg

SEQ ID NO: 30470 - DNA, 575 bp, Homo sapiens
  misc_feature: GYAE6OF02GAHSB.33.65.F10.1.454.CMB.1.raw
  modified_base (224)..(224): a, c, t, g, unknown or other
  misc_feature (224)..(224): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccacccctccctgtctgcatctgtcggagacagagtcaccatctcttgccgggcaagtcagngcatccgtccgcttatttaaattggtatcagcaagaaaccagggacaacgacccctaaactcctgatctatgctgccgtccagtcagacaaaggtcgggtacccatacgtaaggttcagtggactaggtaggatcgtagggactaagtatttccactctactaccatcacgcagtctcgacaaccgtagtaagttatttacacttaacctttacttactctacaaactactaacgttaactaacttccttacccgttaactaccgtttacggaccgtacgggaccaagtaccgtaggaacgtacgtacgaacggacgtacgttcggtacggtccgtacgacctacgtaccg

SEQ ID NO: 30471 - DNA, 567 bp, Homo sapiens
  misc_feature: GYAE6OF02IXTRA.33.65.F10.1.454.CMB.1.raw
  modified_base (223)..(223): a, c, t, g, unknown or other
  misc_feature (223)..(223): n is a, c, g, or t
  modified_base (234)..(234): a, c, t, g, unknown or other
  misc_feature (234)..(234): n is a, c, g, or t
  modified_base (366)..(366): a, c, t, g, unknown or other
  misc_feature (366)..(366): n is a, c, g, or t
  modified_base (393)..(393): a, c, t, g, unknown or other
  misc_feature (393)..(393): n is a, c, g, or t
  modified_base (405)..(405): a, c, t, g, unknown or other
  misc_feature (405)..(405): n is a, c, g, or t
  modified_base (520)..(520): a, c, t, g, unknown or other
  misc_feature (520)..(520): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatggtgacatccagatgacccagtctccaccctccctgtctgcatctgtcggagacagagtcacatctcttgccgggcaagtcagngcatccgtccncttaatttaaagttggtatcacgacaacgaaacccaggggacaacggaccccttaaaactccgtgatctatgctcgccgtcagtctgactaaaggtcgggtaccatctaaggtcaggtgctaggtgattcgnggactagtactttcactctaccactancacgtcagtctntacaacctgtaacgtatttcgtacttacttaccttactgtactaactactacgttaacaacttacctaccgtttactacgtttcgaccgtacgggaccgaacggtcgtagggtanacgttaaggacggtacgtacgttcgtgggtactcgtacgaccttacg

SEQ ID NO: 30472 - DNA, 575 bp, Homo sapiens
  misc_feature: GYAE6OF02HE3KP.33.65.F10.1.454.CMB.1.raw
  modified_base (389)..(389): a, c, t, g, unknown or other
  misc_feature (389)..(389): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtcctgcatctgtcggagacagagtcaccatctcttgccgggcaagtcagagcatcgtccgctatttaaattggtatcagcaagaaaccagggacaaacgacccctaaactcctagatctatgctgcgtccagtctgctaaagtcgggtccatcgaagttcagtggactagtggatcgtaggatagtatttcactctcacctatcagtcacgttcncgactaaccgtagtaaagttattttacgaccttaaactttaccgtttctacgttaccgaaaccttacgtaacgtttaaccaacgttccctaccgttaccttacgttttcggacccgtaacggggacctaaggtccgtaggacgtataccgtaggaccgaacttgggtcgacttcgaccctactacg

SEQ ID NO: 30473 - DNA, 522 bp, Homo sapiens
  misc_feature: GYAE6OF02F6MV0.33.65.F10.1.454.CMB.1.raw
  modified_base (215)..(215): a, c, t, g, unknown or other
  misc_feature (215)..(215): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgcccggnaagtcagagcatccgccgctatttaaattggtatcagcagaaaccagggcaagcccctaaactcctgatctatgctgcgtccagtctgacaaaggtgggtcccatcgaaggttcagtggcagtggatcgtagggacagtatttcacttctacaccatcagcagtctacgacaaccgtgaagtattttcgactaacttacttctacgtcaaacactagttacaacttctaccgttaactccgtttaggaccgtagggaccaagtcgtaggagactacgacgtcgaacgttgtacgctcgaccacgtac

SEQ ID NO: 30474 - DNA, 626 bp, Homo sapiens
  misc_feature: GYAE6OF02GQ8AP.33.65.F10.1.454.CMB.1.raw
  modified_base (241)..(241): a, c, t, g, unknown or other
  misc_feature (241)..(241): n is a, c, g, or t
tcagtacacacactcacgaccggtgctcgatttagctacgctctaagggggagtcagtctcagtcaggacacagcatggacatgagggtcccccgctcagctcctggggctcctgctactctggctccgaggtgccagatgtgacatccagatgacccagtctcccaccctccctgtctgcatctggtcggagacagagtccaccatctcttcggccgggcaagtcagagcatccgtccgnttaatttaaattggtatcagacaacgaaaccgagggcaaccgacccctaaactccgtgtatctatgcgtcgccgtccagtctgacgaagggtcgggtaccatcgtaaggttccaggtcggacgtaggtaggtacgttcggtagggactacggttactttccgtacctcctaccaaccctagtaccaacggacctacgttcgtacggtaacgtaacggtaggttaacttagtttacgacctttaacttacttactacggtaccaaacgtggaaccgtaccaacccaaccctaccctactttacctaccgttccgacccgtacggtaccacggtaggttacgacgttacgtaacccgacgtacgcggttagccgtacacctacgtcc

SEQ ID NO: 30475 - DNA, 599 bp, Homo sapiens
  misc_feature: GYAE6OF02HF0VV.33.65.F10.1.454.CMB.1.raw
  modified_base (224)..(224): a, c, t, g, unknown or other
  misc_feature (224)..(224): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctcccaccctccctgtctgcatctgtcggagacagagtcaccatctcttgccgggcaagtcagngcatcgtccgcttatttaaagttggtatcagacagaaaccgagggacaacgaccccctaaaactccctagactactatgctcgctccagtctgacgaaaggtcgggtacccatcgaaggttcaggtggacagtcggatcgtgggactagtacttcactctctaccatcaagcagtctcgacctaactaggaattacttttacgactaaaccgtttcttactacgttacaactacttaacgttaactaccttccttaccccgttaacgttaccttttcggggacccgtaacggggacccgaaggttaccggtaaggtaaccgtcgtaacggtacgggacgtaacggttggttacggcgtttacgccgtaccttacg

SEQ ID NO: 30476 - DNA, 673 bp, Homo sapiens
  misc_feature: GYAE6OF02I3Q16.33.65.F10.1.454.CMB.1.raw
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
  modified_base (476)..(476): a, c, t, g, unknown or other
  misc_feature (476)..(476): n is a, c, g, or t
tcagtacacacactcacgaccggtgctcgatttagctacgctctaagggggagtcagtctcagtcaggacacagcatggacatgagggtccccgctcagctccgtggggctcctgctactctggctccgaggtcgccagatgtgacatccagatcgacccagtcctccaccctccctgtctgcatctgtcgganacagatccacatctcgtgccggcaagtcagngcagtccgtccgtacttaagtttaaacgtggtactacgagtacaaacggaaaccgagggtaccaaaccgtacccctaaactccgtagaacttcagttcggctcggaccgttccaagttccgagtaacgtaacgggttccgggtacccaagttacggtaaacgggttcaagggttcggaccgttaggtcgtaacgtcggtagggaacctgttaccgtttaccacctctacactacacgacgtcgtacgtacncacgtaacgtagtacgttactttacgaccttacttaaccgttctacgtaaccaacgttaacgtaacgttaaccgtaactttcccgtaccgttaccgttaccgtttaccgggaacgtaccgggactaacggtacgtaacggaactgtaaccgaggtaccgtaacggttcggtacggtacgtacgtacctacgttaccg

SEQ ID NO: 30477 - DNA, 720 bp, Homo sapiens
  misc_feature: GYAE6OF02FTL2U.33.65.F10.1.454.CMB.1.raw
  modified_base (316)..(316): a, c, t, g, unknown or other
  misc_feature (316)..(316): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctcccaccctccctgtctgcatctgtcggagacagagtcaccatctcgttggccggacaagtcagagcatcgtccgacttaatttaaagttggtatcagtacaacgaaacccgagggaccaaccgaccccttaaactcctagacttcgtatcgtcncggtcctccagttctaggacgtaaaggggtccgggtaccaagttacgtaaggttcagggtcggacgtaggtaggattccggtaagggtactaggttacttttaccacttccgtacaccctatacgaacgtcacgttccgtacgaaccctaacccgttaagttaacgtttacgttttacgaaccctttaacgttttaccgtttacgttaacgttacccttaaaccgttaaacgttaaaccgttttaacctaaaccgtttccccgtttaaacccgttaacttttaccggttttacgggacccgtaaacggggtaccctaggtaccggttaagggtaaccgtacgtacccggttaacggtaaccgttacggttacgggtccggacttaccggacccttacgttaccg

SEQ ID NO: 30478 - DNA, 701 bp, Homo sapiens
  misc_feature: GYAE6OF02F4A4M.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccaccctccctgtctgcatctgtcggagacagagtcaccatctcttgccgggcaagtcagagcatcgtccgctatttaagttgtatcaacagaaccagggacaacgacccctaaactcctagactctatcgctgcgtccagtctgacgtaaaggtcggggtacccagtacgtaaggttcaggtcggactaggtacggtattaccggtaggggaactaggtaactttaccgacctttacctaccgaaccctaacgtccgaaggtaccgtacggtttaccgtacggtacccgtaaacccgttaggaaacgtttacgtttttaacggacccttttaaaccgtttaccttttcgttaccggttaacctaaacctaaccgttaacgtttaacctaactttccccgttaaccccgtttaactttaacccggttttaccgggaccgtaaaccgggggtaaccctagggtcccgtagggtaacgtaacgtacggaaccgggtacgtaaccggtaggtccggtactcggacccctacgtcttaccgg

SEQ ID NO: 30479 - DNA, 654 bp, Homo sapiens
  misc_feature: GYAE6OF02ID7J1.33.65.F10.1.454.CMB.1.raw
  modified_base (193)..(193): a, c, t, g, unknown or other
  misc_feature (193)..(193): n is a, c, g, or t
  modified_base (252)..(252): a, c, t, g, unknown or other
  misc_feature (252)..(252): n is a, c, g, or t
tcagtacacacactcacgaccggtgctcgatttagctacgctctaagggggagtcagtctcagtcaggacacagcatggacatgagggtccccgctcagctcctggggctcctgctactctggctccagataccaccggggaaattgtgttgacacagtctccggccaccctgtctttgtctccgaggggaanagccaccctctcctgcagggccagtcagagttgttagcgggtactagcctggtaccaanagacgaccgtggccaggcctccaggctccctcttactatacgatgctactcccaaacgacgggacctacgtcggacctacgtccccagaccgtagggttaccaggtgggtcgggttgggtacgtggggacacggtacttccactcgtacgacctatcgacgcacggtcctaggacgtctaaggtaagttagttttacgacgttagttttacttacgttcgtagtagtaccgtagtacgtacacgtaagtcggttcgttaggttaccggttaccggaacgtaacgggaaccggttaaaggacggtaaactaaccgtaaacgtacgtacgtacggactcgacctacgtacgttaccgttgttaccttccgtaccgtttacccgtaccctaccttacgttaccgg

SEQ ID NO: 30480 - DNA, 611 bp, Homo sapiens
  misc_feature: GYAE6OF02ISGO8.33.65.F10.1.454.CMB.1.raw
  modified_base (234)..(234): a, c, t, g, unknown or other
  misc_feature (234)..(234): n is a, c, g, or t
  modified_base (290)..(290): a, c, t, g, unknown or other
  misc_feature (290)..(290): n is a, c, g, or t
  modified_base (362)..(362): a, c, t, g, unknown or other
  misc_feature (362)..(362): n is a, c, g, or t
  modified_base (576)..(576): a, c, t, g, unknown or other
  misc_feature (576)..(576): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctcctgtctgcatctgtcggagacagagtcaccatctcttgccgggcaagtcagagcatccgtccgnttattaaattggtatcagcagaaccagggacaacgccctaaactcctagactctangctgccgtcagtctgacgaaggtcgggtcccataccgtaaggttcagggtcggacgtaggtcggtattacgnggggtacaagttactttcgtaaccgttccttaccaacccgtaacgtaccgaagtacgtaacgttcgtacgtacctaaaccggtaagtaagttacgttttacgaccttaacctttactttaccgtacgttactaaaccgttactacggttaactaaccttccttaacccgtttatacgtttcggaccgaacgggtaccaagtcggtaagacgtancgacgtacgtatcggtcgtcgtacgactacgtacg

SEQ ID NO: 30481 - DNA, 868 bp, Homo sapiens
  misc_feature: GYAE6OF02GD4RN.33.65.F10.1.454.CMB.1.raw
tcagtacacacactcacgaccggtgctcgatttagctacgctctaagggggagtcagtctcagtcaggacacagcatggacatgagggtccccgctcagctcctgggctcctgctactctggctccgaggtgccagatgtgacatccagatgacccagtcctccaccctccctgtctgcatctgtcggagacagagtccacctatctcttcgccggacaagtcaagagactatccgtcgtacttaatttaaagttggtatcaagacaagaaaccgagggtaccaacgaccccttaaaacttccgtagtactactaagtcgtactcgaccgtacctagttctagaaccgttaaaggtccggggtcccaaagtacgtaaacggttcaaaggtcggactaagggtacggtacgttcggtaacggggtaacctaaggttacttttacccgaaccttaccttacccgtaaacctacgtacgtaaccgtaccggttaacgttaccgtacgtaaacccgtaaaccggttaacggttaaacggtttaacttttaaccggtaaaccttttaaacccgttttaaccgtttaaccgttaaccgttaaaccctaaaaccggttaaacccgtttaaacggtttaaaccttaaaccgttttacccccgttaaacccgtttaaacccgtttttaaaccggttttttacccggggaacccgggttaaacccggggggttaaacccgtaaacgggttacccgggttaaacggggtaaaccgttaacgggttaacccgggtaaaccggggttaacccggttaaacggttaccggggttaaccggttaacccggttacccggtaacccgttaacccgtttaacccgg

SEQ ID NO: 30482 - DNA, 706 bp, Homo sapiens
  misc_feature: GYAE6OF02HN9TL.33.65.F10.1.454.CMB.1.raw
  modified_base (332)..(332): a, c, t, g, unknown or other
  misc_feature (332)..(332): n is a, c, g, or t
tcagtacacacactcacgaccggtgctcgatttagctacgctctaagggggagtcagtctcagtcaggacacagcatggacatgagggtccccgctcagctcctggggctcctgctactctaggctccgaggtgccagatgtgacatcccagatcgacccagtcctcccacctccctgtctgcatcgtgtcggagacaggagtccaaccattcctcttcggcccgggataacgtcaagacgctactccgtccgatttaatttaaagtggtactcagaccaacggaaaaccgagggaccaaccggtacccctaaactcgtagactacgtaacncggtctcgaccgtccgagtccgtagacgtaaacgggttcggtaccctagtacgtacggttaccgagggtcgtactaggttacggacttcgggtaggactaggttacctttacaccgtttctaccgtaaccctacgtaccgtaacggtctaaccggttacgacgtacctaaccggttagtaaacggtttacgtttacgtactttaaaccgttacctttacgtaccgtaaaccttaaccgtaacgttaccgttaaacctacgtttacccgttacccgttaccgtttaaccgttacgggacccgtacggggactaaggccgtaacggacgttacgaccgtacgaacggttacgcggtagtcgtacgacctacgtacg

SEQ ID NO: 30483 - DNA, 584 bp, Homo sapiens
  misc_feature: GYAE6OF02G72UO.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcggagacagacgtcaccattcctcgttgccgggacaagtcagagcatcgcgtactatttaatgtatcagcaagaaacgaggtacaacgcccctaaactcctagactctagtcgacttcggcctcgagtcctagacgtaaagggttccggggtaccctagttactaacggttccaggtcggactaggtggacgtcgtaggactaggtatttaccaccttcgtaccacctatacgagactacgtctcgactaacgtagtagttagtttcgactaacttactctacgtactaaacgtactactaactacttaccctccgttactacgtttccggacgtacgggacctaaggcgtaagacgtacgtcgaacgtaccgacgttcgtacgcgtacgaccactacg

SEQ ID NO: 30484 - DNA, 667 bp, Homo sapiens
  misc_feature: GYAE6OF02HRMKU.33.65.F10.1.454.CMB.1.raw
  modified_base (499)..(499): a, c, t, g, unknown or other
  misc_feature (499)..(499): n is a, c, g, or t
tcagtacacacactcacgaccggtgctcgatttagctacgctctaagggggagtcagtctcagtcaggacacagcatggacatgagggtccccgttcagctcctggggctcctgctactctggctccgaggtgccagatgtgacatccagactgacccagtcctcccaccctccctgtctgcatctgtcggagacagtagtcaccatcttccgttacggccggataaggtccaaggacgcagttccgtaccgtattaattttaaagttggtactacgagacaacgaaaccgaggaacctaaccgtaccccctaaactccgttatacctcttacgtcgtctcggtcccgtacgtagttcgtacgtacgtaacgggtcggtacccagtacgtaggtcgacggtgactaggtcgtagtcggtaggtactagttctttaccgcttacccgataccctataccgtaagaccgttagtcctacgtaactacctagtaaccgtttnttaacctaacttacctttctactcgtaaactactacgttaactaacctaccttaccgtacccgttacgtttaacggttcgaaccggtaacggactacgggtcgtaacggcgtaacgttacggaacggtacccgtagttcggtaacgtccttacgaccgtatccgttcg

SEQ ID NO: 30485 - DNA, 807 bp, Homo sapiens
  misc_feature: GYAE6OF02I44NB.33.65.F10.1.454.CMB.1.raw
tcagtacacacactcacgaccggtgctcgatttagctacgctctaagggggagtcagtctcagtcaggacacagcatggacatgagggtcccccgctcagcctccgtggggcctcctgctactctggctccggaggtgccagatgtgacatccagtatcgacccagtcctcccaccccgtccctcgtctgcacttctacggtcggacgacgaagacgtcaaccagttccttcttacgggcccgggacaaggtaccagacgacacgttcccgtaccgtactttaattttaaaacggtttggtaacttccaacgtaccgaaacgaaaacccggtacgggaccgaaacccgtacccccgttaaaaacctccgtacgtaactcgtagtcggaccttcgcccgttactacggtccttaggacgaaaggggttccgggtacctaacgtaccgttaacggttcgaacggttcggaacgtaggtacggaagttcgggtaacgggtactaacgttaacgtttccaacctttccctacgtaacccctacgtaccgaacgtccgtacgttacccgagtaacccgtaaacgtacgttaaaagtcttttaccggaaccttttacgtttaaccgttccgtacttaccggaaaactaaccgttaacgtaaaccttacccgtaaccgtttaccccgttaagttcccggttttaaccgaacggggtttaacccggacgtacggtaccggtacggaaccggttacgtacggaacccggtcgttaacggtaccggtaccggctaacggtaccctaacgttacccgg

SEQ ID NO: 30486 - DNA, 780 bp, Homo sapiens
  misc_feature: GYAE6OF02I7F9J.33.65.F10.1.454.CMB.1.raw
  modified_base (193)..(193): a, c, t, g, unknown or other
  misc_feature (193)..(193): n is a, c, g, or t
tcagtacacacactcacgaccggtgctcgatttagctacgctctaagggggagtcagtctcagtcaggacacagcatggacatgagggtccccgctcagctccgtggggctcctgctactctggctccgaggtgccagatgtgacatccagatcgacccagtctccaccctccctgtctgccatctgtcgganacagagtcacatcctcgttggccggacaagtccagacgcacgttccgtccgacttaatttaaacgtttggattccgaagaccgtaaacgaaaacccgaggggaccaaaccggtaacccccttaaacgttcccgtacgtaacttacgtaacgttgaccgtcgaccgttaccgacgttctacggacgtaaaacggggttcggggtacccctaacgtacgtaacgggtttccgaggttacggacgaacgggttaggtacgttacggtacggggtaaacctacggtaaccttacccgaaccgtttccgtaaccctacccgtaaagtaccccggtacggttaacccgaggtaaccccgttaaggacggtaaccccgttaaggtaacggtttaacgttttacgtaaccttaaggttttaaccgttaaccgttcggttaccgttacgaccgtcggtaaaccgttacgaaccgtaccgttacggtacctaaccgtacccgttccggaccgaacggtaccggaaccgacgtacgggtaacgtaaacgttaaaccggacgttacggttcgaccgtttacggacccgttaccgtaccg

SEQ ID NO: 30487 - DNA, 552 bp, Homo sapiens
  misc_feature: GYAE6OF02JVXKA.33.65.F10.1.454.CMB.1.raw
  modified_base (230)..(230): a, c, t, g, unknown or other
  misc_feature (230)..(230): n is a, c, g, or t
  modified_base (272)..(272): a, c, t, g, unknown or other
  misc_feature (272)..(272): n is a, c, g, or t
  modified_base (545)..(545): a, c, t, g, unknown or other
  misc_feature (545)..(545): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctcctgtcctgcatcgtgtcggagacagagtcaccagtctctgccggcaagtcagagcattcncgactattaaatgtatcagcagaacaggataacgccctaaanccagatcatgctagctcagtcagtcaaaggtcggtaccagtcgtaaagttcagtggacgagtaggtaactgtaggacgtatactttacacttcacgtacccgacaccgtgcttagcgtagcttagaagtttactagtactaagttactacctggtaaacaagttagctaagacgtgcccattacgtaccgttccgtacgacggtaactaagtaacgaacgttaaccgaaagtaccgttagcggtcttaaccggaccttaacggtaactcggtnttacccg

SEQ ID NO: 30488 - DNA, 626 bp, Homo sapiens
  misc_feature: GYAE6OF02GT9L4.33.65.F10.1.454.CMB.1.raw
  modified_base (95)..(95): a, c, t, g, unknown or other
  misc_feature (95)..(95): n is a, c, g, or t
  modified_base (221)..(221): a, c, t, g, unknown or other
  misc_feature (221)..(221): n is a, c, g, or t
  modified_base (353)..(353): a, c, t, g, unknown or other
  misc_feature (353)..(353): n is a, c, g, or t
tcagtacacacactcacgaccggtgctcgatttagctacgctctaagggggagtcagtctcagtcaggacacagcatggacatgagggtccccgntcagctcctggggctcctgctactctggctccgaggtgccagatgtgacatccagatgacccagtctccaccctcctgtctgcatctgtcggagacagagtcaccatctctgccggctaagtcagncgactcgtccgctattaaatggtatcagcagaaacctggacaacgacccctaaatccgtagactcgtaatcgctacggctaccagtctagaccaaggtcgggtcccagtacaaggttcagtcgataggtagngtcgtagggacagtattccagtctaccgactactcagtctacgttcgtacgtactaaccgtagtaacgttactttagtaccttaacgttaccttcgtacgtactaaccgtactaacgttaacctaacgttaccttaccggttaactaccggttttaaccggacccggtaaccgggtacctaacggtaccggtagggtaaccgtacggtaacgtaaccgggtaaccggtaacgttccggtacgggtaccgtacgtacccgtaaccgttaaccgg

SEQ ID NO: 30489 - DNA, 714 bp, Homo sapiens
  misc_feature: GYAE6OF02JOSCE.33.65.F10.1.454.CMB.1.raw
  modified_base (136)..(136): a, c, t, g, unknown or other
  misc_feature (136)..(136): n is a, c, g, or t
  modified_base (145)..(145): a, c, t, g, unknown or other
  misc_feature (145)..(145): n is a, c, g, or t
tcagtacacacactcacgaccggtgctcgatttagctacgctctaagggggagtcagtctcagtcaggacacagcatggacatgacgggtcccgctcagctccgtggggctcctgctactctcggctccgaggtcnccagactgnacatccgagatcgaccagtcctcctaccctcctgtctcgctagttcgtcggtcggaacacgaggtacgtaccgacctacttccgttcggttacggacccgggactaacgtccgacggacgtcctacgttccggtaccgtacttaacgttttaaacgttacggttaacgtacgaacgtacgaacggtaaaccggacgggaaccgaaccgtttttttttttaacccaaccgttaccgtacgtacgttacgtacgtcgtacgtcggtaccgtacgtacgtacgtacggtaaccggtaacgggtccgggtacctacgtacgtaacggttcgtacggtcggacggtaggtacggtacgtacggtacggactacgttacttacgtactactactactacgtacgtagtacgtacgtacgtacgtacctaacgtacgtacttacgttactacttacgttactacgtactactactacttacgtactacgtccgttacctacgttacgttcgacgtacgacgtacgtacggtcgtactacgtacgtaacgtacgtcgtcgcgtacgactactactcg

SEQ ID NO: 30490 - DNA, 962 bp, Homo sapiens
  misc_feature: GYAE6OF02GA19F.33.65.F10.1.454.CMB.1.raw
  modified_base (95)..(95): a, c, t, g, unknown or other
  misc_feature (95)..(95): n is a, c, g, or t
  modified_base (195)..(195): a, c, t, g, unknown or other
  misc_feature (195)..(195): n is a, c, g, or t
tcagtacacacactcacgaccggtgctcgatttagctacgctctaagggggagtcagtctcagtcaggacacagcatggacatgagggtccccgntcagctcctggggctcctgctactctggctccgaggtgccagatgtgacatccagatcgacccagtcctcccacccctcctgtctgctatctggtcgganacagagtccacctatcctcgttcggacccgggtacaacgtcaacgacgcctaagtccgtccgtactttaatttaaacgttggtactacaacgtaacgaacgaaaccggaacggaccaaaccgtaccccttaaaccttcccgtagtactaccgttatccggtacgttcggccgttaccgtaacggttcgttacgaaccgggtttaaaacggggttccgggggttaacccctaacggttaaccggtaaacgggtttaccggtacgggtaccgggtaccgtaggggttacggtaaccgttcggggtaacgggtaaccgttaaggtttaaccgttttacccgtaacccgtttacccgttaacccgtaaaccccgaacgtttaacccggtaacgtaccggttaaccggttaccgttacggttaaacccggtaaacccggtttaaaggttaaacggtttaacgttttttacccggttaaccctttaaaacccggtttaccgttttaccgttaaaccggttaaaccctaaacccgtttaaaccggtttaaacccgttttaaacccggttaaacccttttcccccgttttaaaccccgtttaacccggttttacccgtttaaacccggggggtaccccgggttaacggggtaacccgttaaccgggtacccggggttaaagggtacccggtaagggtaaacccggtacgggggtaacccgttaaacgggtcgggtttccgggaacccggttacggtaccgtaccccggtttaacg

SEQ ID NO: 30491 - DNA, 754 bp, Homo sapiens
  misc_feature: GYAE6OF02F8YRS.33.65.F10.1.454.CMB.1.raw
  modified_base (195)..(195): a, c, t, g, unknown or other
  misc_feature (195)..(195): n is a, c, g, or t
tcagtacacacactcacgaccggtgctcgatttagctacgctctaagggggagtcagtctcagtcaggacacagcatggacatgagggtccccgctcagctccgtggggctcctgctactctggctccgaggtgccagatgtgacatccagatcgacccagtcctcccaccctccctgtctgcatctggtcgganacagagtcaccatctctgccggacagtcagagctatccgtacgtattaattaatggtactcgagacaaacggaaccgagggaccaaaccgtaccccttaaactccgtagtactcgtatcgtctacggccgtaccgtagtccgtacgtaacggtaaacgggttccgggtaccaagttaccggtaaacggttcgaagggtcggacgtaggtacggtacgttcgaggggtaacctaggtttacttacccgaacgttccgtaacctaccgtacgtacgtacgtacgtacgttacgtacgtaaccgtaccgtagtaaacgtttacgtttaaccgtaaccgttaacctttaccgttacgttaaccgtaacgtaaaccgtaacgttaaccgttaacctaacccgtttacccgttaacccgttaaccgtttaccggttttaaccgggaacccgggttaaccgggtaaccgtacggttacggtaacgggtaacggttaaccggtaccggaacggttaccgttacggttacggttaccgtaccgtaccggtacccgtaaccgttaccgg

SEQ ID NO: 30492 - DNA, 783 bp, Homo sapiens
  misc_feature: GYAE6OF02GEZ3M.33.65.F10.1.454.CMB.1.raw
  modified_base (191)..(191): a, c, t, g, unknown or other
  misc_feature (191)..(191): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtctccaccctccctgtctgcatctgtcgganacagactcacctatctcttggccggacaagtcagagcctagtccgtccgtacttaagtttaaagttggtaactacgaacgtacgaaacggaaaacccgtaggggaacctaaaccggtaaccccccttaaaacgtttcccgtaggtaacttaccgttaacgtcggtaccgtcggtacccgttacccgtacgttccgtaaggtaccggttaaaacggggttcccgggggtaacccctaattaacccggtaaacgggtttcgtaagggtcggtacgtaacgggttacggtacgttacgggtacgggtaactacggttacgttttaccacgttccctaccgaacctataccgacgtccgtacgttccgtaacgtacctaacgtagtaagttaccttttacgaacctttaacctttcgttcttaaccgtaactaaaccgtaaccgttaacgtttaacccttaaccttcccgtttacccgttaacgtttaccggttttacccgggaaccgaaccggggttacaaccggttacgtcggtaacacgtaaccggacggtacgtacggttggtaccggtactaccggtacctaccgttaacg

SEQ ID NO: 30493 - DNA, 741 bp, Homo sapiens
  misc_feature: GYAE6OF02I7CE7.33.65.F10.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
tcagtacacacactcacgaccggtgctcgatttagctacgctctaagggggagtcagtctcagtcaggacacagcatggacatgagggtcccgctcagctccgtggggctcctgctactctggctccgaggtgccagatgtgacatccagatgacccagtcctccaccctccctgtctgaccatctgtcggagacagngtccaccgtatctctacggccgggacaagtcaaggacncactcggtcctatttaatttaaagttcggtaatcgaacgacaaaggaaacccgtagggacctaaaccggtaacccccttaaaacgttcccgtagtacttacctaagttcggaccttcgggaccctacccgtaagttccgtacggaaccgttaaaacgggggttccgggtacccctaagttaccggtaaacggggtttcaaggggttcggaaccgtttagggaacgggtcttaccgggttaaggggaccttaaggttacctttcaaccgttccgtaccaactactacgacgtactaggtcctacgaacctaacgtagttaacgttacgttttacaacttaaccgttttactactacggtaacctaacgtaacttaagttaacctaacgttacccttaccgttaaccgttacgtttaccggaaccggttaacggtaccaaggttccgtaagggaacgtcgtaacgaacggttacgacggttacggtcgttaccgcgaccctagtacg

SEQ ID NO: 30494 - DNA, 785 bp, Homo sapiens
  misc_feature: GYAE6OF02GSUB7.33.65.F10.1.454.CMB.1.raw
  modified_base (194)..(194): a, c, t, g, unknown or other
  misc_feature (194)..(194): n is a, c, g, or t
tcagtacacacactcacgaccggtgctcgatttagctacgctctaaggggggagtcagtctcagtcaggacacagcatggacatgagggtccccgctcagctcctggggctcctgcctactctggctccgaggtgccaggatgtgacgtccagatgacccagtctccatccctccctgtcttcatctgtagganacagagtcaccatcacttcgccgggcaagtgagagctattagaaccttattagaattggtatcagcagagaccgaagggaaccgacccccaaactcctagactctactcgccgcactaccgtaatttaaccacgtaacgtccggggtaccctacgtacggtacggttacgaaggtcgggcgtaggtaggtacgtacggtagggaaccaaggtttacttttaccgaccgtttcctaaccctaaccgtaaacttaaacggaccgtaaacggtttaccggtaaaccggtaaacccggttagggtaaacgtttagggttttaacggtaaaacggttacctttaacgtttaccgttaaccggtaccttaaaaccggtacgtttaaacctttaaacgttaaacccgggttaaaccccgtttaaaccgtttaaccggttttaccgggaacccgggtaaccggggtaaacccgtaaacgggtaccggtaagggtaacggtacttaacggaaacccggtagggtaaacccgtttaccgggtacgggtactaacccggtacacccgttaaccgttccgtacggtttccgtaccttaccccg

SEQ ID NO: 30495 - DNA, 1085 bp, Homo sapiens
  misc_feature: GYAE6OF02IZB8V.33.65.F10.1.454.CMB.1.raw
tcagtacacacactcacgaccggtgctcgatttagctacgctctaagggggagtcagtctcagtcaggacacagcatggacatgagggtccccgctcagctccgtggggctcctgctactctggctccgaggtgccagatgtgacatccagactacgacccagttcctcccaccccgtcccttagtcttcgactacgttccgtcggtacgggaacgaaccaacggtaacgttaccccaacccgtacgttccttaccgtttccgggccggtaacgggggtacctaaacgggttaccaagggaccggtaccctaacgtttaccccggttaccccgtaacgttttttaaaacgttttaaaacgttttcgggttaactaaccgtaacggtaaccgtaaaacggaaacccggaacggggacccgtaaacccggtaacccccctttaaaaacctcccgttaaggtaacccttagtaaccgttcggtaccgtttacccgggtccgttacccgttaacgggttaccgttacggtaaaaccggttaaaaccggggttttcccggggtaaaccccgtaaaccgttaaccggggtttaaaggggttttaccccggttaggggttaaccgggacgtttaaacgggggtaacgggttaccgtttaaccggggtaaccggggtaaaccgtaacggtttttacctttacccggtaaccctttacccggttaaccctaacccggacgtttaacccgtccgttaaccggttacgtaacccgttaaccggtaaccccgtaaacggtttaccggtttaaaagttttaacccggttttaccctaaaccgttttaaccccgtttttaaccgtaccgtttaaaccgttacccggtaaaaccctttaacccggttacttttaaaaccgttaccccgtttaaccgggttttaaacccccttacggttttaaaccccggtttacggggaacccggggtacccgggtaaaaccggtaccgggtttacggtaaccgggaaacccgttcgtaaacccggggtattaaccccgggtaggttacggacggttacccggtaccgacccgtttaccg

SEQ ID NO: 30496 - DNA, 799 bp, Homo sapiens
  misc_feature: GYAE6OF02F5Y5I.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctccacccctccctgtctgcatctgtcggagacagagtcaccatctctgccggacagtcagagcatccgtccgacttaatttaacgttggtatcagacaacgaaccgaggaccaaccgacccctaaactcctagtacttctatcgtctcgccgtccgtacgtctacggtacgtaaacgggtccgggtaccctacgtacgtaacggtctaaggtcggtacgaggttacggacgttcggtaacgggtaactacggtttaactttacccgtaccgtttaccctacccgtaaaccctaacgttaccgacggtaccgttaaccggttacgtaacccggtaccctaaacccggtacggttaaacggttttacgttttaaccgggttaactttaaaccccgtttaccttttaccggtttacccgtaacccgttaaaccgtaccgttaaaccgttttaaacctaaacccggtttaccccgtttaaccccgtttaacccgtttaccggtttttaccggaacccgggtaacccggggtaacccgtaacggtaccggtaacgggtaaccggttacggtaaccggtaacgggtacccgttaaacgggttcggtaccggttacccggtacgtacccgtaccgttaacccg

SEQ ID NO: 30497 - DNA, 689 bp, Homo sapiens
  misc_feature: GYAE6OF02F6BY9.33.65.F10.1.454.CMB.1.raw
  modified_base (135)..(135): a, c, t, g, unknown or other
  misc_feature (135)..(135): n is a, c, g, or t
  modified_base (153)..(153): a, c, t, g, unknown or other
  misc_feature (153)..(153): n is a, c, g, or t
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
  modified_base (684)..(684): a, c, t, g, unknown or other
  misc_feature (684)..(684): n is a, c, g, or t
tcagtacacacactcacgaccggtgctcgatttagctacgctctaagggggagtcagtctcagtcaggacacagcatggacatgagggtccccgctcgagctccgtggggctcctgctactctggctccgaggtnccagatgtgacatccagntcgacccagtcctcccaccctcctgtctgctatcgtgacgganacgacgagtccacctattctcgttggtccggganaacgtcaagacgctagtaccggtcctacttaaacttttaagtcggttactcgaagtaacaaacggaaacccggacgggtaaccaaaccggtaccccctaaaacttccgtagtacttcgtaatcgacgtcgtaccgtactacgttcgaggtaccgtaaggttccggtacctaacgtacggttaacggtctacggtacggcgtaggtacggtaaatccggtaaggaacttagttacttacccgtaactccctacaaacccgtacgtacgtaaccggtctacggtacctacgtaaccgtacgtaagttaacgttattacgtaaccttacgtttacgttactacgtaacctaacacgtttacgtaaccttacgtacccgttaccgtaacgttacggttacgacggagtaccgtacgaggtcgaacgttacacggacgtagcgtcgtacttgacctacnctacg

SEQ ID NO: 30498 - DNA, 527 bp, Homo sapiens
  misc_feature: GYAE6OF02F5T0T.33.65.F10.1.454.CMB.1.raw
  modified_base (383)..(383): a, c, t, g, unknown or other
  misc_feature (383)..(383): n is a, c, g, or t
tcagtacacacactcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccaccctccctgtctgcatctgtcggagacagagtcaccatctcttgccgggcaagtcagagcatcgtccgctatttaaattgtatcagcagaaaccgagggacaacgcccctaaactcctagatctatgctgcgtccagtctgacaaaggtcgggtccatcaagttcagtcggacaggtgatcgtggacagtacttcactctacaccatcagctagtcngacaagtgtaagtatttcgactaacttactatcgacaacgagtagtcaaccaacaccctaatcctacgtttccgccctacgggacctacggtacggtaggtactacggtacgaaacgtacgtcggtcggactcgtacacctacg

SEQ ID NO: 30499 - DNA, 609 bp, Homo sapiens
  misc_feature: GYAE6OF02H4H78.33.65.F10.1.454.CMB.1.raw
tcagtacacacactcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccaccctcctgtctgcatctgtcggagacagagtcaccatctcttggccggcaagtcagagcatcgtccgcttaatttaaattggtatcagacaagaaaccgagggaccaacgtaccccctaaaactccctagactctatcgtctcgccgtccagtctgacgtaaaggtcgggtaccagtcgtaaggttcaggtggctaggtggactcggtagggactaggttacttcacttcctacaacctatccagctacgtcgtacgactaacgtagtaagttagttttacgacttaaccgtttacttcgtacgtaccaacgtactacgttaacctaactaccttaccgttaactacgtttcgggacccgtaacgggtacccaacggtcggtaggtaacgacgtacggacggtaccggtacgtcggtacggtccgtacgtacctaccgttacg

SEQ ID NO: 30500 - DNA, 999 bp, Homo sapiens
  misc_feature: GYAE6OF02H71AH.33.65.F10.1.454.CMB.1.raw
  modified_base (133)..(133): a, c, t, g, unknown or other
  misc_feature (133)..(133): n is a, c, g, or t
tcagtacacacactcacgaccggtgctcgatttagctacgctctaagggggagtcagtctcagtcaggacacagcatggacatgagggtccccgctcagctccgtggggctcctgctactctggctcgaggtnccagagtgtgacatcagtatcgacccagtcctcccacccgtccctgtctcgacactcgtcggtacggacgacgaacgagtccaaccgtattcctcgttcggacccgggataacggtaccaagtacgacgtaccgtccggtccgttaactttaaattttaaagttgggtacttcgaacggaccgaaaacggaaaaccggcggggtaaccaaacccggttacccccttaaaacgtcccggttaagacctttacgtaacttcggtccgttaccgaccggttacctaacgttaccggttacggaaaccgttaaacccggggggttccgggttacccctaaaggttaaccggtaaccgggtttacggtcggggttaacggtaccggttacgggttaaggtaaccgggtttcggaaacccgggggtaaactttaccgttaacccggttttaccaccccggtttaaccgtaaacccctaaaccgtttacgtaacggttaaacccggtcccgtaaaccggttttaaccgccccgggtaaaaacggttttaaaccccgaaggttttaacgtttaaaccggtttttacccggtaaacctttaaaaaccgtttcccgggttaagttaacccggtaaaacccgaaagtttaaccgggtaaaccctttaaaacccgaccccaaaacccgtttcccccggtttttaacgttaccccggtttaaacccgtttttccccgggggacccgggttttaacccggtaaccccggtaaccggggttaaggttccggaaacccgttttcccggaaaacccgtaacccggttagggtttcccggggtaaaccgttcccgggtaccccgttactaaacccggttttccg

SEQ ID NO: 30501 - DNA, 539 bp, Homo sapiens
  misc_feature: GYAE6OF02FG1SM.33.65.F10.1.454.CMB.1.raw
  modified_base (190)..(190): a, c, t, g, unknown or other
  misc_feature (190)..(190): n is a, c, g, or t
  modified_base (286)..(286): a, c, t, g, unknown or other
  misc_feature (286)..(286): n is a, c, g, or t
  modified_base (325)..(325): a, c, t, g, unknown or other
  misc_feature (325)..(325): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccctccctgtctgcatctgtcgganacagagtcaccatctcttgccggcaagtcagagcatcgtcgctattaaattggtatcagcagaaaccagggcaagcccctaaaatcctagatctangactgcgtccagtctgctaaagtgggtccatcaacgttnagtggcagtggtatcgtggacagtactttcacttctacacatcagcagtctagcaactgaagtatttggactaacttacgttctattaccgaacaactacgttaacaacttcctacccgtacttaccgtttttcggaccgacggggtaccaacggcgtaacggataacttccgagggtaccgaacgttcggttaggactggtaccaacctaacg

SEQ ID NO: 30502 - DNA, 616 bp, Homo sapiens
  misc_feature: GYAE6OF02I6447.33.65.F10.1.454.CMB.1.raw
  modified_base (228)..(228): a, c, t, g, unknown or other
  misc_feature (228)..(228): n is a, c, g, or t
  modified_base (403)..(403): a, c, t, g, unknown or other
  misc_feature (403)..(403): n is a, c, g, or t
  modified_base (611)..(611): a, c, t, g, unknown or other
  misc_feature (611)..(611): n is a, c, g, or t
tcagtacacacactcacgaccggtgctcgatttagctacgctctaagggggagtcagtctcagtcaggacacagcatggacatgagggtccccgctcagctcctggggctcctgctactctggctccgaggtcgccagatgtgacatccagatcgacccagtcctccaccctccctgtctgcatctgtcggagacagacgtcaccatcctctgcccggacaagtcagngacatccgtccgacttaatttaaagttggtactcgacgacaacgaaaccgcgggacaaccgacccccttaaaacgtccctaggtactcgtactcgtcttacgccgttccaggttcctaggacttaaacggggtcggtacccagttacgtaacggttcacggtggctaggtcgtanccggtagggactaggtactttcccgactccgtacctacctactacgacgtctacgtcctacgactaaccgtgtaacttgtttacacttaaccttacttcctatacaactacgtacgttactacttccgtaccgttaccttacgttacgaccgtaacgggacctagtccgtagacgtacgcgaggtacgtacgtaggtgcgtccgtacnctacg

SEQ ID NO: 30503 - DNA, 743 bp, Homo sapiens
  misc_feature: GYAE6OF02GNDFB.33.65.F10.1.454.CMB.1.raw
  modified_base (467)..(467): a, c, t, g, unknown or other
  misc_feature (467)..(467): n is a, c, g, or t
tcagtacacacactcacgaccggtgctcgatttagctacgctctaaggggggagtcagtctcagtcaggacacagcatggacatgagggtccccgctcagctcctggggcctcctgctactctggctccggaggtgccagatggtgacatccagatcgacccagtcctcccaccctccctgtctgctatcgtggtcggagacagtacgtaccacctactcgttcgttccggaccgggcctaacggtccgaacggagactactccggtccgtatttaaattttaaagttggtaactcgagtaacgaacgaaaccgtacgggaccaaccggtaccccttaaaccgtccttacggacttccgtaagtcgtcgtacgccgttccgtagtcgtacggacgtaacgggtccggtacctagtaccgtaggtcgaggtcgcgtaggtgtcgtacggtacggactagttacttacnccgttcctaaccaccgttagacgtacgtccgtgtaccgtacgtaccgtaacgtagttaacggtttaactttacgtaactttaccctttacgtcccttacgtaaacctaaccgtacggttactaaacgtacccgttacccttaccggttacccttaggggttaccgaaccgggttaccggtacaaccgggtgtaaacggtaacggtaccggacggtaaccggttacgtaacggggttcgtacccggggttaacacgggttaccccacgtttaaccgg

SEQ ID NO: 30504 - DNA, 887 bp, Homo sapiens
  misc_feature: GYAE6OF02FNFQ9.33.65.F10.1.454.CMB.1.raw
  modified_base (164)..(164): a, c, t, g, unknown or other
  misc_feature (164)..(164): n is a, c, g, or t
  modified_base (200)..(200): a, c, t, g, unknown or other
  misc_feature (200)..(200): n is a, c, g, or t
  modified_base (626)..(626): a, c, t, g, unknown or other
  misc_feature (626)..(626): n is a, c, g, or t
tcagtacacacactcacgaccggtgctcgatttagctacgctctaagggggagtcagtctcagtcaggacacagcatggacatgagggtccccgctcagctcgtggggctcctgctactcgtgctccgagtgccagatgtgacatccagatcgaccctagtccnccctacccgtccctagtctagctatcgtgtacgganacgtagacgtaccacctactcgttcgtaccggtcgggactaacgtacgtacgacgacgtacgttccggtaccgttaacttaaatttaaggtttgaaccttagaaccggtaacaaacggaaacccgtacggggtacctaaaccggtaccccttaaactccgtaacggtatactaaggttcctaacggtcgacgttaaccgtacgtaccgtagtaaccggtaacgggttacgggttacccaacggttgtaaacggttcgaacgggtttacggaacgtcggttaacggtacggtacgggtaacggtaccgttaaacgttcgttttacccgaaccttaccgttaccgaaaccgtccgttaaacggtaccgtacgtaaacccgttaggttaccggaaccctaacgttaaacggttaattaacccggtttanaaccctttaccggtttaacctttacggaccgtttaacctaaacgtaaccttacggtttaaaaccttacccggttaacccgttaacccggttttaaccgttaacccggtttacggggaaaacccggggtacgggttttaaaacccccgagggtttaacccgggtaacggggtaaccctttacggtaaaccggttaaccgggttaacgtcccgggttaaccggtttaacgggaccctttaacgttaccccgaaccccgtttgg

SEQ ID NO: 30505 - DNA, 911 bp, Homo sapiens
  misc_feature: GYAE6OF02GJE03.33.65.F10.1.454.CMB.1.raw
  modified_base (901)..(901): a, c, t, g, unknown or other
  misc_feature (901)..(901): n is a, c, g, or t
tcagtacacacactcacgaccggtgctcgatttagctacgctctaaggggggagtcagtctcagtcaggacacagcatggacatgagggtccccgctcagctccgtggggctcctagctactcgtaggcctaccggaggtcgccaggatggtagactatccgagatcgacccgtagtcctaccccgaccccttcccgttgtcctcgactattccgtaggtaccggagacaggtactacctacctactccttccggttcggacccggggaataacggtacgaacgacgtaccgtaccgttccggttacccgttagttttaaaacgtttttaaggttaccggttacgtaaccgtacgtaaaccggaaaacgggaaaaccccggtacggggaaccctaaaacccggttaacccccttaaaccgttccggttaagaaccgtttacttaacggttccgttaccgtccgggttaccccggttaccgtaaggtttccgaaccggtaaaacgggttaaccggggggttacccgggtaaacccttacggtttaaccggttaaacgggttacccggtaagggttaccgggtaacggtacgggttaccgggtaacggttacccgggttaaggggtaccttaacgggtttaacccttacctacccgttacgtaacccgtacgtacgtaccgtacggttacctaccggtacgtaccggtaacctaaccgtaggtttaaccgttctttaaccgtacctttaacgttacttcgtacgtaactacgtacgtaacttactacccgttacttaaccgtacgttaccgttaaccgggaccgtaacggtacgtacgtacggtacgtacggtacgtacgggtacgacgttaccggtacggccgttaccgtaccggttaaccnccggtttacg

SEQ ID NO: 30506 - DNA, 703 bp, Homo sapiens
  misc_feature: GYAE6OF02GOXCS.33.65.F10.1.454.CMB.1.raw
  modified_base (190)..(190): a, c, t, g, unknown or other
  misc_feature (190)..(190): n is a, c, g, or t
tcagtacacacactcacgaccggtgctcgatttagctacgctctaaggggggagtcagtctcagtcaggacacagcatggacatgagggtccccgctcagctcctggggctcctgctactctggctccgaggtgtcagatgtgacatccagatgacccagtctccaccctcctgtctgcatctgtcgganacagagtcaccatctcttgccgggcaagtcagagcatccgtccgtacttatttaaattggtaatctagacaacgaaaccgaggacaaccgtacccctaaactcctagactctaagcgctgcgtccagtctacgacgtaacggtcggggttacccagtacgtaaggttacgaggtacggacgtaggtaggtacgttcgtaggggtacaagtagtttcctactacctccaacgtactacgacgtacgtacgtctacgaccaacccgtagtaaaggttacttttacgaaccttaaactttacgttaccgttacgtaccctaaacgtaaccgttaagttaaaccctaacgtttaccccgttacccgtttaacctttaaccggtttttacccggggaacccgtaacgggggtaccctaaacggtaccgttaacggggtaacgtaaccggttaacggaacgggtaacccgttaaacggttcgggtaacggttaccgtaccggtacccgtacttacccgg

SEQ ID NO: 30507 - DNA, 819 bp, Homo sapiens
  misc_feature: GYAE6OF02INOMN.33.65.F10.1.454.CMB.1.raw
tcagtacacacactcacgaccggtgctcgatttagctacgctctaagggggagtcagtctcagtcaggacacagcatggacatgagggtccccgctcagctccgtggggctcctgctactctggctccgaggtcgccagatgtgacatccagatcgacccagtcctcccaccctcctgtctgctatctggtacggagaccaggtacgtccaacctattccttcgttcggcccggggactaacggtccaaggtacgaccgtacgtccggtaccgtactttaaagttttaaaacgttggtaacttacgaacgacgtaaacggaaaccgacgggtaccaaaccggtaccccttaaaccgtcctagtactacgtagtcgtcgtacgtccgtaccgtacgtcgtacgacgtaaacggttccgggtaccctagtaccgtaaggttacgaggtacggacgtaggtacggtacgtacgggtacgggtaactaacggttacgtttacccaccgttaccctaaccgtaccttacggtaaccgacggtaaccgtacggttaccgtaaccgacccgttaaacggttacgttaaacggtttcgttttaaccgtaacccttttaaaccgttttaccgtacgttaccggtaacctaaaacccgtaaccgttaacgttaaacccgttaaccttaccccgtttaacccgttaccgtttaacggtttaccgggaacccgggttaccggtaacccggtagttaccggaaggtacgttaccggtaccgtaacgggtcctaacgggttcggtaccgacggttccgtacctaccgttacgg

SEQ ID NO: 30508 - DNA, 847 bp, Homo sapiens
  misc_feature: GYAE6OF02IPDFJ.33.65.F10.1.454.CMB.1.raw
tcagtacacacactcacgaccggtgctcgatttagctacgctctaagggggagtcagtctcagtcaggacacagcatggacatgagggtccccgctcagcctcctggggctcctgctactctggctccggaggtcgccagatgtgacatccagatcgacccagtcctccacccttccctgtctgcatcgtggtcgagactagacgtccacatccttcgttcggccggactaagtcaaggacgtacacgttccgtaccgtactttaagttttaaacgtttcgggttacttcgaagaccgtaacgaaaaccgaacggggaccgaaacccgtaacccccttaaaccgttacccgttacgaactttaccgttaagttaccggtaccgttacggtacccgttccggtacgttactacggtaccgtaaaaccggggttcggggtaaccccctaggttaacccgttaacggggttaaccgtacggttacgggtacggtaagggttaacggtacgttacgggaaccggggttaacgtaacgtttacgtttttacctaaccgttaccttaaccgaaaccgtaactaccggtaacgtaccgtacgttccgtacgtaaccgtaaccgttagtaaacgtttagtttaccgaaactttaaccgtttaccttacggtacttaacgtaaacctacgtttaaacgttaacctaacggttacccgttaaccgtttaccgtttacgttaccgggaaccgggttacccggaacgtaacgtaccggttaacggaaccggttacaacccggttaaggtaacccggttcgtacgggttaccgaccgttcgtacccgtactttaacccgg

SEQ ID NO: 30509 - DNA, 703 bp, Homo sapiens
  misc_feature: GYAE6OF02FOMKY.33.65.F10.1.454.CMB.1.raw
tcagtacacacactcacgaccggtgctcgatttagctacgctctaagggggagtcagtctcagtcaggacacagcatggacatgagggtccccgctcagctcctggggctcctgctactctggctccgaggtgccagatgtgacactccagatcgaccctagtcctcccaccctccctcgtctgcatctgtcgagacagagtcaccatcctcttggacccgggacaagtccagacacacgtccgtaccgtcttaaatttaaagttggtactacgacgcgaacgaaaccggacggaccaaccgtaccccctaaaaccgtccgtagtacttacgtaactgtacgtccgtccgtaccgtacgttccgtaggtaaccgtaaaccggggttcggggtaacccctaagttacggtaacggttcgaacggttcggacgtaggtggtacgtcgtacgggtactaggtacttaccacctactccaactacgtccaggccctagtcctacaacctaccgagtaacttgttaacgtaccttaacctttcgtaccttacgtacctaataccgttaacttaaccaacgttaccgttacccgttaacgttaccgtttaccgggaaccgttaaccggaccgttactacggtaccggtaagttacgtaccgacgggtacgttaacggtccgttaggacccgtctaccgttaccgttccg

SEQ ID NO: 30510 - DNA, 170 bp, Homo sapiens
  misc_feature: GYAE6OF01BMK8E.16.36.D03.1.454.CMB.1.raw
  modified_base (169)..(170): a, c, t, g, unknown or other
  misc_feature (169)..(170): n is a, c, g, or t
tcagtgtactactccacgaccggtgctcgatttagctgcgtcacgatctccttgggtattcggcggagggaccaagctgaccgtcttaggtcagcccaaggctgcccctcggtcactctgttcccaccctctcgagtagtacactgagcgggctggcaaggcgcatagnn

SEQ ID NO: 30511 - DNA, 178 bp, Homo sapiens
  misc_feature: GYAE6OF01CJ3LK.16.36.D03.1.454.CMB.1.raw
  modified_base (177)..(178): a, c, t, g, unknown or other
  misc_feature (177)..(178): n is a, c, g, or t
tcagtgtactactccacgaccggtgctcgatttagctgcgtcacgatctctcttgggtttgggaagaggaagactgacggtccccaggagttcaggtgctgggcacagcggccctgggctgcctggtcaaggactacttccgagtagtacactgagcgggctggcaaggcgcatagnn

SEQ ID NO: 30512 - DNA, 188 bp, Homo sapiens
  misc_feature: GYAE6OF01CSBXG.16.36.D03.1.454.CMB.1.raw
  modified_base (178)..(178): a, c, t, g, unknown or other
  misc_feature (178)..(178): n is a, c, g, or t
  modified_base (184)..(188): a, c, t, g, unknown or other
  misc_feature (184)..(188): n is a, c, g, or t
tcagtgtactactccacgaccggtgctcgatttagctgcgtcacgatctctcttggggtttgggggaagaggaagactgacggtccccccaggagttcaggtgctgggcacgagccggccctgggctgcctggcaaggactacttccgagtagtacactggagcgggctggcagggcncatagnnnnn

SEQ ID NO: 30513 - DNA, 181 bp, Homo sapiens
  misc_feature: GYAE6OF01D8NUY.29.6.A06.1.454.CMB.1.raw
  modified_base (179)..(181): a, c, t, g, unknown or other
  misc_feature (179)..(181): n is a, c, g, or t
tcagatagagtactcacgaccggtgctcgatttagatctactgacaacgacacaagggcccatcggtcttcccctggcgccctgctccaggagcacctccgagagcacagcggccctgggctgcctggtcaaggactacttccctcgtctctactgagcgggctggcaaggcgcatagnnn

SEQ ID NO: 30514 - DNA, 206 bp, Homo sapiens
  misc_feature: GYAE6OF01BHA5A.29.6.A06.1.454.CMB.1.raw
  modified_base (93)..(93): a, c, t, g, unknown or other
  misc_feature (93)..(93): n is a, c, g, or t
  modified_base (179)..(206): a, c, t, g, unknown or other
  misc_feature (179)..(206): n is a, c, g, or t
tcagatagagtactcacgaccggtgctcgatttagatctactgacgaacacacaagggcccatcggtcttcccctggcgccctgctccaggancacctccgagagcacagcggccctgggctgcctggtcaaggctacttcccctgtctctactgagtcgggctggcaaggcgcatagnnnnnnnnnnnnnnnnnnnnnnnnnnnn

SEQ ID NO: 30515 - DNA, 248 bp, Homo sapiens
  misc_feature: GYAE6OF01DMBKZ.29.6.A06.1.454.CMB.1.raw
  modified_base (77)..(77): a, c, t, g, unknown or other
  misc_feature (77)..(77): n is a, c, g, or t
  modified_base (95)..(95): a, c, t, g, unknown or other
  misc_feature (95)..(95): n is a, c, g, or t
  modified_base (107)..(107): a, c, t, g, unknown or other
  misc_feature (107)..(107): n is a, c, g, or t
  modified_base (187)..(189): a, c, t, g, unknown or other
  misc_feature (187)..(189): n is a, c, g, or t
  modified_base (191)..(248): a, c, t, g, unknown or other
  misc_feature (191)..(248): n is a, c, g, or t
tcagatagagtactcacgaccggtgctcgatttagatctactgacgaacgacacaagggcccatcggtcttcccccnggcgccctgctccaggancacctccgagancacagcggccctgggcctaggcctggtcaaagggctacgttccctagtctctactgagtcgggctggcaaggctcatagnnnannnnnnnnnnnnnnnnnnnnnnnnnnnnnnnnnnnnnnnnnnnnnnnnnnnnnnnnnn

SEQ ID NO: 30516 - DNA, 201 bp, Homo sapiens
  misc_feature: GYAE6OF01EANDX.29.6.A06.1.454.CMB.1.raw
  modified_base (145)..(145): a, c, t, g, unknown or other
  misc_feature (145)..(145): n is a, c, g, or t
  modified_base (178)..(201): a, c, t, g, unknown or other
  misc_feature (178)..(201): n is a, c, g, or t
tcagatagagtactcacgaccggtgctcgatttagatctactgacaacgacacaagggcccatcggtcttcccctggcgccctgctccaggagcacctccgagagcacagcggccctgggctgcctggtcaaggactacttcccngtctctactgagcgggctggcaaggcgcatagnnnnnnnnnnnnnnnnnnnnnnnn

SEQ ID NO: 30517 - DNA, 191 bp, Homo sapiens
  misc_feature: GYAE6OF01AZSX6.29.6.A06.1.454.CMB.1.raw
  modified_base (181)..(191): a, c, t, g, unknown or other
  misc_feature (181)..(191): n is a, c, g, or t
tcagatagagtactcacgaccggtgctcgatttagatctactgacaacgacgacgaaggggcccatcggtcttcccctggcgccctgctccaggagcacctccgagacgcacagccggccctgggctgcctggtcaaggctacttccctgtctctactgagcgggctggcaaggcgcatgnnnnnnnnnnn

SEQ ID NO: 30518 - DNA, 189 bp, Homo sapiens
  misc_feature: GYAE6OF01B2S71.29.6.A06.1.454.CMB.1.raw
  modified_base (178)..(189): a, c, t, g, unknown or other
  misc_feature (178)..(189): n is a, c, g, or t
tcagatagagtactcacgaccggtgctcgatttagatctactgacaacacacgaagggcccatcggtcttcccctggcgccctgctccaggagcacctccgagagcacagcggccctgggctgcctggtcaaggactacttccctgtctctactgagcgggctggcaaggcgcatagnnnnnnnnnnnn

SEQ ID NO: 30519 - DNA, 210 bp, Homo sapiens
  misc_feature: GYAE6OF01D7Q42.29.6.A06.1.454.CMB.1.raw
  modified_base (180)..(210): a, c, t, g, unknown or other
  misc_feature (180)..(210): n is a, c, g, or t
tcagatagagtactcacgaccggtgctcgatttagatctactgacaacacaccaagggcccatcggtcttcccctggcgccctgcgtccaggagcacctccgagagcacagcgccctgggctgcctggtcaaggactaccttccctcgtctctactgagcgggctggcaaggcgcatagnnnnnnnnnnnnnnnnnnnnnnnnnnnnnnn

SEQ ID NO: 30520 - DNA, 224 bp, Homo sapiens
  misc_feature: GYAE6OF02IV7MB.29.6.A06.1.454.CMB.1.raw
  modified_base (180)..(182): a, c, t, g, unknown or other
  misc_feature (180)..(182): n is a, c, g, or t
  modified_base (185)..(224): a, c, t, g, unknown or other
  misc_feature (185)..(224): n is a, c, g, or t
tcagatagagtactcacgaccggtgctcgatttagatctactgacgaacacacaagggcccatcggtcttcccctggcgccctgctcccaggagcacctccgagagcacagcggccctgggctgcctggtcaaggactacttccctcgtctctactgagcgggctggcaaggcgcatagnnngannnnnnnnnnnnnnnnnnnnnnnnnnnnnnnnnnnnnnnn

SEQ ID NO: 30521 - DNA, 193 bp, Homo sapiens
  misc_feature: GYAE6OF02FGPQ3.29.6.A06.1.454.CMB.1.raw
  modified_base (171)..(171): a, c, t, g, unknown or other
  misc_feature (171)..(171): n is a, c, g, or t
  modified_base (177)..(193): a, c, t, g, unknown or other
  misc_feature (177)..(193): n is a, c, g, or t
tcagatagagtactcacgaccggtgctcgatttagatctactgacaacacgacaagggcccatcggtcttccccctggcgccctgctccaggagcacctcgagagcacagcggcctgggctgcctggtcaaggctacttccctcgtctctactgagcgggctggcaaggcncatagnnnnnnnnnnnnnnnnn

SEQ ID NO: 30522 - DNA, 681 bp, Homo sapiens
  misc_feature: GYAE6OF02JWBEF.29.6.A06.1.454.CMB.1.raw
  modified_base (196)..(196): a, c, t, g, unknown or other
  misc_feature (196)..(196): n is a, c, g, or t
tcagatagagtactcacgaccggtgctcgatttagatctactgacagggggggggtctcgaggaggcaggcgctctcgggacgtctccaccatggcctgggctctgctattcctcaccctcctcactcagggcacagggtcctgggcccagtctgccctgactcagcctgcctccgtgtctgggtctccgtggacngtcgatcaccatctccagcactcggaaccagcaatgaacgttggtaacttataacttctcgtctcctgtaccaactaactaccccggacaaacgtccccaaacttcatacgattccgttagagttaccaatgtacgtaccggcccgtacggttagggttcctcgtactcggtccttcgtcccggcttaccgaggttcctggcacgacgtaccggtccctaccgtcgaacctctccttcgcggtcctccgacggctcggacggtacgtaggcgtatacttacttacgtagtcgtacgtcgtactacgtaacttacgaaacgtaagtaaaccgtacggttagggttccggttacgggacccggggtacggaaccgtaggtaccgtacggtaccttacccggtaaccggtcctaacggccccgtaacggcccggttacccggtccccgtaccggttccgtaacccttccgttacccgtttaccccccg

SEQ ID NO: 30523 - DNA, 551 bp, Homo sapiens
  misc_feature: GYAE6OF01C0ONY.19.31.C09.1.454.CMB.1.raw
  modified_base (295)..(295): a, c, t, g, unknown or other
  misc_feature (295)..(295): n is a, c, g, or t
tcagtactctcgtgcacgaccggtgctcgatttagacgtctcatcaaggaaggaaggggcagcaagatggtgttgcagacccaggtcttcatttctctgttgctctggatctctggtgcctacggggacatcgtcatgacccagtctccagactccctggctgtgtctctgggcgagagggccaccatcaactgcaagtccagccagagttgttttatacagctccaaacaataagaactacttaacttggtatcagcagaaaccaggacagcctcctaaaggtgctcatttccngggcatctacccgggaatccggggtccctgaccgattcagtggcagcggtctgggacagtatttcactctcagtcatcagcgcctgcaggctaggaagatggtggctagttttattctgtccagctaaatattaatatccacttcctaccgtacgttcggaccgaggggaccagggtacggaaatccgaaaacggtaacttcggtggacctgacccacctagttccttacgttctttccacgttcccttacccccg

SEQ ID NO: 30524 - DNA, 599 bp, Homo sapiens
  misc_feature: GYAE6OF01A5YRQ.19.31.C09.1.454.CMB.1.raw
  modified_base (216)..(216): a, c, t, g, unknown or other
  misc_feature (216)..(216): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
  modified_base (415)..(415): a, c, t, g, unknown or other
  misc_feature (415)..(415): n is a, c, g, or t
tcagtactctcgtgcacgaccggtgctcgatttagacgtctcatcaaggaaggaaggggcagcaagatggtgttgcagacccaggtcttcatttctctgttgctctggatctctggtgcctacgggacatcgtcatgacccagtctccagactccctggctgtgtctctgggcgagagggccaccatcaactgcaagtccagccagagttgtttanacagctccaacaataagaactacttaactgtatcagcagaaaccaggacagcctacctaaggtgctcatttccgtgggcatccgtacccgggaatcccggggtccctgaccgattcagtggcaggtcggtctgggacaggtatttcactctcgagctatcgacgcggcctgcnggtctagaagngtgtggcttagtttnttctgtcagtcaaattacgttatactcaacttcccgtaccgtaccgttccggaccgtacgggaccgtaggggtacggtaaaagtaccgaaaaaccggtacgtacgggtacggaccgttcggaaccctaaccctacgttccgttacggtttacccttaccgttaccgttcccgtttacccccccg

SEQ ID NO: 30525 - DNA, 820 bp, Homo sapiens
  misc_feature: GYAE6OF01D4PNA.19.31.C09.1.454.CMB.1.raw
  modified_base (217)..(217): a, c, t, g, unknown or other
  misc_feature (217)..(217): n is a, c, g, or t
  modified_base (303)..(303): a, c, t, g, unknown or other
  misc_feature (303)..(303): n is a, c, g, or t
tcagtactctcgtgcacgaccggtgctcgatttagacgtctcatcaaggaaggaaggggcagcaagatggtgttgcagacccaggtcttcatttctctgttgctctggatctctggtgcctacggggacatcgtcatgacccagtctccagactccctggctgtgtctctgggcgagaggccaccatcaactgcaagtccagccagagttgttttanacagcctaccaaacaataagaactacttaacgttggtatcagcagaaaccaggacagcctacctaaggtgactctaacttttccgngggtctacgtaccgtaacccggggaacgttcccgggggtccctaggaccgtattcgaggtcggcgacggcggtcgtagggactaggtacttttacgaccttctacgacgtcctaacgtccgaacgggtcccgggtcccgttcggaccggtaagggtcctaagggtaaacgtaaggttgggttacggtaccgtttaaggttttttaacgttttccgttcgggttaccctaaggttaaccctttaaaagttttaacgtttaacgtttaactttcccgtaaccccgtttacccccggtttacccccgggttaacccggggtttttaccccggggaaccccgggtaaacgggggggtaaccccggtaaggggggttaaacgtaaaaaccggttaacccggaaaacccgggttaacgggtttccggtaacgggtcccgttaaccgggacccctaaacccgttaacgtttcccggtttacgtttacccgtttaccctaccgtttcccccggtttaacccccgg

SEQ ID NO: 30526 - DNA, 672 bp, Homo sapiens
  misc_feature: GYAE6OF01BGQHL.19.31.C09.1.454.CMB.1.raw
  modified_base (219)..(219): a, c, t, g, unknown or other
  misc_feature (219)..(219): n is a, c, g, or t
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
tcagtactctcgtgcacgaccggtgctcgatttagacgtctcatcaaggaaggaaggggcagcaagatggtgttgcagacccaggtcttcatttctctgttgctctggatctctggtgcctacggggacatcgtcatgacccagtctccagactccctggctgtgtctcgtgggcgagagggccaccatcaactgcaagtccagccagagttgttttanacagcctaccaaacaataagaacttacttaacttggtatcagcaacgaaaccaggacagccctacctaaggtcnctctagtttccgngggcagtccgtacccggggaagtcccggggtccctagaaccgtattcgaggttcggacagggtcgggtcgtaggggactaggtactttccgactctacgagacactcgacggtccggcctgacgacgggtctaggaagtagttgggtacggtacttagttttactttccgtgtaccgtagtactaattattaactacgtcctaacccgttcccgtaccggtaccggttccgggaccggtacggggaaccgtaaggggttaaccggtaaactaaccgaaaaccggttacgtcgggttacggccgtacgtaccctaacccgttagttcccgttagtttacccttaacgtccgttcccgttacccccgg

SEQ ID NO: 30527 - DNA, 564 bp, Homo sapiens
  misc_feature: GYAE6OF01BQU3F.19.31.C09.1.454.CMB.1.raw
  modified_base (295)..(295): a, c, t, g, unknown or other
  misc_feature (295)..(295): n is a, c, g, or t
  modified_base (398)..(398): a, c, t, g, unknown or other
  misc_feature (398)..(398): n is a, c, g, or t
tcagtactctcgtgcacgaccggtgctcgatttagacgtctcatcaaggaaggaaggggcagcaagatggtgttgcagacccaggtcttcatttctctgttgctctggatctctggtgcctacggggacatcgtcatgacccagtctccagactccctggctgtgtctctgggcgagagggccaccatcaactgcaagtccagccagagttgttttatacagcctaccaacaataagaactacttaacttggtatcagcaagaaaccaggacagcctctaaggtgctcatttccnggcatccgtacccgggaatcccgggtccctgaccgtattcgagtggcaggcggtcgtgggacagtatttcacttctcagcatcagcgcctgcaggctagaagngtgtgtctagttttattcgtgtcagtactaattattatactcctaccttcccgtaccggtaccggttccggacccgaggggtacccgagggtacgaaactacgaaacgtacgtggtagctcgaccaccgtagttcgttcgttaccttctacgttcccgttaccccg

SEQ ID NO: 30528 - DNA, 679 bp, Homo sapiens
  misc_feature: GYAE6OF01CH8DT.19.31.C09.1.454.CMB.1.raw
  modified_base (224)..(224): a, c, t, g, unknown or other
  misc_feature (224)..(224): n is a, c, g, or t
  modified_base (316)..(316): a, c, t, g, unknown or other
  misc_feature (316)..(316): n is a, c, g, or t
tcagtactctcgtgcacgaccggtgctcgatttagacgtctcatcaaggaaggaaggggcagcaagatggtgttgcagacccaggtcttcatttctctgttgctctggatctctggtgccgtacggggacatcgtcatgacccagtctccagacctccctggctgtgtctcgtgggcgaggagggccaccatccaactgacaagtccagccagagttgttttanacagcctaccaaacgaaataaagaactacttaacgttggtatcagacaacgaaaaccaggaacacgcctaccgtaaggtgctctatttccgnggcagtccgtaacccgggaactcccggggtcctgaccgtatcgaggtcggcaggtcggtcgtagggaccaagtacttttccgactacctacgacggacctaagtaccgacggacccggtcccgtaggaccgtaagggccgtaaggaaaggtagttcgggttacgtaacgtttaaggtttttacgtttcgttaggtcctaaaggttactaaacgtttaatttaactacttcctaaccgttcccgtacccggttacgttccgggacggacggggtaccgaagggtacgaaacgtaccgaaacgtacgttcgtacggcgtcgaccaacgtacgttccgtcgttacttcctacgtcccgttaccccg

SEQ ID NO: 30529 - DNA, 871 bp, Homo sapiens
  misc_feature: GYAE6OF01ET4Q2.19.31.C09.1.454.CMB.1.raw
tcagtactctcgtgcacgaccggtgctcgatttagacgtctcatcaaggaaggaaggggcagcaagatggtgttgcagacccaggtcttcatttctctgttgctctggatctctggtcgccgtacggggacatcgtcatcgaccctagtctccagtacctcccgtggctgtgtctcgtgggcgaggacgggccaccatcaactgacaacgtccagaccagtagtttagtttaacacacgtacctaaccaaaactaaagttaaacgtaaacctttaacctttaacgtttggtaatacaacgtaccaaaacggaaaaccaggaaccacgtacccgttaaccgtaacggtctaccttacttacgtttccggtcggtactaccgttaacccgggtaaccccgggtaccggttccccgggggttaccctacggtacccgttagttaccgtagggtcggaccgtacgggggtccggttacgacgggtaacacgtttacgtttacccaccttaccgtacacggtacctaatccggaccggtcccggcgtaccgacgtacggtacgtaaggaagtacgttaggtacgggttactttaaaggttttactttaacggttaacgttaaactaaacggttttaactttaagttttaaacgttttactttaacccgggtttaccgggtttaacggggttaaccccgggtttaaccgggaaacccgggtttaaccgggtaaacgggttaaggggttacgtaacttaacgtaaccggaaacgttaaccccgggttaagttaccgggtccgggtaacgtacccggtacttacccgttagttccgttacccggttactttcccttaacccggttccccgttaccccgg

SEQ ID NO: 30530 - DNA, 806 bp, Homo sapiens
  misc_feature: GYAE6OF01EJAHV.19.31.C09.1.454.CMB.1.raw
tcagtactctcgtgcacgaccggtgctcgatttagacgtctcatcaaggaaggaaggggcagcaagatggtgttgcagacccaggtcttcatttctctgttgctctggatctcgtggtgccgtacggggacatcgtcattgatccagtctccagactcccgtggctgtgtctcgtgggcgagagggccaccatcaactgacaacgtccgagaccaaggtagttagttttaacaacgacgtacctaaccaaataaattaaaacggtaaaccttaacgtttaaaccgtttggtaactacgaacgaccaaaggaaaacccgtaggacctaacggtacccttaccgtaaagggtctaccttacgtaacgttttccggaggggtcctaaccgttacccggtaacccggggtaacgttccccgggggtaccccttaaggaaccccgttatttccggaaggttaccgggacgaacgggtccggggtacgtaggggaaacctaggtacttttaccgaaccgttcgtacgaaggtcaattccggagggtccgtactagggaccgtaaggggtcctaaagggtaacgtaggttacggttacggtaaccgttttaaggttttaccttttaccgacggtttaccgtaaagtaacgttaaagtttaacgttactaaccgttacccgtaccgtttacccgtaccgggtacggttaccggaccgggtaacgggtaccgagggttaaagtaacctaacggtaaacgtaggtcggacgtccgaatacccgaccttattaccgtgttacctactcgttaccccg

SEQ ID NO: 30531 - DNA, 874 bp, Homo sapiens
  misc_feature: GYAE6OF01CEHPP.19.31.C09.1.454.CMB.1.raw
  modified_base (181)..(181): a, c, t, g, unknown or other
  misc_feature (181)..(181): n is a, c, g, or t
  modified_base (243)..(243): a, c, t, g, unknown or other
  misc_feature (243)..(243): n is a, c, g, or t
tcagtactctcgtgcacgaccggtgctcgatttagacgtctcatcaaggaaggaaggggcagcaagatggtgttgcagacccaggtcttcatttctctgttgctctggattctcgtggtcgccgtacgggacagtcgtacatcgacccagtcctccgagacctccgtggctgtgtcgtcgngggcgaaggacggccactactaccaacgtcgacaacggccacgaccagtagtttactttaanacacgtaccaaccaaaagtaaattaaacgtaacttaacgtttaacgtaggtactacgaacgataaacgaaacgacggacacgtccttaaccgtaaggtcctactaccgttacgtttcccggaggtacctaccggtacccggttaacccggggtaacccggttcccggggttacccaacggtaacccggttaaggtttcccggaagggtccggtaaccggtaacgggggttaccggggttacgggaaacggggtaaccttaacggtttacttttaaacccggtaccttaccggaagaacccgttaacgacgttaacccggggcggcccgggtaaccggttacggacgggtaggtaccggtaaggtaacgtaggttcgggtacggttaaccttttaggttttacgttaccgtacgtaccgtaagtaaacttaacgtttaattaaccgtacccttaccgtaaccccgtttccggtacccgggttaacccggttacgggaaccgggaacgggtaaccgggaaacggtaacggtaaactaaacggaaaaccgttaggtacccgtaaggtcgtaacccgaacgtaaccgttaccgttacgttaaccgttcttaacccgttccgttacccgtaacccg

SEQ ID NO: 30532 - DNA, 511 bp, Homo sapiens
  misc_feature: GYAE6OF02F9YDH.19.31.C09.1.454.CMB.1.raw
  modified_base (388)..(388): a, c, t, g, unknown or other
  misc_feature (388)..(388): n is a, c, g, or t
tcagtactctcgtgcacgaccggtgctcgatttagacgtctcatcaaggaaggaaggggcagcaagatggtgttgcagacccaggtcttcatttctctgttgctctggatctctggtgcctacggggacatcgtcatgacccagtctccagactccctggctgtgtctctgggcgagagggccaccatcaactgcaagtccagccagagtgttttatacagctccaacaataagaactacttaacttggtatcagcagaaaccaggacagcctcctaaggtgctcatttcctgggcatctacccgggaatccggggtccctgaccgattcagtggcagcggtctgggacagatttcactctcaccatcagcagcctgcaggctgaagntgtggctagtttattattgtcaacaattattattatacttcgtggtacgttcggccaagggaccaaggtggatatcagacgaacgtggtgctgcaccattctgttccttcacttccttccccg

SEQ ID NO: 30533 - DNA, 496 bp, Homo sapiens
  misc_feature: GYAE6OF02FXLLK.19.31.C09.1.454.CMB.1.raw
  modified_base (388)..(388): a, c, t, g, unknown or other
  misc_feature (388)..(388): n is a, c, g, or t
  modified_base (469)..(469): a, c, t, g, unknown or other
  misc_feature (469)..(469): n is a, c, g, or t
tcagtactctcgtgcacgaccggtgctcgatttagacgtctcatcaaggaaggaaggggcagcaagatggtgttgcagacccaggtcttcatttctctgttgctctggatctctggtgcctacggggacatcgtcatgacccagtctccagactccctggctgtgtctctgggcgagagggccaccatcaactgcaagtccagccagagtgttttatacagctccaacaataagaactacttaacttggtatcagcagaaaccaggacagcctcctaaggtgctcatttcctgggcatctacccgggaatccggggtccctgaccgattcagtggcagcggtctgggacagatttcactctcagcatcagcggcctgcaggctgaagntgtggctagtttattctgtcagtcaatattatatcactcctcgacgttcgccgagggaccagggtgaatcaaacgacgtgngctgcaccatctgtcttcactctcccg

SEQ ID NO: 30534 - DNA, 506 bp, Homo sapiens
  misc_feature: GYAE6OF02GINZ9.19.31.C09.1.454.CMB.1.raw
  modified_base (349)..(349): a, c, t, g, unknown or other
  misc_feature (349)..(349): n is a, c, g, or t
tcagtactctcgtgcacgaccggtgctcgatttagacgtctcatcaaggaaggaaggggcagcaagatggtgttgcagacccaggtcttcatttctctgttgctctggatctctggtgcctacggggacatcgtcatgaccccagtctccagactccctggctgtgtctctgggcgagagggccaccatcaactgcaagtccagccagagtgttttatacagctccaaacaataagaactacttaacttggtatcagcagaaaccaggacagcctcctaaggtgctcatttcctgggcatctaccgggaatccgggtccctgaccgattcagtgcagcggtctgggacngatttcactctcagcatcagcgctgcaggctgaagatgtggcagtttattctgtcagcaatattatatcacttcctaccgcgttccggcgacgggaccaggggtcgaaatcgaaacgacgtgtaggctgcaccatctgtcttcgacttccttacccg

SEQ ID NO: 30535 - DNA, 622 bp, Homo sapiens
  misc_feature: GYAE6OF02J2TJR.19.31.C09.1.454.CMB.1.raw
  modified_base (298)..(298): a, c, t, g, unknown or other
  misc_feature (298)..(298): n is a, c, g, or t
tcagtactctcgtgcacgaccggtgctcgatttagacgtctcatcaaggaaggaaggggcgagcaagatggtgttgcagacccaggtcttcatttctctgttgctctggatctctggtgcctacggggacatcgtcatgacccagtctccagacctccctggctgtgtctctgggcgagagggccaccatcaactgcaagtccagccagagtgttttatacagctccaacaataacgaactacttaacttggtatcagacagaaccaggacagcctaccgtaaggtgctctattccgnggcactccgtacccgggaacgtcccggggtcccctaggacccgattcgaggttcggcacggcggtcgtagggacagtactttccacgtctcgacgtcacgtcgacggccggccctgccgacgggtctaggaagtagtggtcggtacttagttttacttcgttcgttacgagtaccgtaattacttacgtaacttccaaccttcccgttaccgtaccggtaccggaccggaacgggtacggagggtacgaacgtaccgaacgtaacgtcggtcgtactccggtacaccgtattccgtcgttaccttcgtaccttcccgttacccg

SEQ ID NO: 30536 - DNA, 661 bp, Homo sapiens
  misc_feature: GYAE6OF02HD1GS.19.31.C09.1.454.CMB.1.raw
  modified_base (222)..(222): a, c, t, g, unknown or other
  misc_feature (222)..(222): n is a, c, g, or t
  modified_base (309)..(309): a, c, t, g, unknown or other
  misc_feature (309)..(309): n is a, c, g, or t
tcagtactctcgtgcacgaccggtgctcgatttagacgtctcatcaaggaaggaaggggcagcaagatggtgttgcagacccaggtcttcatttctctgttgctctggatctctggtgccgtacggggacatcgtcatgacccagtctccagacctccctggctgtgtctcgtgggcgagacgggccaccatcaactgcaagtccagccagagttgttttanacagctaccaacaataagaacttacttaacttggtatcagacaagaaaccaggacagccctaccgtaaggtcgctactactttccgngggctacgtaccgtacccggggaacgttcccgggggtccctaggacccgtattccgaggtcggacgacggcgggtcgtaggggactaggtacttttcactctacacgaccatcgacggccggtcctggccgacgggcgttaggaaggtagttggtggtacttaggttttacttcgtagtacagactaaatttattatactcctaccttcccgtaccggaccgttcccggaccgtaaacggggtaccgtaaggggtaacgaaacgttaccgaaacggtaacgttcggtacggtacctacggaccctaaccgtacgttccgttacgttaccgttactaccgttcccttaccccg

SEQ ID NO: 30537 - DNA, 550 bp, Homo sapiens
  misc_feature: GYAE6OF02H71F0.19.31.C09.1.454.CMB.1.raw
  modified_base (347)..(347): a, c, t, g, unknown or other
  misc_feature (347)..(347): n is a, c, g, or t
tcagtactctcgtgcacgaccggtgctcgatttagacgtctcatcaaggaaggaaggggcagcaagatggtgttgcagacccaggtcttcatttctctgttgctctggatctctggtgcctacggggacatcgtcatgacccagtctccagactccctggctgtgtctctgggcgagagggccaccatcaactgcaagtccagccagagtgttttatacagctccaacaataagaactacttaacttggtatcagcaagaaaccaggacagcctacctaaggtgctcatttcctgggcactcgtacccgggaatccggggtcctgaccgattcagtggcagcggtcngggacagtatttcactctcagcatcagcggcctgcagctagagatgtggctagtttattctgtacagactaaattattatatctacctccgtccgacggtttccggaccgtaaggggaccgtaggggtacgaaatacgaaacgtacgtggtcggactcgaccaaccgtactccgttgttccttactaccgttccgttaccccg

SEQ ID NO: 30538 - DNA, 558 bp, Homo sapiens
  misc_feature: GYAE6OF02G04IK.19.31.C09.1.454.CMB.1.raw
  modified_base (217)..(217): a, c, t, g, unknown or other
  misc_feature (217)..(217): n is a, c, g, or t
  modified_base (290)..(290): a, c, t, g, unknown or other
  misc_feature (290)..(290): n is a, c, g, or t
tcagtactctcgtgcacgaccggtgctcgatttagacgtctcatcaaggaaggaaggggcagcaagatggtgttgcagacccaggtcttcatttctctgttgctctggatctctggtgcctacggggacatcgtcatgacccagtctccagactccctggctgtgtctctgggcgagaggccaccatcaactgcaagtccagccagagttgttttanacagctccaacaataagaactacttaacttgtatcagcagaaacaggacagcctactaaggtgctcatttccnggctatcgtaccggaattcgggtccctgtccgtattcacgcggcagcgtgtcgtgggacagtattcactctcacatcagcagcctgcgaggctagagacgtggcggtcggtacttacttacgtagtacaactaaattattatagaaacgtccgagggtctttcggacccgttaggaacgttaaggtaggagtacgtacgaagaacggtaacgtgtcgggtacgttacgaccgtacctacgttccttgtacctttacaccgtttccccg

SEQ ID NO: 30539 - DNA, 671 bp, Homo sapiens
  misc_feature: GYAE6OF02H89EF.19.31.C09.1.454.CMB.1.raw
  modified_base (117)..(117): a, c, t, g, unknown or other
  misc_feature (117)..(117): n is a, c, g, or t
  modified_base (143)..(143): a, c, t, g, unknown or other
  misc_feature (143)..(143): n is a, c, g, or t
  modified_base (172)..(172): a, c, t, g, unknown or other
  misc_feature (172)..(172): n is a, c, g, or t
  modified_base (188)..(188): a, c, t, g, unknown or other
  misc_feature (188)..(188): n is a, c, g, or t
  modified_base (220)..(220): a, c, t, g, unknown or other
  misc_feature (220)..(220): n is a, c, g, or t
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
  modified_base (365)..(365): a, c, t, g, unknown or other
  misc_feature (365)..(365): n is a, c, g, or t
  modified_base (393)..(393): a, c, t, g, unknown or other
  misc_feature (393)..(393): n is a, c, g, or t
  modified_base (456)..(456): a, c, t, g, unknown or other
  misc_feature (456)..(456): n is a, c, g, or t
tcagtactctcgtgcacgaccggtgctcgatttagacgtctcatcaaggaaggaaggggcagcaagatggtgttgcagcccaggtcttcatttctctgttgctctggatctctggtnccgtacgggacatcgtcatcgacccngtactccagacctccgtgctgtgtctcgngggcgagcggccacancaactgacagtcagcagagttcgtttactacncgctaccgaacaataacgaacttacttaacttggtacactacgcaacggaaacgtacgacacgtcccgtacgtaaggtcncttacctcgtttccgaggtacncgtaccggtaccggacggttcccgggtcctagcccgtattcgnggtacgcgagggtcggtgagtactagtnttccactctacagcagtcggacgccgtgtcggcgagtacgtaagacggtgttcggtacggttnttacgtttacttcgtacgttacaacgttataacgtttataacgttctaccgtacccgttcgtacccgggtttcggtaccgggaccgggttaacgggtaccgggtaaacgggttaacgtaaccgtaaccgggtaaacgttgtaccgggtacgtacgtaaccggtacctacgtaccgtttcggttaccttcgttaccttaccccgttaccgtccccg

SEQ ID NO: 30540 - DNA, 226 bp, Homo sapiens
  misc_feature: GYAE6OF01A9AJM.27.2.A02.1.454.CMB.1.raw
  modified_base (225)..(226): a, c, t, g, unknown or other
  misc_feature (225)..(226): n is a, c, g, or t
tcagagcgtcgtctcacgaccggtgctcgatttagactcatctacagggctccagtctgaggatgagggtgactattattgtgtcatttggcacagcagtacttatgtggccttcggcggagggaccaagctgaccgtcctaggtcagcccaaggctgccccctcggtcactctgttcccgccctcctcagacgacgctctgagcgggctggcaaggcgcatagnn

SEQ ID NO: 30541 - DNA, 227 bp, Homo sapiens
  misc_feature: GYAE6OF01A8U99.27.2.A02.1.454.CMB.1.raw
  modified_base (225)..(227): a, c, t, g, unknown or other
  misc_feature (225)..(227): n is a, c, g, or t
tcagagcgtcgtctcacgaccggtgctcgatttagactcatctacagggctccagtctgaggatgagggtgactattattgtgtcatttggcacagcagtacttatgtggccttcggcggagggaccaagctgaccgtcctaggtcagcccaaggctgccccctcggtcactctgttcccaccctcctcagacgacgctctgagcgggctggcaaggcgcatagnnn

SEQ ID NO: 30542 - DNA, 250 bp, Homo sapiens
  misc_feature: GYAE6OF01B8EZF.27.2.A02.1.454.CMB.1.raw
  modified_base (231)..(250): a, c, t, g, unknown or other
  misc_feature (231)..(250): n is a, c, g, or t
tcagagcgtcgtctcacgaccggtgctcgatttagactcatctacagggctccagtctgacggatgagggtgactattattgtgtcatttggcacagcagtacttatgtggccttcggcggagggaccaagtctgaccgtcctaggtctagcccaaggctgtccccctcggtcactctgttcccaccctcctcagacgacgctctggagcgggctggcaaggcggcatagnnnnnnnnnnnnnnnnnnnn

SEQ ID NO: 30543 - DNA, 284 bp, Homo sapiens
  misc_feature: GYAE6OF01BF5WA.27.2.A02.1.454.CMB.1.raw
  modified_base (228)..(229): a, c, t, g, unknown or other
  misc_feature (228)..(229): n is a, c, g, or t
  modified_base (231)..(234): a, c, t, g, unknown or other
  misc_feature (231)..(234): n is a, c, g, or t
  modified_base (236)..(239): a, c, t, g, unknown or other
  misc_feature (236)..(239): n is a, c, g, or t
  modified_base (241)..(284): a, c, t, g, unknown or other
  misc_feature (241)..(284): n is a, c, g, or t
tcagagcgtcgtctcacgaccggtgctcgatttagactcatctacagggctccaggtctgaggatgagggtgactattattgtgtcatttggcacagcagtacttatgtggcttcggcggagggacaagctgaccgtcctaggtcacgcccaaggctcgccccctggtcacttctagttcccaaccctcctcagacgacgctctgaggcggctggcaaggcgcatagnngnnnntnnnncnnnnnnnnnnnnnnnnnnnnnnnnnnnnnnnnnnnnnnnnnnnn

SEQ ID NO: 30544 - DNA, 228 bp, Homo sapiens
  misc_feature: GYAE6OF01C1AO3.27.2.A02.1.454.CMB.1.raw
  modified_base (225)..(228): a, c, t, g, unknown or other
  misc_feature (225)..(228): n is a, c, g, or t
tcagagcgtcgtctcacgaccggtgctcgatttagactcatctacagggctccagtctgaggatgagggtgactattattgtgtcatttggcacagcagtacttatgtggccttcggcggagggaccaagctgaccgtcctaggtcagcccaaggctgccccctcggtcactctgttcccgccctcctcagacgacgctctgagcgggctggcaaggcgcatagnnnn

SEQ ID NO: 30545 - DNA, 233 bp, Homo sapiens
  misc_feature: GYAE6OF01ETIVD.27.2.A02.1.454.CMB.1.raw
  modified_base (227)..(233): a, c, t, g, unknown or other
  misc_feature (227)..(233): n is a, c, g, or t
tcagagcgtcgtctcacgaccggtgctcgatttagactcatctacagggctccagtctgaggatgagggtgactattattgtgtcatttggcacagcagtacttatgtggccttcggcggagggaccaagctgaccgtcctaggtcagcccaaggctcgccccctcggtcactctcgttcccaccctcctcagacgacgctctgagcgggctggcaaggcgcatagnnnnnnn

SEQ ID NO: 30546 - DNA, 227 bp, Homo sapiens
  misc_feature: GYAE6OF01D2738.27.2.A02.1.454.CMB.1.raw
  modified_base (224)..(227): a, c, t, g, unknown or other
  misc_feature (224)..(227): n is a, c, g, or t
tcagagcgtcgtctcacgaccggtgctcgatttagactcatctacagggctccagtctgaggatgagggtgactattattgtgtcatttggcacagcagtacttatgtggccttcggcggagggaccaagctgaccgtcctaggtcagcccaaggctgccccctggtcactctgttcccgccctcctcagacgacgctctgagcgggctggcaaggcgcatagnnnn

SEQ ID NO: 30547 - DNA, 236 bp, Homo sapiens
  misc_feature: GYAE6OF01BGJ8V.27.2.A02.1.454.CMB.1.raw
  modified_base (226)..(236): a, c, t, g, unknown or other
  misc_feature (226)..(236): n is a, c, g, or t
tcagagcgtcgtctcacgaccggtgctcgatttagactcatctacagggctccagtctgaggatgagggtgactattattgtgtcatttggcacagcagtacttatgtggccttcggcggagggaccaagctgaccgtcctaggtcagcccaaggctgccccctggtcactctcgttcccaccctcctcagacgacgctctggagcgggctggcaaggcgcatagnnnnnnnnnnn

SEQ ID NO: 30548 - DNA, 614 bp, Homo sapiens
  misc_feature: GYAE6OF01AI0U6.27.2.A02.1.454.CMB.1.raw
  modified_base (208)..(208): a, c, t, g, unknown or other
  misc_feature (208)..(208): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (282)..(282): a, c, t, g, unknown or other
  misc_feature (282)..(282): n is a, c, g, or t
  modified_base (304)..(304): a, c, t, g, unknown or other
  misc_feature (304)..(304): n is a, c, g, or t
  modified_base (315)..(315): a, c, t, g, unknown or other
  misc_feature (315)..(315): n is a, c, g, or t
  modified_base (384)..(384): a, c, t, g, unknown or other
  misc_feature (384)..(384): n is a, c, g, or t
tcagagcgtcgtctcacgaccggtgctcgatttagactcatctacaggctccagtctgaggatgagggtgactattattgtgtcatttggcacagcagtacttatgtggccttcggcggagggtaccaagctgaccgtcctaggtcagcccaaggctgccccctggtcactctgttacccgccctccgtcacgacgacgcttctaggngcgggctagggcaaacggtcgactaatacggntcgatnatcagtccgntnactacncgatctagctactacgtntcgtaacgtcgcgtagtacggntcgacttaggnttagtacagcttcgtaacgtcgctaacgtcgtacgagtcagtacacgtagtccgaatcgtagtctacgngttacaccgttacacgtacccgtctacgtaccgtcgtaacgtcgtactacgtacgacgttacgtactcgtaacgtaccgttagtaccgttagaaccgcgttacgacggttactaaggtacgtccgtacgtacgtacggtacgtcgtagtaccgttagaccgttaacgtccgtacgttacgtcgtaccgtacgttaaccgtattaaccggtatccggttcgttacgtacgg

SEQ ID NO: 30549 - DNA, 225 bp, Homo sapiens
  misc_feature: GYAE6OF02HALHA.27.2.A02.1.454.CMB.1.raw
  modified_base (224)..(225): a, c, t, g, unknown or other
  misc_feature (224)..(225): n is a, c, g, or t
tcagagcgtcgtctcacgaccggtgctcgatttagactcatctacagggctccagtctgaggatgaggtgactattattgtgtcatttggcacagcagtacttatgtggccttcggcggagggaccaagctgaccgtcctaggtcagcccaaggctgccccctcggtcactctgttcccgccctcctcagacgacgctctgagcgggctggcaaggcgcatagnn

SEQ ID NO: 30550 - DNA, 229 bp, Homo sapiens
  misc_feature: GYAE6OF02G6KU4.27.2.A02.1.454.CMB.1.raw
  modified_base (225)..(229): a, c, t, g, unknown or other
  misc_feature (225)..(229): n is a, c, g, or t
tcagagcgtcgtctcacgaccggtgctcgatttagactcatctacagggctccagtctgaggatgagggtgactattattgtgtcatttggcacagcagtacttatgtggccttcggcggagggaccaagctgaccgtcctaggtcagcccaaggctgccccctcggtcactctgttcccgccctcctcagacgacgctctgagcgggctggcaaggcgcatagnnnnn

SEQ ID NO: 30551 - DNA, 285 bp, Homo sapiens
  misc_feature: GYAE6OF02J1R7O.27.2.A02.1.454.CMB.1.raw
  modified_base (115)..(115): a, c, t, g, unknown or other
  misc_feature (115)..(115): n is a, c, g, or t
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (235)..(235): a, c, t, g, unknown or other
  misc_feature (235)..(235): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (247)..(248): a, c, t, g, unknown or other
  misc_feature (247)..(248): n is a, c, g, or t
  modified_base (253)..(253): a, c, t, g, unknown or other
  misc_feature (253)..(253): n is a, c, g, or t
  modified_base (256)..(256): a, c, t, g, unknown or other
  misc_feature (256)..(256): n is a, c, g, or t
  modified_base (258)..(260): a, c, t, g, unknown or other
  misc_feature (258)..(260): n is a, c, g, or t
  modified_base (262)..(262): a, c, t, g, unknown or other
  misc_feature (262)..(262): n is a, c, g, or t
  modified_base (265)..(266): a, c, t, g, unknown or other
  misc_feature (265)..(266): n is a, c, g, or t
  modified_base (268)..(285): a, c, t, g, unknown or other
  misc_feature (268)..(285): n is a, c, g, or t
tcagagcgtcgtctcacgaccggtgctcgatttagactcatctacaggctccagtctgaggatgaggtgactattattgtgtcatttggcacagcagtactatgtggccttcggnggaggtaccaagcgtgaccgtcctaggtcagcccaaggctgcccccgtggtcactctgtcccaccctctcagacgacgtcctcgngacgcgggctggacaacgggcncagtacggcgntncngcatncgacnncgctnaancnnncngcnncnnnnnnnnnnnnnnnnnn

SEQ ID NO: 30552 - DNA, 234 bp, Homo sapiens
  misc_feature: GYAE6OF02IGC21.27.2.A02.1.454.CMB.1.raw
  modified_base (224)..(234): a, c, t, g, unknown or other
  misc_feature (224)..(234): n is a, c, g, or t
tcagagcgtcgtctcacgaccggtgctcgatttagactcatctacagggctccagtctgaggatgagggtgactattattgtgtcatttggcacagcagtacttatgtggccttcggcggagggaccaagctgaccgtcctaggtcagcccaaggctgccccctggtcactctgttcccgccctcctcagacgacgctctgagcgggctggcaaggcgcatagnnnnnnnnnnn

SEQ ID NO: 30553 - DNA, 518 bp, Homo sapiens
  misc_feature: GYAE6OF01B8LXP.40.67.G01.1.454.CMB.1.raw
  modified_base (379)..(379): a, c, t, g, unknown or other
  misc_feature (379)..(379): n is a, c, g, or t
  modified_base (394)..(394): a, c, t, g, unknown or other
  misc_feature (394)..(394): n is a, c, g, or t
  modified_base (405)..(405): a, c, t, g, unknown or other
  misc_feature (405)..(405): n is a, c, g, or t
  modified_base (493)..(493): a, c, t, g, unknown or other
  misc_feature (493)..(493): n is a, c, g, or t
  modified_base (514)..(514): a, c, t, g, unknown or other
  misc_feature (514)..(514): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagacgcctccctctcctgcggggccagtcagcatgtgcacctcttagcctggtaccaacaaagcctggccaggctcccagacctctcatctatgatgcgtcttccaggccactggcgtccggcaggttcagtggcagtggtctgggacagccttcactctcacatcagcagcctggancccgaagtattttgnggtttattacngtcagcagcgtgccgactggcccctgacggttcgggcggaacgggaccaagggtcgaacagtacaaacgactggtaggctggacaccntcgtgtcttcatccttcccgntatc

SEQ ID NO: 30554 - DNA, 508 bp, Homo sapiens
  misc_feature: GYAE6OF01B0PCP.40.67.G01.1.454.CMB.1.raw
  modified_base (477)..(477): a, c, t, g, unknown or other
  misc_feature (477)..(477): n is a, c, g, or t
  modified_base (486)..(486): a, c, t, g, unknown or other
  misc_feature (486)..(486): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggcaggttcagtggcagtggtctgggacagccttcactctcaccatcagcagcctggagcccgaagtattttgcggtttattactgtcagcagcgtgccgactggcccctgacgttcggcggagggaccaagggtgacagtcaaacgactgnggctgcacntctgtcttcatcttcccncntc

SEQ ID NO: 30555 - DNA, 507 bp, Homo sapiens
  misc_feature: GYAE6OF01D5UY4.40.67.G01.1.454.CMB.1.raw
  modified_base (362)..(362): a, c, t, g, unknown or other
  misc_feature (362)..(362): n is a, c, g, or t
  modified_base (437)..(437): a, c, t, g, unknown or other
  misc_feature (437)..(437): n is a, c, g, or t
  modified_base (475)..(475): a, c, t, g, unknown or other
  misc_feature (475)..(475): n is a, c, g, or t
  modified_base (486)..(486): a, c, t, g, unknown or other
  misc_feature (486)..(486): n is a, c, g, or t
  modified_base (502)..(502): a, c, t, g, unknown or other
  misc_feature (502)..(502): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttcagggccactggcgtccggcaggttcagtggcagtggtctgggacagcctttacnctcaccatcagcagcctggacgcccgaagattttgcggttttattactgtcagcagcgtgccgactcggcccctnacgttcggcggaggaccagggtgacatcaaacgactgngctgcacatcngtctcatcttcccgcntctag

SEQ ID NO: 30556 - DNA, 524 bp, Homo sapiens
  misc_feature: GYAE6OF01D2ZTY.40.67.G01.1.454.CMB.1.raw
  modified_base (369)..(369): a, c, t, g, unknown or other
  misc_feature (369)..(369): n is a, c, g, or t
  modified_base (497)..(497): a, c, t, g, unknown or other
  misc_feature (497)..(497): n is a, c, g, or t
  modified_base (521)..(521): a, c, t, g, unknown or other
  misc_feature (521)..(521): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccaggccactggcgtcccgcaggttcagtggcagtggtctgggacagccttcactctcaccntcagcagcctggacgcccgaagtattttgcggttttatactgtcagtcagtcgtgccgactcggcccctgaccgttcgggcggagggaccaagggtcgaacagtacaaacgacgtgtgctggacaccntcgtgtcttcacttccttccgctntcg

SEQ ID NO: 30557 - DNA, 530 bp, Homo sapiens
  misc_feature: GYAE6OF01BJO3Z.40.67.G01.1.454.CMB.1.raw
  modified_base (523)..(523): a, c, t, g, unknown or other
  misc_feature (523)..(523): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggccgtcccggcaggttcagtggcagtggtctgggacagccttcactctcaccatcagcagccctggacgccccgaagtcttttggcggtttaattacgtgtcagcagcgtgccgatcggccctgacgttcggcggagggaccaagggtcgacagtaccgaaacgtacgtggtacggctgcaccatctgtcttcacttccttcccnctgtccg

SEQ ID NO: 30558 - DNA, 554 bp, Homo sapiens
  misc_feature: GYAE6OF01CF9D6.40.67.G01.1.454.CMB.1.raw
  modified_base (203)..(203): a, c, t, g, unknown or other
  misc_feature (203)..(203): n is a, c, g, or t
  modified_base (393)..(393): a, c, t, g, unknown or other
  misc_feature (393)..(393): n is a, c, g, or t
  modified_base (520)..(520): a, c, t, g, unknown or other
  misc_feature (520)..(520): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcgggccagtcagcatgttggcacctccttagcctggtaccaacaaaagcctggccaggcctcccagactcctcatctatgatgcgtcttccgagggccacgtggccgtcccggccaggttcaggtggcaggtgggtctgggacagcctttcactctcaccatcagcagcctggacnccgaagtattttgacggttttattactgtcagtcaggcgtgcccgtactggccccctgaccgttcgggcggaacggggaccaagggtcgaacacgtacaaacggtactggtaggcctggacaccctntccgtgtccttcacttcccttccccgctagttcg

SEQ ID NO: 30559 - DNA, 548 bp, Homo sapiens
  misc_feature: GYAE6OF01DPMZW.40.67.G01.1.454.CMB.1.raw
  modified_base (391)..(391): a, c, t, g, unknown or other
  misc_feature (391)..(391): n is a, c, g, or t
  modified_base (438)..(438): a, c, t, g, unknown or other
  misc_feature (438)..(438): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgctctggaacttctatcaagggtagcagcttccactggggctggatccgccagccccaggaagggctccaatgcgttggacatgtcaattctatggcgctccactacagtgccggccctcagacgtcgacgccctcatactccatagacacgtaccaagaacctagtttcccngaccgctgacgtctgtcgaccgccgcagacacggctgtctattatgngcgagactagccttgtgtaggtggggtacttggaccaacccgggataccgtacctcctaccgttcggacttcggactagttcggtacggggccgtaggggcccttccggg

SEQ ID NO: 30560 - DNA, 525 bp, Homo sapiens
  misc_feature: GYAE6OF01CXJB7.40.67.G01.1.454.CMB.1.raw
  modified_base (499)..(499): a, c, t, g, unknown or other
  misc_feature (499)..(499): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctgggacgcccgaagtattttggcggttttattacgtgtcagcagcgtgccgactcggcccctgacggttccggcggagggaccaagggtgacatcaaacgactgtggctgcaccgtntctgtcttcattccttcccgctgtcg

SEQ ID NO: 30561 - DNA, 537 bp, Homo sapiens
  misc_feature: GYAE6OF01AV67G.40.67.G01.1.454.CMB.1.raw
  modified_base (204)..(204): a, c, t, g, unknown or other
  misc_feature (204)..(204): n is a, c, g, or t
  modified_base (510)..(510): a, c, t, g, unknown or other
  misc_feature (510)..(510): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcggggccagtcagcatgttggcacctcttagcctggtaccaacaaaagcctggccaggctcccagactcctcatctatgatgcgtcttccgagggccactggccgtcccggccaggttcagtggcaggtggtctggggacaggccttcactctcaccatcagcagcctggacgcccgaagtattttgcggttttaattctgttcagtcaggtcgtgccgactcggcccctcgtacggttcggcgggacgggaccaagggtcgaacagtacgaacgtactgtggctgcacgtntctgttcttcacttcctcccgctgtcg

SEQ ID NO: 30562 - DNA, 513 bp, Homo sapiens
  misc_feature: GYAE6OF01BP8SZ.40.67.G01.1.454.CMB.1.raw
  modified_base (364)..(364): a, c, t, g, unknown or other
  misc_feature (364)..(364): n is a, c, g, or t
  modified_base (398)..(398): a, c, t, g, unknown or other
  misc_feature (398)..(398): n is a, c, g, or t
  modified_base (491)..(491): a, c, t, g, unknown or other
  misc_feature (491)..(491): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccagggttcagtggcaggtggtctgggacagccttnactctcacatcagcagcctggacgcccgtaagtnttttgcggtttatacgtgtcagcagcgtgccgtactcggccctgcgttcggcggagggaccaagggtcgacatacaacgactgtggctgcacntctgtctcactcctccncntcg

SEQ ID NO: 30563 - DNA, 518 bp, Homo sapiens
  misc_feature: GYAE6OF01DR2C9.40.67.G01.1.454.CMB.1.raw
  modified_base (262)..(262): a, c, t, g, unknown or other
  misc_feature (262)..(262): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaanaaaagcctggccaggctcccagactcctcatctatgatgcgtcttccaggccactggcgtcccggcaggttcagtggcagtggtctgggacaggccttcactctcaccatcagcagcctggacncccgaagtnttttgcggttttatactgtcagcagcgtgccgactcggcccctcgacgttcggcggagggaccaaggtcggacagtcaaacgactgtggctgcacatctgtcttcactcttcccgctagtccg

SEQ ID NO: 30564 - DNA, 558 bp, Homo sapiens
  misc_feature: GYAE6OF01DIB8G.40.67.G01.1.454.CMB.1.raw
  modified_base (357)..(357): a, c, t, g, unknown or other
  misc_feature (357)..(357): n is a, c, g, or t
  modified_base (516)..(516): a, c, t, g, unknown or other
  misc_feature (516)..(516): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccgagggccactggcgtcccggcaggttcagtggcaggtggtctgggacnggccttcgactctcaccatcagcagcctggacgcccgaagtcttttgcggttttatactgtcagcagcgtgcccgatcggcccctgaccggttcgggacggagggaccgaagggtcgactacgtacgaaaacggactggtggccgttgacccaaccgtnttccgttggttccttacactttcccttccccgctagttaccg

SEQ ID NO: 30565 - DNA, 520 bp, Homo sapiens
  misc_feature: GYAE6OF01BPYYC.40.67.G01.1.454.CMB.1.raw
  modified_base (495)..(495): a, c, t, g, unknown or other
  misc_feature (495)..(495): n is a, c, g, or t
  modified_base (517)..(517): a, c, t, g, unknown or other
  misc_feature (517)..(517): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacaggccttcactctcaccatcagcagcctggacgcccgaagtattttgtggttttattactgtcagcagcgtgccgactcggcccctgacggttcggcggagggaccaagggtcgacatacaaacgactggtgctgcacntctgtcttcattcctcccgctntcg

SEQ ID NO: 30566 - DNA, 511 bp, Homo sapiens
  misc_feature: GYAE6OF01AJHSK.40.67.G01.1.454.CMB.1.raw
  modified_base (386)..(386): a, c, t, g, unknown or other
  misc_feature (386)..(386): n is a, c, g, or t
  modified_base (437)..(437): a, c, t, g, unknown or other
  misc_feature (437)..(437): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtggtctgggacagcctttcactctcaccatcagcagcctggancccgaagattttgcggtttatactgtcagcagcgtgcccgactggcccctnacgttcggcggagggaccaaggtggaacatcaaaacgactgtggctgcaccatctgtcttcatcttcccgcatc

SEQ ID NO: 30567 - DNA, 601 bp, Homo sapiens
  misc_feature: GYAE6OF01C50VC.40.67.G01.1.454.CMB.1.raw
  modified_base (399)..(399): a, c, t, g, unknown or other
  misc_feature (399)..(399): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggcctcccagactcctcatctatgatgcgtcttccgagggccacgtggccgtcccggccaggttcagtggcagtggtctgggacagtccttcactctcaccatcagcagcctggacgcccgaatnttttgcggttttatactgtcagcagcgtgccgacgtcggcccctgacggttcgggacggtaagggacccgtaagggtcggaactagtaccgaaaacggtacgtcggtacggccttacggacctaaccccgtagttacccgtttcggttaccttttcccgtaaactttcccccgtttacccccgcccgttaactttacccggg

SEQ ID NO: 30568 - DNA, 566 bp, Homo sapiens
  misc_feature: GYAE6OF01CPEFT.40.67.G01.1.454.CMB.1.raw
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggactccgccacgcccccaggaaacgggctccaatgcgttggacatgtcattcttatggcgctccactacagtgcgccctcagagtcgacgccctnatacnccatagaccacgtccaagaacctacgttttcccagacgtctcgacgtctgtcgaccgccgcagaccacggctgtctattattgtgcgagtactacgtccttgtgttaggtcggggtacttgaccgaacccgggtataccgtacctcctaaccgtttcggacttcggactacgttccggtggggcccgaggggtcccttccgggg

SEQ ID NO: 30569 - DNA, 560 bp, Homo sapiens
  misc_feature: GYAE6OF01AZ9L7.40.67.G01.1.454.CMB.1.raw
  modified_base (389)..(389): a, c, t, g, unknown or other
  misc_feature (389)..(389): n is a, c, g, or t
  modified_base (398)..(398): a, c, t, g, unknown or other
  misc_feature (398)..(398): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccaggccactggcgtcccggccaggttcagtggcagtgggtctggggacagcctttcactctcaccatcagcagcctggacncccgaagtnttttgcggtttatactgtcagcagcgtgccgactcggcccctcgaccggttcgggcggaacgggaccaagggtcggaacataccgaaaacggtactcggtgggctggacctaccgattccgtacggttcctttccattcccgtttcccccggctaacttcgg

SEQ ID NO: 30570 - DNA, 603 bp, Homo sapiens
  misc_feature: GYAE6OF01C74EP.40.67.G01.1.454.CMB.1.raw
  modified_base (204)..(204): a, c, t, g, unknown or other
  misc_feature (204)..(204): n is a, c, g, or t
  modified_base (260)..(260): a, c, t, g, unknown or other
  misc_feature (260)..(260): n is a, c, g, or t
  modified_base (360)..(360): a, c, t, g, unknown or other
  misc_feature (360)..(360): n is a, c, g, or t
  modified_base (399)..(399): a, c, t, g, unknown or other
  misc_feature (399)..(399): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcggggccagtcagcatgtggcacctcttagcctggtaccaanaaaagcctggccaggctcccagacctcctcatctatgatgcgtcttccgagggccacgtggccgtcccggccaggttcaggtggcaggtggtctgggacngccttcactctcacatcagcagcctggacgcccgaagtnttttgcgttttatactgtcagcagtcgtcgccgtacgtcggcccctgaccggttcgggacgggacggggtaccaagggtcgaacctagtaaccgaaaacggaacgtggttacgggaccttacgggacccaacccgtagtttccgtttcggttacccctttacgtaacctttccccgtttacccccggccttaaccgtttaccgg

SEQ ID NO: 30571 - DNA, 587 bp, Homo sapiens
  misc_feature: GYAE6OF01CZCMI.40.67.G01.1.454.CMB.1.raw
  modified_base (203)..(203): a, c, t, g, unknown or other
  misc_feature (203)..(203): n is a, c, g, or t
  modified_base (364)..(364): a, c, t, g, unknown or other
  misc_feature (364)..(364): n is a, c, g, or t
  modified_base (546)..(546): a, c, t, g, unknown or other
  misc_feature (546)..(546): n is a, c, g, or t
  modified_base (581)..(581): a, c, t, g, unknown or other
  misc_feature (581)..(581): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcggggccagtcagcatgttggcacctccttagcctggtaccaacaaaagcctggccaggcctcccagactcctcatctatgatgcgtcttccgagggcccacgtggccgtcccggccaggttcaggtggctaggtggtcgtgggacngtccttcactctcacctatcagcagcctggacgcccgaagttcgttttggacggttttattacgtgtcagctaggtcgtgcccgtactccggtacccctcggtaccgttcggggacgggtacgggaccgtaagggtcggaaccagtaacgaaaaccggtacgtggtacggcgtcgccaaccngttccgttagtctttcgacttcccttccccgcgtnttaccg

SEQ ID NO: 30572 - DNA, 536 bp, Homo sapiens
  misc_feature: GYAE6OF01CV6R1.40.67.G01.1.454.CMB.1.raw
  modified_base (261)..(261): a, c, t, g, unknown or other
  misc_feature (261)..(261): n is a, c, g, or t
  modified_base (394)..(394): a, c, t, g, unknown or other
  misc_feature (394)..(394): n is a, c, g, or t
  modified_base (506)..(506): a, c, t, g, unknown or other
  misc_feature (506)..(506): n is a, c, g, or t
  modified_base (532)..(532): a, c, t, g, unknown or other
  misc_feature (532)..(532): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctcttagcctggtaccaanaaagcctggccaggctcccagactcctcatctatgatgcgtcttccgaggccacgtggcgtcccggcaggttcagtggcagtggtctgggacagccttcactctcaccatcagcagcctaggacgccgaagtntttgcggttttatactgtcagcagcgtgccgtactccggcccctcgaccgttcgggacgggacgggaccaagggtcggaacagtaccgaaacggactgtcggctcggacacntcttgtcttcattcccttcccgcctntacg

SEQ ID NO: 30573 - DNA, 611 bp, Homo sapiens
  misc_feature: GYAE6OF01AGUB3.40.67.G01.1.454.CMB.1.raw
  modified_base (324)..(324): a, c, t, g, unknown or other
  misc_feature (324)..(324): n is a, c, g, or t
  modified_base (369)..(369): a, c, t, g, unknown or other
  misc_feature (369)..(369): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggactccgccacgcccccaggaacggggctccaatgcgttgacatgtcaattcttagtgggcnctccactacagtcgccggccctcagacgtcgacgtccctcatacnccatacgaccacgtaccaaagtaaccctacgttttcccagaccgcttggaccgttctcgtcgacccgccgacgacgaccgacggctgtcctagttattgtcgtacgagtactacgtccttcgtggttaggtcggggttacttcggacgtaacccgggtacttaccgtaccgtacccttaccgttcgggtaccttgggaacctcgttccggtaggggcccggtaggggtcccgtttacccggg

SEQ ID NO: 30574 - DNA, 540 bp, Homo sapiens
  misc_feature: GYAE6OF01D63VT.40.67.G01.1.454.CMB.1.raw
  modified_base (204)..(204): a, c, t, g, unknown or other
  misc_feature (204)..(204): n is a, c, g, or t
  modified_base (513)..(513): a, c, t, g, unknown or other
  misc_feature (513)..(513): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctcctctcctgcggggccagtcagcatgttggcacctcttagcctggtaccaacaaagcctggccaggcctcccagactcctcatctatgatgcgtcttccgaggccacgtggccgtcccggccaggttcaggtggctaggtcgggtctggggacaggccttcgactctcaccatcagcacgcctggacgcccgaagtcttttggcgttttatacgtgtcagcagtcgtgcccgactcgggcccctgaccgttcggcggacgggaccgaagggtgacatacgaaacggactggtacggctgcacctntctgttcttcacttcctcccgctgtcg

SEQ ID NO: 30575 - DNA, 526 bp, Homo sapiens
  misc_feature: GYAE6OF01C1DHG.40.67.G01.1.454.CMB.1.raw
  modified_base (261)..(261): a, c, t, g, unknown or other
  misc_feature (261)..(261): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
  modified_base (523)..(523): a, c, t, g, unknown or other
  misc_feature (523)..(523): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaanaaaagcctggccaggctcccagactcctcatctatgatgcgtcttccagggccactggcgtcccggcaggttcagtggcagtggtctgggacaggccttcactctcaccatcagcagcctggacgcccgaagtattttggcggttttattactgtcagcaggtcgtgcccgacgtcggcccctgaccggttcgggcgggacgggaccaagggtcgacatacaaacgactggngctgcacntctgtcttcactcctcccgctntcg

SEQ ID NO: 30576 - DNA, 616 bp, Homo sapiens
  misc_feature: GYAE6OF01A5UQA.40.67.G01.1.454.CMB.1.raw
  modified_base (325)..(325): a, c, t, g, unknown or other
  misc_feature (325)..(325): n is a, c, g, or t
  modified_base (410)..(410): a, c, t, g, unknown or other
  misc_feature (410)..(410): n is a, c, g, or t
  modified_base (490)..(490): a, c, t, g, unknown or other
  misc_feature (490)..(490): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggacctcgtccctcaattgctttgtctctggaacttctatcaagggtagcagcttccacgtggggctggatccgccacgcccccaggaaacgggctccaatgcgttggacatcgtcaattcttatgggcnctcccactacagtcgccggccctccgagacgtcgacgccctcactactccaatacgacacgtaccaaagaacctacgttttcccngaccgtctgacgtctgtcgacccgcgacacgaccgacggtctgtcttatttagttcgtgacgaacgtactagtccctttntaggttaggtacgggggttacttcggacccgtaaacccgggtattaaccgtacccgttcccgaacccggtttcggacgtttcggaactcgttccggtacgggggcccgaagggggtcccttccggg

SEQ ID NO: 30577 - DNA, 535 bp, Homo sapiens
  misc_feature: GYAE6OF01CTC42.40.67.G01.1.454.CMB.1.raw
  modified_base (204)..(204): a, c, t, g, unknown or other
  misc_feature (204)..(204): n is a, c, g, or t
  modified_base (251)..(251): a, c, t, g, unknown or other
  misc_feature (251)..(251): n is a, c, g, or t
  modified_base (373)..(373): a, c, t, g, unknown or other
  misc_feature (373)..(373): n is a, c, g, or t
  modified_base (399)..(399): a, c, t, g, unknown or other
  misc_feature (399)..(399): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctcctctcctgcgggccagtcagcatgtgcactctagctgacaanaaagctgccagctccagactcctcatctatgatgcgtcttccagggccacgtggccgtcccggcaggttcagtggcaggtggtctgggacagtccttcactctcaccatcagcagctggacnccgaagtatttgcgtttatactgtcngcagcgtgccgtacgtcggcccctcgacggttccggacggtacggggaccgtaagggtcgactacgtaccgaaacggtaacgtggtcggcgtcggccaacgtatcttgtccttacacttcccttcccgctacttcg

SEQ ID NO: 30578 - DNA, 584 bp, Homo sapiens
  misc_feature: GYAE6OF01BA62F.40.67.G01.1.454.CMB.1.raw
  modified_base (244)..(244): a, c, t, g, unknown or other
  misc_feature (244)..(244): n is a, c, g, or t
  modified_base (414)..(414): a, c, t, g, unknown or other
  misc_feature (414)..(414): n is a, c, g, or t
  modified_base (463)..(463): a, c, t, g, unknown or other
  misc_feature (463)..(463): n is a, c, g, or t
  modified_base (571)..(571): a, c, t, g, unknown or other
  misc_feature (571)..(571): n is a, c, g, or t
tcagtctagcgactcacgaccggtgctcgatttagagtatacatattgggtttgggggctttctgagagtcatggatctcatgtgcaagaaagtgaagcacctgtgtttcttcctcctgctggtggcggctcccagatgggtcctgtccctgatgcaggtgcgggagtcgggcccaggattggtgaaaccttcggggaccctgtccctcaattgctttgtctctggaacttctatcaagggtancagcttccacgtggggctggatccgccacgcccccgagggaaacggggctccaatcgcgttggacatgtctaatttcttagtgggcgcctcccactacgagtcgccggccctcagacgtcgacgccctacatactccatacgacacgtaccaaagaacctacgtttcccngacgtctacgacgtctgtcgaccgccgcacgaccgcggcttgtctattntgcgcgagtactacgtccttgtggttaggtcggggtacttcggaccgtaaccggtattaccgtaccgtccctaccgttcggaccttaggactagtcggtaggggccgnggggtcctccggg

SEQ ID NO: 30579 - DNA, 699 bp, Homo sapiens
  misc_feature: GYAE6OF01BGWVF.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccgagggcaaagcgcctccctctcctggcggggccagtcagcatgttcggcacctcttagcctggtaaccaacaaagcctggccaggcctcccagacctcctacatctatgatgcgtctccgagggccacgtcggccgtcccggctaggttcaggtggctaggtcgggtcgtggggacacggtcccttacgacctcctaccacctatcgagtccacggtcccgtgggaccgtaccccggtaaaggttacgtttttcgggtaccggtttttaacttacgttcggttaccacggtacgtacggtccgtacggacccggtaccgttcccgggtacccccttcggtaccgggtttaccgggacggggtaacgggtaacccgtaaggggtacggaacctaacgtaaccggaaaaccggtacgtcgggtacggtccgtacgaccctaacccgtcgttcccgttcgttacccttacgtacccgtttaccccgttccccgtcttaacgttaccgg

SEQ ID NO: 30580 - DNA, 651 bp, Homo sapiens
  misc_feature: GYAE6OF01CQO6P.40.67.G01.1.454.CMB.1.raw
  modified_base (335)..(335): a, c, t, g, unknown or other
  misc_feature (335)..(335): n is a, c, g, or t
  modified_base (380)..(380): a, c, t, g, unknown or other
  misc_feature (380)..(380): n is a, c, g, or t
  modified_base (430)..(430): a, c, t, g, unknown or other
  misc_feature (430)..(430): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctccagatgggtcctgtccctgatgcaggtgcgggagtcgggcccaggattggtagaaaccgttcgggaccctgtccctcattgctttgtctctggaacttctatcgaaaggtagcagtcttccacgtggggctggactccgcacgccccgaaggaacgggctaccaatcggcgttggactagtgtactaattcgttagtcgggcnccgtccactacgaggtcgccggccctcgagagtccgacgccctanactactcatacgacaccgtaccaaacgtacctacgttttcccacggtacncgtacgtaccgtcttcggtaccgaacccggcccgtacgaacgaccgaacggtctcgttacttagttagttgtcgacgtactacgtacgtccttgttggtacggtgggtacgttacgaccgtaaacccggtactaaccgttacccgtcccgtaccgttcggtccgttacggtaacctacgttcgggtaccggggacccgggttgggtcccggtttacccggg

SEQ ID NO: 30581 - DNA, 565 bp, Homo sapiens
  misc_feature: GYAE6OF01C5IXQ.40.67.G01.1.454.CMB.1.raw
  modified_base (204)..(204): a, c, t, g, unknown or other
  misc_feature (204)..(204): n is a, c, g, or t
  modified_base (258)..(258): a, c, t, g, unknown or other
  misc_feature (258)..(258): n is a, c, g, or t
  modified_base (393)..(393): a, c, t, g, unknown or other
  misc_feature (393)..(393): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctcctctcctgcgggccagtcagcatgttgcacctcttagcctggtaccaanaaagcctggccaggctcccagactcctcatctatgatgcgtcttccagggccacgtggccgtcccggcaggttcagtggcagtggtctgggacacggccttcactctcacatcagcagcctggacgcccgaagtnttttgcgtttatctgtcagcagcgtgccgactcggccctgaccgttcgggacgggtacgggaccgtaagggtcgaactacgtaccgaaacgtacgtcggtaggcctcggacctaccgtatccgttcggttcctttaccgactttccccgttaccccgtccctagttacccgg

SEQ ID NO: 30582 - DNA, 750 bp, Homo sapiens
  misc_feature: GYAE6OF01A5KNQ.40.67.G01.1.454.CMB.1.raw
  modified_base (201)..(201): a, c, t, g, unknown or other
  misc_feature (201)..(201): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccacctgtccttgtctcagggcaaagngcctcctctcctgcgggccagtcagcatgttggctacctccttagcctaggtaccaaacgaaagcctggccaggcctcccagacctcctcactctatgatgccgttcttccgagggccacgtcggtccgtcccggcctagggttcaggtcggacgtaggttcgggtctacgggggactacggccctttacgaaccgttcctaccgaaccctagtcccgaacggccgaaccggtcccgtacgggtaaccggtaccccggttaaaggttacgtttttttcgggtaacccgggttttttaacttacccgttacggttacccaagggtccgtaacggttcccggttacggtaccccggtacggtttaccccggggccccctttacggggtaacccgggtttcccggggacggggtaaacccgggggaacccgttaaggggttaccggaacgtaacgtaaccgtaaaaccggtactgggtacgggaccgtacgggacccaccgttgtcccgtgttaccttactaaccgttcccgttcccgacgtacgttaccgg

SEQ ID NO: 30583 - DNA, 685 bp, Homo sapiens
  misc_feature: GYAE6OF01DNUYI.40.67.G01.1.454.CMB.1.raw
  modified_base (446)..(446): a, c, t, g, unknown or other
  misc_feature (446)..(446): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtagaaaccgttcggggaccctgtccctcaattgctttgtctctggaacttctatcaagggtagcagcttccacgtggggctggactcccgccacgacccccgaagggaaacggggcctaccgaagtgtcggttcggacattgtactaagtttccttagtcgggccgcctccctaactaccgagtcgccggccctccgagacgtcgacgccctcagtactaccatacgacctacgtaccaaaggtaaccctacgttttacccgngtaaccgtccgtacgtacgtccgtaggtaccgaacccgcccgacgaacgaccgaccgcttagttccttatttagttgtcgacgtagtaaccgttacgttcctttacgttaggttacgggttacggggttaccttacggacccggtaaacccgggtattacccgtactacccgttaccggtttcggtaccgttgggaacctacgttacgggcggggtacccggcggggtccttaccgggg

SEQ ID NO: 30584 - DNA, 600 bp, Homo sapiens
  misc_feature: GYAE6OF01D0PXP.40.67.G01.1.454.CMB.1.raw
  modified_base (203)..(203): a, c, t, g, unknown or other
  misc_feature (203)..(203): n is a, c, g, or t
  modified_base (254)..(254): a, c, t, g, unknown or other
  misc_feature (254)..(254): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctcctctcctgcggggccagtcagcatgtggcacctctagcctgacaanaaagcctggccaggctcccagacctcctcatctatgatgcgtcttccagggccacgtggcgtcccggcaggttcaggtggcaggtcgggtctggggaccagccttcactctcaccatcagcagcctggactcccggaagtagtttttcgacggttttaatacgttgtccagcgtagtcgttcgccgtacctcgggccccctagtaccggttccgggaccgggacggggtaacccaggggtcggaaccagttacccgaaaacggtacctcggtaggtccgtcgaccctaccgtagtttccgtaggtttcccttcctacgttccctttacccccggccttagttcccg

SEQ ID NO: 30585 - DNA, 534 bp, Homo sapiens
  misc_feature: GYAE6OF01BTTL0.40.67.G01.1.454.CMB.1.raw
  modified_base (204)..(204): a, c, t, g, unknown or other
  misc_feature (204)..(204): n is a, c, g, or t
  modified_base (494)..(494): a, c, t, g, unknown or other
  misc_feature (494)..(494): n is a, c, g, or t
  modified_base (505)..(505): a, c, t, g, unknown or other
  misc_feature (505)..(505): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcggggccagtcagcatgttggcacctccttagcctggtaccaacaaaagcctggccaggctcccagactcctcatctatgatgcgtcttccgagggccacgtggcgtcccggcaggttcagtggcaggtggtctgggacaggccttcactctcaccatcagccagcctggacgcccgaagtcgttttgcggttttatactgtcagcagcgtgccgacgtcggccctcgacggttcggcggagggtaccgaaggtcggacagtaccgaaacgactgnggctcgcactntccgtgtcttcactccgtcccgctagtcg

SEQ ID NO: 30586 - DNA, 675 bp, Homo sapiens
  misc_feature: GYAE6OF01EHVLV.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagcccaccctgtccttgtctccgagggacaaagcgccctccctctcctggccggggccagtcagctatgttcggcctaccttccttagcctacggtaaccaaacaaaacgccgtggccaggcctcccagacctcctcatatatgatgcgttcttccgagggccacgtcggccgtcccggctaggttcagtggcgtaggtcggtcgtgggactacggtcctttacaccttccgtacacctatccgaacgccaacgtcccgtagggaaccgtacccggtaaagttcgtttttcggtacggttttaattacgtgtaccacgtcgacggtccgtcgacccggtacgttcccggaccccttcggtaccgggtccgggaccgggaacgggtaccgtaaggggtcgaacgtacgtaacgaaaccggtacgtcgggtacggaccgtcgaccctaacctcggttccttacggttcccttactaccgttccccttaccccgctacgttaccg

SEQ ID NO: 30587 - DNA, 512 bp, Homo sapiens
  misc_feature: GYAE6OF01EIKQR.40.67.G01.1.454.CMB.1.raw
  modified_base (490)..(490): a, c, t, g, unknown or other
  misc_feature (490)..(490): n is a, c, g, or t
  modified_base (495)..(495): a, c, t, g, unknown or other
  misc_feature (495)..(495): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccatgtccttgtctccagggcaaagagcctccctctcctgcggggccagtcagcatgttggcacctccttagcctggtaccaacaaaagcctggccaggctcccagactcctcatctatgatgcgtcttccagggccacgtggcgtcccggcaggttcagtggcagtggtctgggacagccttcactctcaccatcagcagcctggacgcccgaagtattttgcggttttatactgtcagcagtcgtgccgactcggcccctgacggttcggcgggtagggaccaaggtgacatcaaacgactgtggctgcncatcngtctcatcctccgctac

SEQ ID NO: 30588 - DNA, 810 bp, Homo sapiens
  misc_feature: GYAE6OF01ACJUY.40.67.G01.1.454.CMB.1.raw
tcagtctagcgactcacgaccggtgctcgatttagagtatacatattgggtttgggggaggaactgctcagttaggacccagagggaaccatggaacgccccagcccagcttctcttcctcctgctactctggctcccagcagccaccggagaagttgtcctgacacagtctccagcccaccctgtccttgtcctccaggggcaaagcgccctccctctcctggccggggccagtcagcatgtggcacctcttagcctggtaccaacaaagcctggccacggcctcccgagacctcctcatctatgactcgccgtcttccgacgggccacgtcggccgtcccggccaggttccaggtcggcgtaggtcgggtctagggacacggtcctttcgacctcctacaccatccagccacgccgtcgggaccgtacccggtaagttacgtttttcggtaccggtttttaacttaccgttcgtaccgtacggtacccgtaagggtcccggttaccggtaccccgtaaccggttcccgggtacccccccgttacggttaacccgggggtttacccgggggaccggggtaaacccgggggtaaccggttaaaccggggttaccgggaacccgttaaccggtaaacccggtaaaaacccggggtaccgtttaaccggggtaccgggttaccccgttaccgggtaaccccttaacccggttacccgttttacccggtttacccggttttaccccttttaccccgttaacccgttttccccccgtttacccccggtacccgttaacggttttaaccccgggg

SEQ ID NO: 30589 - DNA, 528 bp, Homo sapiens
  misc_feature: GYAE6OF01D7H6Q.40.67.G01.1.454.CMB.1.raw
  modified_base (504)..(504): a, c, t, g, unknown or other
  misc_feature (504)..(504): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcgggccagtcagcatgttgcacctcttagcctgtaccaacaaagcctggccaggctcccagactcctcatctatgatgcgtcttccgagggccactggccgtcccggcaggttcagtggcaggtggtctgggacagccttcactctcaccatcagcagcctggacgcccgaagtctttttcggcggttttattacgtgtcagcagtcgtgccgactcggcccctgaccggttcggacggacgggacagggtcgacagtacgaaacgacgtcgtggctgcactgtctntccttcacttccttcccgctatcg

SEQ ID NO: 30590 - DNA, 615 bp, Homo sapiens
  misc_feature: GYAE6OF01D3NAA.40.67.G01.1.454.CMB.1.raw
  modified_base (204)..(204): a, c, t, g, unknown or other
  misc_feature (204)..(204): n is a, c, g, or t
  modified_base (259)..(259): a, c, t, g, unknown or other
  misc_feature (259)..(259): n is a, c, g, or t
  modified_base (380)..(380): a, c, t, g, unknown or other
  misc_feature (380)..(380): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcgggccagtcagcatgttgcacctcttagcctggtaccaanaaaagcctggccaggcctcccagactcctcatctatgatgcgttcttccagggccacgtcggccgtccccggctaggttcaggtggcaggtgggtctggggacaggtcctttactctcacntcagcagcctgggacgcccgtaagtactttttggacgggttttaattacgttgtacaggctaggtccgtggcccgacgtccggccccttcgaccggtttccgggacgggtacgggaacccgtaagggtcggaacctagtaccgaaacggtacgttggtcggactcggacctacgtagttccgttacgttcctttaccgtactttccccgttaccccggacctagttccgtaacgg

SEQ ID NO: 30591 - DNA, 737 bp, Homo sapiens
  misc_feature: GYAE6OF01B8OVD.40.67.G01.1.454.CMB.1.raw
  modified_base (209)..(209): a, c, t, g, unknown or other
  misc_feature (209)..(209): n is a, c, g, or t
  modified_base (242)..(242): a, c, t, g, unknown or other
  misc_feature (242)..(242): n is a, c, g, or t
  modified_base (307)..(307): a, c, t, g, unknown or other
  misc_feature (307)..(307): n is a, c, g, or t
  modified_base (325)..(325): a, c, t, g, unknown or other
  misc_feature (325)..(325): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctnaattgctttgctctggaacttctatcaagggtncagcttccgagtggggctggactccgccacgcccccgaggaacgggctccgaagtcgcgttgacngtgtcattctagtgggcnctcccacgtacagtcgcggccctcgagacgtcgaacgtccctgtactactccaagttacgaacctaccggttaccaaacggtaacccgttacggttttacccaggtaaccggtcgttacggtaccgttccgttacggtaccggtacccgtaccggtccgtaacggaccgtaaccgggtccgttcggttaccttacgttttacgttcggtacggtaccgtaacggtaccttaggttccctttacggtacggttacgggttacgggggttaccctttacggaccccggtaaacccgggtaacgttaacccgttccgttaacccgtacccggtttcccgggtaccgtttaggacccgtacggtttacccggtacggggggaccccgttaacgggggtcccgtttaaccccggggg

SEQ ID NO: 30592 - DNA, 523 bp, Homo sapiens
  misc_feature: GYAE6OF01DQ5I8.40.67.G01.1.454.CMB.1.raw
  modified_base (261)..(261): a, c, t, g, unknown or other
  misc_feature (261)..(261): n is a, c, g, or t
  modified_base (493)..(493): a, c, t, g, unknown or other
  misc_feature (493)..(493): n is a, c, g, or t
  modified_base (517)..(517): a, c, t, g, unknown or other
  misc_feature (517)..(517): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctcttagcctggtaccaanaaaagcctggccaggctcccagactcctcatctatgatgcgtctccaggccatggctccgcaggtcagtgcagtggtctgggacagccttcactctcaccatcagcagcctggacgccgaagtatttttgcggttttaatacgtgtcagcagcgtgcccgtactcggcccctgaccggttcggacggagggaccaaggtgaacatacaaacgactggtacgctcgcaacgtnttcgtgtcttcacttccttcccgntagtcg

SEQ ID NO: 30593 - DNA, 641 bp, Homo sapiens
  misc_feature: GYAE6OF01BK48M.40.67.G01.1.454.CMB.1.raw
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctggcgggccagtcagcatgttggcacctccttagcctggtaccaacaaagcctggccaggctcccagacctcctcatctatgatgcgtctccgagggccacgtggccgtcccggcaggttcaggtcggctaggtggtctgggacacggcttcactctcacatcagcagcctggacgacccgtaagtcttttggtacggttttattacgtgtaccgagtaccgtacggtccgtcgacccggtaccgtccggaccccccgtttgacccgggtttaccggggaccggggtaacggggtacccgaaggggttcggaactacgttaacccgaaaacgggtacttgggtacgggtcctcggtacccaaccgttattcccgttagttcccctttacgtaccgtttacccctttccccggccgtacgttaccgg

SEQ ID NO: 30594 - DNA, 762 bp, Homo sapiens
  misc_feature: GYAE6OF01DWQV7.40.67.G01.1.454.CMB.1.raw
  modified_base (268)..(268): a, c, t, g, unknown or other
  misc_feature (268)..(268): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccgagggcaaagcgcctccctctccgtggcggggccaggtcagcatgttgcacctctagcctagacaacaagccgngccagctccagacctcacatctatgatcgcgttctccgaggtccacgtcggccgtcccggcctaggttcgaggtcggcgtaggtcgggtcgacggggactacggtccttacgaccttcgtaccaaccgtactaccgacgtacgaccggtcccgtaggggaacccgtacccggtaaggttacgttttttacggtacggtttttaattaaccgttcggtacctaacgggtcgtacggtccgggttaccgtacccggtacccgttcccggtcccccttacgggtaacccgggtttccggggggaacccggggtaaacggggtaaccccgttaaagggggtacccgaaccgttaaacggtaaacccggtaaaaaaccgggtcccgttcggggtacggtacccgtcggaaccctaacccgttaccggtttcgtacccgggttttacccttaaccttacccgtttcccccggttaccccccggtattccgttaacccggg

SEQ ID NO: 30595 - DNA, 583 bp, Homo sapiens
  misc_feature: GYAE6OF01DW5SD.40.67.G01.1.454.CMB.1.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
  modified_base (362)..(362): a, c, t, g, unknown or other
  misc_feature (362)..(362): n is a, c, g, or t
  modified_base (381)..(381): a, c, t, g, unknown or other
  misc_feature (381)..(381): n is a, c, g, or t
  modified_base (577)..(577): a, c, t, g, unknown or other
  misc_feature (577)..(577): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcggggccagtcagcatgttggcacctccttagcctggtaccaanaaaagcctggccaggcctcccagacctcctcatctatgatcgcgtctccgaggccacgtggccgtcccggctaggttcagtggcaggtggtcgtgggacncggtccttcactctcaccntcagcacgcctgggacgacccgtaagttcgttttggacggttttatacgtgtaccagcacggcgttacggcccgtacgtccggtccccctggacccggtttcgggaccgggaagggtacccgtaagggtcggaactagtaccgaaacgtacgtggtacggctacgacacctgttcctgttcttcacttcctacccnctatcg

SEQ ID NO: 30596 - DNA, 533 bp, Homo sapiens
  misc_feature: GYAE6OF01CLQK5.40.67.G01.1.454.CMB.1.raw
  modified_base (527)..(527): a, c, t, g, unknown or other
  misc_feature (527)..(527): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatattggcacctcttagcctggtaccaaacaaaagcctggccaggctcccagactcctcatctatgatgcgtcttccgaggccacgtggcgtcccggcaggttcagtggcaggtggtctgggacagccttcactctcacatcagcagcctggacgcccgtaagtattttggacgttttatactgtcagcagcgtgcccgactcggcccctgacggttcggacggacgggaccaagggtcgaacatacgaaacgtactggtcgctcgcacgtatctagttctacattccttcccgntagtcg

SEQ ID NO: 30597 - DNA, 857 bp, Homo sapiens
  misc_feature: GYAE6OF01DWZ4M.40.67.G01.1.454.CMB.1.raw
  modified_base (326)..(326): a, c, t, g, unknown or other
  misc_feature (326)..(326): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtgcggctccagatggtccctgtcctgatgcaggtgcgggagtcggccaggattggtgaaaccgttcgggaccctgccctcaattgcttgtctctggaacttctatcgaaggtcgcagcttcgacgtggggactggactccgcccagccccgaggaacgggctccaagtgcgtaggactgtagtcttaattcgtagtcgggccnccgtacctacgtacgtacgtcgcccgaccgtacgaggaacgtccgactaccctactaactacttaccgaaacgtaccgtaaacccgtaaaccgtaccgtaaaaccggttaaaccccgtttacggttttaccccgtacggtaaccggtacccgttaaccgggtcccggtttaccgtacccgggtaacccggaacccggacccggttaaccgaaaccggtaacccgttacggttaccgttaacggttttaccttaacggtttttacgtaccgggttacgggtaaccgttaaaccggttaacccggttttaaccgttacccgggttttaacgggttacgggggttttaaccgggttaccgggggttaacccgttaccccggggtaaacccggttaaaccccgggtaaaacctttaccccgttaacccggtaccccgtttaaccggttcccggttaaaccggttacggtacccggtaccgggttacccggggttaccggtccccggggttaccgggtcccggttttaccccgggg

SEQ ID NO: 30598 - DNA, 603 bp, Homo sapiens
  misc_feature: GYAE6OF01ELNPQ.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctggcggggccagtcagcatgtgcactcttagcctgtaccaacaaagcctggccaggcctcccagacctcctcatctatgatcgcgttcttccgagggccacgtcgggccgtcccggcctagggttccaggtcggcaggttcgggtctggggacacggtcctttcactctcacatcagcagtccgtaggacgcccgtaagtcgtttttcggacggttttaattacgttgtacgtagcgtacggtcgtcggccgtacgtcggcccctcgtacggttccgggacgggacgggaaccgtagggtcggaccagtaccgaaacgtacgtggacggtacgtcgaccaccgtattccgttagtcctttacacttccccgttcccgcctagtaccg

SEQ ID NO: 30599 - DNA, 690 bp, Homo sapiens
  misc_feature: GYAE6OF01AZI3B.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccgttcggggaccctgtccctcaattgctttgtctctggaacttctatcaaggtagcagcttccacgtggggctggactccgccacgccccgaaggaaacgggcctaccgaagtggcgttggacagtcgtactaatttcgttagtcgggccgcctcccactacgaggtcgccggccctccgagacgtcgacgccctcactactccaagtacgacaccgtaccaaacgtaaccttacgtttcccagacgtctaggaccgttcgtgtacgacccgccgacaacgaccgacggtcttacgttaccttatttacgttggtacggaccgtaacgtaccgttacgttcccttttaggtcggtttaacggggttcggggttaactttccgggacccgttaaacccgggttattaacccgtacccgttaccccgtacgtttccgggtacgtttacggaacgttcggtaccgggttacgggggcccgggtacggggttccccgttccgggg

SEQ ID NO: 30600 - DNA, 668 bp, Homo sapiens
  misc_feature: GYAE6OF01CJBO4.40.67.G01.1.454.CMB.1.raw
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagcccaccctgtccttgtctccgagggcaaagcgccctccctctcctggccggggccagtcagcagtgttgcactcctagcctggtaccaanaaagcctggccaggctaccagactcctnatctatgatgtcgtctccgacggtccacgtcggaccgtcccggacctagggttacgaggtcggacgtacggttcgggacttggggaacctacggtccctttacgaacctttcgtaccgtaaacccaagttccaacggtacctaacggtcccgtagggaaccgtaccccggtaaagttctttttacgggacccggttttaatacgtggtacaacggtcgaagtccgtacgccgtacgtcgacccctcgtacggttccgggacggtaacgggaccctaagggcgaactacgacgaaaacgtaccgtgggtacgcgttacgaccgtaccctgtaccgttgttacccttacgaacccttccgtccccgattcgtaccgg

SEQ ID NO: 30601 - DNA, 550 bp, Homo sapiens
  misc_feature: GYAE6OF01BNICK.40.67.G01.1.454.CMB.1.raw
  modified_base (407)..(407): a, c, t, g, unknown or other
  misc_feature (407)..(407): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (469)..(469): a, c, t, g, unknown or other
  misc_feature (469)..(469): n is a, c, g, or t
  modified_base (493)..(493): a, c, t, g, unknown or other
  misc_feature (493)..(493): n is a, c, g, or t
  modified_base (536)..(536): a, c, t, g, unknown or other
  misc_feature (536)..(536): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccacgcccccaggaaacggggctccaatgcgttggacatgtcaatttcttagtgggcgcctcccactacagtgccggccctccagacgtcgacgccctcatactccaatacgacacgtaccaagaacctacgtttcccngacgctgacgtctgtcgaccgcgcagacgcggctgtctattnttgngcgtagactgtccttntggtaggtgggtactgcaaccggntaccgtacctcaccgttcgcgttcgactagtctagggggccgnggggtcccttcggg

SEQ ID NO: 30602 - DNA, 696 bp, Homo sapiens
  misc_feature: GYAE6OF01DW4ER.40.67.G01.1.454.CMB.1.raw
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccgagggcaaagacgccctccctctccgtgccggggccagtcagcagtgttcggcctaccttccttagcccgtaggtaacccaaacgaaaacgcctacggcccgaggcctcccagtacctccctcatcctatgatcgcgttccttccgacgggcctacgtcggccgtcccggcctaggttcaggtcggcgtagggtcgggttcgtacggggactacggtccctttcaccgttcctaccgacctatccgacgccacggtccgtacggacgacccggtaagttcgttttcgggtacgttttaattcgtcgtacgacgtcgagtccgtcgacccgtacgttccggaccccttcggtaccgggttaccgggaccgggaaccgggtaccggtaacgggtacgaactaaccgtaacgaaaaccggtacggttacggtacggtcgtacgtaccaccgttcgtccgttacgttccttacgtcccgtttaccctccccgttactccgttaccgg

SEQ ID NO: 30603 - DNA, 1163 bp, Homo sapiens
  misc_feature: GYAE6OF01CAE19.40.67.G01.1.454.CMB.1.raw
tcagtctagcgactcacgaccggtgctcgatttagagtatacatattggggtttgggggctttctcgagagtcatggatctcatgtgcgaacgaaagtgaagcacctggtggttcttcctcctgctggtggcggcctccgagactgggttcctgtccctgactgctagggtcgcggggtacgttcccggggtccccaacgggtagttttcgggttacggtaaaaccccgttttcccggggggtaaccccctttgggttcccccggttacgtaaaacttttcgggtacccgttttttccggtaccctttccgtttaccggggttaaaccctttttccgttaaccggttacccgtaaaaggggggtttaccgaccgtaaacggttccgtttttaccccgtaacgggtttggggggtccgttacgggtaacgttccccggacccgaaccggacccccccggtaaaagggggaaaaacccggggggtacccttaccccgtaaaacgttccggttaccgggttttacgggaaccttaacggtttacggttaaccgttaacgtttttaccgttttaaagggtttaccgggggaacccggttccccgggtttaacccccctaaacgtttaacccggtaagggtttcccggtaccccgggtacccccgttaccggaacggggttaaccggttaccgggtaaccgtaccccccgttaacggtaaactttaaccgttaacccctaaacgttaaccggtaaacccctaaacccggttaacccctaaaaaccggttaaaccccgtttaccggttttttacccccgaacgggttacccggtacccgttacggtaacccggtttccggttacggttaaccggtaaccccggttacccgttaccgtaaaccggttaacccgttaccgggtccttacgtttaaccgtttaaagttttacgtttacggttacggtaaccggttaaccggtaccgtttaacggttcccgttttacgggtacgggttaacggggttccgggggttaactttacgggaacccggtaaacccgggtaaacttacccgttaccggttaccctaccggtttccggtaccgttaacggtaaccttacggttccgggttaccgggggcccggttaccggggttccccgttacccgggg

SEQ ID NO: 30604 - DNA, 599 bp, Homo sapiens
  misc_feature: GYAE6OF01A7EBS.40.67.G01.1.454.CMB.1.raw
  modified_base (204)..(204): a, c, t, g, unknown or other
  misc_feature (204)..(204): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcggggccagtcagcatgttggcacctccttagcctggtaccaaacaaagcctggccaggctcccagactcctcatctatgatgcgtcttccgagggccactcgggccgtccccggcctagggttcaggtcggcaggtggtctggggactggcctttcgactctcacctatcacgcacggcctggacgcccggtaaagttcttttcgggtacgttttattacgtggtcggacgtacggcgtcgccgtacgtcggcccctacgtacggttccgggcgggtacggaccgtaagggtcgtacgataccgaaacgtacgtggtcggactaccgcctactattcgtcgttccttcctacttcccgttccccgcttagtccgtaacgg

SEQ ID NO: 30605 - DNA, 753 bp, Homo sapiens
  misc_feature: GYAE6OF01EH1X5.40.67.G01.1.454.CMB.1.raw
  modified_base (204)..(204): a, c, t, g, unknown or other
  misc_feature (204)..(204): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngccctccctctcctgcggggccagtcagcatgttggcacctccttagcctggtaccaacaaagcctggccaggcctcccagactcctcatctatgatgcgtctccgagggccacgtcggccgtcccggctagggttcaggtggcgtaggtcgggtcgtggggacaggtccctttacgaccttcctaccaaccctacttccgaaggcccgaacggtcccgttaggggaacccggtacccccggtaaaagggtttacgtttttttacgggtaccgggtttttttaaacttaaccggtttcggtttacccgaacgggtcccgtaacgggtcccggtttccggacccccggtacggtttcccgggcccccccgtttacggtaacccggggtttccggggaccgggggtaacgggggtaacccgttaaacgggggttcggaaaccgtagttaaccggaaaaccggtacgttgggtacggtccgtcgaccgtaaccgtcttccgttcgttaccctttcgtaccctttccccgttacccccgcttaacgttaccgg

SEQ ID NO: 30606 - DNA, 542 bp, Homo sapiens
  misc_feature: GYAE6OF01AUWJ8.40.67.G01.1.454.CMB.1.raw
  modified_base (513)..(513): a, c, t, g, unknown or other
  misc_feature (513)..(513): n is a, c, g, or t
  modified_base (539)..(539): a, c, t, g, unknown or other
  misc_feature (539)..(539): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctcttagcctggtaccaacaaaagcctggccaggctcccagactcctcatctatgatgcgtcttccagggccacgtggccgtcccggccaggttcaggtggcaggtggtcgtggggacagtccttcactctccaccatccagcacgcctggacgcccgtaagtacttttggcggttttactactgtcagctagcgtgccgactcggcccctgaccggttcgggcggacgggaccagggtcgacatcgaaacgtactggcggctgaccaccntcctgttcctcacttccctcccgctntcg

SEQ ID NO: 30607 - DNA, 808 bp, Homo sapiens
  misc_feature: GYAE6OF01CATGC.40.67.G01.1.454.CMB.1.raw
  modified_base (263)..(263): a, c, t, g, unknown or other
  misc_feature (263)..(263): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtcctccgagggcaaagcgcctccctctccgtggccgggccagtcagcatgtcgcacctctagcctggtaccaanaaacgctgccaggcctccagacctcctcatcgtatgatcgcgttcttccgacgggtccacgtcggccggtccccggacgtacggttcgaggtcggacgtagggtcgggtcgtacggggactacggtcccttcgacccttccgtaccaccctaagtcccgaacggtacccgaccggtcccggttacggggaaccggtaacccccgggttaaaggtttacgttttttacgggtaccgggtttttttaaacttaccgttacggttccgtaacgtccggtaacggtccgggttccggaccccggttaccgtcccgggtaccccccgttacggtaacccggggtttacccgggacccgggggtaacggggtaaccccgggtaaaggggttccggaaccgtaaccgtaaacccggtaaaaccggtaacggttcgggtaacgggtccgttccggaacccgtaacccggttcgttcccggtttactttaccccgttttacccgaacccgtttccccgttaacccccggttacccgttaaccggtttaacccgg

SEQ ID NO: 30608 - DNA, 623 bp, Homo sapiens
  misc_feature: GYAE6OF01AQG3K.40.67.G01.1.454.CMB.1.raw
  modified_base (334)..(334): a, c, t, g, unknown or other
  misc_feature (334)..(334): n is a, c, g, or t
  modified_base (419)..(419): a, c, t, g, unknown or other
  misc_feature (419)..(419): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccacgtggggctggactcccgccacgcccccgaagggaaacggggctccaagtgcgttggacatgtcaattcgttagtcgggcncctcccactacagtcgccggccctcagacgtcgacgccctcactactccatacgaccacgtaccaaagtaacctacgttttcccngaacgtctagaccgtctgtcgacccgccgacacgacaccgggtctcgttacttatttagttcggtcgcgtaacgtacgtacgtccgtttcgtggttacgggttcggggtacttcggaccgtaacccgggtataccgtaccttcccgtaccgttcggccgttaggacctgttccggacggggcccggtcggggtcccgttccggg

SEQ ID NO: 30609 - DNA, 786 bp, Homo sapiens
  misc_feature: GYAE6OF01B493J.40.67.G01.1.454.CMB.1.raw
tcagtctagcgactcacgaccggtgctcgatttagagtatacatatggggttggggaggactgctcagttaggacccagagggaaccatggaacgcccagcccagcttctcttcctcctgctactctggctcccagcagccaaccggagaagttgtcctgacacagtctccacgccacctcgtccttcgtctccgaggggacgaaaagcgtccctaccctctccgtggccgggccagtcagcagtcgttgcctacgtcttacgctaggtaaccaaacgaacgtccgtacggaccaaggtacctacccgacggtacctcctacgtacttccgtaagttccgaactcgtccgttactccggacggtcccaccgtcgggcccgtcccggcgtacggttcacggtcggacgtaggttcgggtaccgagggacctaggtcccttacgaccgttccgtaactaacctacgtaccgaccgtcgtaacgcccggttaacgggacgtaacccgtaaggtttacggtttacggtacccgggttttaaataccggtagtaccgtaacggtcccgtagggccccttcgggaacccgttacgttacccgggtaccccttaacggtaccgggggttaccgggacccggggttaaaccgggaaccggttaacggggttacctaacggtacccgggtaactaaaacggggtcccgttaggggaacccgttacgagaacccgtaacgtaacgttccgtacggtttaccttacccgcttaccccgtcccgtagttacttccggg

SEQ ID NO: 30610 - DNA, 811 bp, Homo sapiens
  misc_feature: GYAE6OF01CJOIW.40.67.G01.1.454.CMB.1.raw
tcagtctagcgactcacgaccggtgctcgatttagagtatacatattggggttgggggctttctgacgagtcactggatctcatgtgacaagaaacgtgaagcacctgtgttcttcctcctgctggtcggcggctcccagattcgggttcctgtccctgatgccgaggtggcgggacgtccgggcccaggtattggtacgtaaaccgttccgggggaccctcgtccctcgtaagttgtctttggtctacgtaggtaacttcgtagtcggaaggtagtcagtcctaccgagtgggtctcggactccgcacgacccgaaggaacggctacagtcgcggtgactagtcgtactacgtcgttacgtcgggtccgtactaccccgtagtacggtacgtccgtacccgaccctacgtagggtaccgtccgaaccgtacccgagtaactacgtactaaacgttacgaaaccgtaccggtaaccgaaaccgtacccgttacgtttcccacggtaccgtacggttacgccgtacgttacggccgtacccggaccgtacgaaccgtaccggtaacccgtgttaccgttactttaacgttagttacgggtaccgaacggtacggttaccgtttaacccgggttccgtttacgggtaacgggttaaccggggttacggggtttaaccgttccggaaacccggttaaaccgggttcttaacccggtaaccgttcccggttaaccggttcccgggtacggttaccggaaccgtcgggttacccggtccggggggacccggttccggggtccccggtttaccgggg

SEQ ID NO: 30611 - DNA, 905 bp, Homo sapiens
  misc_feature: GYAE6OF01DK4YQ.40.67.G01.1.454.CMB.1.raw
  modified_base (255)..(255): a, c, t, g, unknown or other
  misc_feature (255)..(255): n is a, c, g, or t
  modified_base (294)..(294): a, c, t, g, unknown or other
  misc_feature (294)..(294): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccacctgtccttgtctccagggcaaagagcctcctctcctgcgggccagtcagcatgtgcacctcttagcctgtaccaanaaaagccgtcgacgctccacgactcctcactactactgntagtccgtcgtttccctacgggccgaacctcgggtcggtccccgggtcccgtacgggttaccgtacggtacggggtcgacgggttacgggggttccggttacgggggtaccggtaaacgggtccccgttttacccggttaacccttacccggtttaccctaaacccccgtaaccggtttaccaaccgggtacccgaacggtaccccggttccggggtaacgggtaacccccggtaaacgggttaaacgttttttacgggtttaccgggtttttaaaccggtttttaacctttacggttaccgtacggtaaccgtacggtaccgggttccgggtacccggtaaccccggtttcgggtaccccccccgttacccggttaccgggtttaccccgggggtacccgggggtaaaccggggggtaaccccggtaaacgggggttaccggtaaccggtaacgttaccggtaaaaaacccggtaaacccggttacgggttacgggttacccgggttacggacccgtaaccccggtaactttaccggttcggtttaacccgtttccttaaccggttaccctttcccccccggtaaccctaccgtttcgttaaaccccggg

SEQ ID NO: 30612 - DNA, 535 bp, Homo sapiens
  misc_feature: GYAE6OF01AXFVF.40.67.G01.1.454.CMB.1.raw
  modified_base (498)..(498): a, c, t, g, unknown or other
  misc_feature (498)..(498): n is a, c, g, or t
  modified_base (509)..(509): a, c, t, g, unknown or other
  misc_feature (509)..(509): n is a, c, g, or t
  modified_base (515)..(515): a, c, t, g, unknown or other
  misc_feature (515)..(515): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctcttagcctggtaccaacaaagcctggccaggctcccagacctcctcatctatgatgcgttcttccgagggccacgtcggcgtcccggcaggttcaggtggctaggtgggtctggggacacggtcctttcgactcgtcaccatcagccagcctaggacgcccgaagtcgttttgacggttttaatcgtgtcagcagcgtcgccgacgtcggccctgaccgttcggcggacgggacaggtgacagacgaacgctgngctcgacacgntccgtntctcactcctcccnctntcg

SEQ ID NO: 30613 - DNA, 665 bp, Homo sapiens
  misc_feature: GYAE6OF01C0XUM.40.67.G01.1.454.CMB.1.raw
  modified_base (383)..(383): a, c, t, g, unknown or other
  misc_feature (383)..(383): n is a, c, g, or t
  modified_base (425)..(425): a, c, t, g, unknown or other
  misc_feature (425)..(425): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaagcctggccaggctcccagactcctcatctatgatgcgtctttccagggccactggccgtacccggccacggttcgagtggcagtgggtctgggacagccttcactctcaccatcagcncgctcggagcccaagatttttcgcgggtttttattaccgttntcgagtcgacgacggtcgtcccggacttcgggccccccgttcgaacccggtttcgggtacccgggacggggtaacccgaacggggttcgggaaccgtaagtacccgaaaaccgggtaaactaccggttggggtaaccgttccggtacggtaacccccgtaaagtttcccgtttacggttaccgttttaccccgttacttacccgtttttccccccccggcccgttaaccgtttaacccgg

SEQ ID NO: 30614 - DNA, 713 bp, Homo sapiens
  misc_feature: GYAE6OF01ES28X.40.67.G01.1.454.CMB.1.raw
  modified_base (203)..(203): a, c, t, g, unknown or other
  misc_feature (203)..(203): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcggggccagtcagcatgttggcacctccttagcctggtaaccaaacaaacgcctggccaggcctcccagacctcctcatctatgatgcgtcttccgagggccacgtcgggccgtccccggctagggtttcaggtcggctagggtgggtcgtggggactacggtcctttcactccgtaccaccagtccagccacggtccgttagggaccgtaccccggtaagttacgtttttcgggtacggtttttaacttaacgttcgtaccgggggaactccgtaacggtcccggttacggaccccgggtaccgttcccgggtccccccttacggtaacccggggtttcccggggaccggggtaacgggggaacccgtaaaggggtcggaacctaacgtaaccgtaaaacggaaccggttcgggtacggtccgtacggacctacccgtacttccgttcgttacccgtttcctacccttaccccgttacccgccttacgttaccgg

SEQ ID NO: 30615 - DNA, 638 bp, Homo sapiens
  misc_feature: GYAE6OF01EIGWQ.40.67.G01.1.454.CMB.1.raw
  modified_base (203)..(203): a, c, t, g, unknown or other
  misc_feature (203)..(203): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcgggccagtcagcatgttggcacctcttagcctggtaaccaacaaacgcctggccacggcctcccagactcctcatctatgatcgcgttcttccgagggccacgtcggccgtcccggcctaggttcaggtcgcgtaggtcggtcgtggggactacgtcccgtttcacgttcctaccaccactccgagccaggtcccgtagggacgtacccgtaagttagtttttcgtacgggttttaatacgttgtacaggtcgagtccggtcgacccgtaccgttccggtcccctcggtaccggttccggggacgggacgggtaccgtaagggttcgaacctagtaccgaaacgtacgtcggtacgggcgtacgaccaccgtgttcccgtagttaccctttcacctttccccgttcccgcgtacgttccg

SEQ ID NO: 30616 - DNA, 789 bp, Homo sapiens
  misc_feature: GYAE6OF01CHHWF.40.67.G01.1.454.CMB.1.raw
  modified_base (694)..(694): a, c, t, g, unknown or other
  misc_feature (694)..(694): n is a, c, g, or t
  modified_base (779)..(779): a, c, t, g, unknown or other
  misc_feature (779)..(779): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctccagcagccacggagtagttgtcctgacacagtcctccagccctacccgtgtccttgtccgttcgagggtcaaagcgtccctccctctccgtggccgggccagtcagctagttggtacgcctaccttcgttacgccgtaggtaaccaaacgaaacgccgtacggccgtaacggtcctacccgacggtacccttccgtactacgttactagttacgtaacgttcgtaccgtttccttaccggaacggggtccctaacggttcgggtccccgttacccgggacgtacgggtttacgaacggtcggcgttacggggttcggttcgtacgggtaacctacgttcccgttacgtacccttaccgtaaccgtaccgtaagttacccgaaggtacccgtaccggttaccgttacgggtacccgtaaccggtttaacgttttacggtttttacgggtaccgttttaacttacggtcgtacgcgtacgtacggttccgtaccggtccgttacggtccccggtaccctggtttacccgggtacgggaccggaaccgggtacgtacgggtanacccgtaacttaacgggaaactcggttcggacgtcgttacgacctaacctgtttaccgtcgttctacctactttacccgtcccgnttcggttacg

SEQ ID NO: 30617 - DNA, 685 bp, Homo sapiens
  misc_feature: GYAE6OF01D81JP.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccgttcggggaccctgtccctcaattgtctttgtctctggtaacttctatcgaagggtagcagcttccacgtggggctggactcccgccgacgacccccgaagggaaacgggcctaccaagtcggcggttaggacatcgtactaatttcttagtcgggccgtcctacccactacgaggtcgccggccctacgagacgtccgacgccctacatactccatacgaccaccgtaccaaacgtaccttacgtttccctagaccgtctcggtacgtctggtaccgacccgtccgacacgaccgccggtctagttccttaatttagtcgtcgacgtagtaccgttacgtccctttagtggttacgggtcgggggttaacttcgggaccgtaaacccgggtacttaaccgttacccgtacccgttacccggtttccggtacgttacggtaacctacggttccgggtaccgggggtcccggtaccgggggtcccgtttcccgggg

SEQ ID NO: 30618 - DNA, 671 bp, Homo sapiens
  misc_feature: GYAE6OF01ERPP2.40.67.G01.1.454.CMB.1.raw
  modified_base (290)..(290): a, c, t, g, unknown or other
  misc_feature (290)..(290): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttggtcctgacacagtctccagccaccctgtccttgtctccagggcaaagagcctcctctcctgacggggccagtcagcatgttgcacctctagcctggtaccaacaaagcctaggccaggcctcccagacctcctnatctatcgatcgcgttcttccgagggtccaacgtgggtaccgtccccgctaggttcaggtggccaggtcggtcgtgggacacggtccttcaacgtcctccaaccctatcgagccgacgtcccgtagggacctacccggaagttacgtttttcggacggtttttaactacgttgtacacggtccgtaggtaccgttcgacccggttaccgtccgggtcccccttacgacgggtttccgggaccgggtaacggggtaccgaaagggttcggaactacgttacgaaaacggtccgttaggccggtacgtacggtccgtaaccgtcgtttcccttaggttaccctttacgaacgtttcccccgttaccccgccttaaccgttcgg

SEQ ID NO: 30619 - DNA, 852 bp, Homo sapiens
  misc_feature: GYAE6OF01D649G.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagcccaccctgtccttgtctccgagggacaaagcgccctccctctccgtcggccggggccagtcagcattggttcggcctaccttccgttacgccctacggtaacccaaaacgaaaaggcccgttagggacccacgggcccttaccccgaacgtaccttcccgtctattcctagttcggatcggtccgttcctttacccggacggggtaccctacggttccgggcccgttccccggggcccgtaaggggttttccaagggttcgggaccgtaggggttcggggtccgtacggggactaccggtccctttaccgaccttcctaccgaacctacgtacgaacggtccacggtcccggtagggaccgtacccggttaaggtttacgtttttcgggttaacggttttattaccgttgtaccgacgtaccgacgggttccggtaccggcccggtaaccggttcccggtacccccgttcggtaccccggggtttacggggaaccggggtaacccggggtaacggtaaacggggttacgaaacccgtaggttaaacccgaaaaccgggttaccgtacggggtaccggtaccgtaccgggtaccctaacccggttgtttcccgttccggtttaccctttacccgttaccctttcccccggttacccccgtccgtacggtttacccgg

SEQ ID NO: 30620 - DNA, 747 bp, Homo sapiens
  misc_feature: GYAE6OF01ETU7G.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagcccaccctgtccttgtctccgagggacaaagcgccctccctctccgtggcgggccaggtcagcattgttcggcctaccttcttagccttaggtaaccaaacaaaacgcctaggcccaaggcctcccagacctcctcatctatgatcgcgtcttccgcgggtccacgtcgggccgtcccggctacggttcaggtggccgtaggtcgggtcgtggggactacggtccctttcaaccgttcctacgaaccctactaccgacgaccgaaccggtccgtacggggaaccgtaccccggttaaaggttaccggttttttggtaaccgggtttttaacttacgttacggtaccgacgtccgtaacggtccggtacgaccccggttaaccgttccccggggtccccctacgggtaccgggtttcccgggggaacgggtaaccgggggtaccgtaaacgggggttcgaaacgtaccgtaaacggaaaacccggtaggtttcgggacgtaccgttacgacccctaaccgtagttcgttaccgttcttaccaccgtttccccttccccggctacgttacccgg

SEQ ID NO: 30621 - DNA, 700 bp, Homo sapiens
  misc_feature: GYAE6OF01B8S0R.40.67.G01.1.454.CMB.1.raw
  modified_base (259)..(259): a, c, t, g, unknown or other
  misc_feature (259)..(259): n is a, c, g, or t
  modified_base (290)..(290): a, c, t, g, unknown or other
  misc_feature (290)..(290): n is a, c, g, or t
tcagtctagcgactcacgaccggtgctcgatttagagtatacatattgggtttgggggaggaactgctcagttaggacccagagggaaccatggaagccccagcccagcttctcttcctctgctactctggctcccagcagccaccggagaagttgtcctgacacagtctccagccacctgtccttgtctccgagggcaaagcgcctccctctcctgcgggccagtcagcatgtgctacctcttagcctggtaaccaanaaacgcctggccaggcctcccagtcctcctnatctagtgatcgtccgtctccgacgggccacgtggccgtcccggcaggttcaggtcggctacgggtgggtacgtacggggactacgtccgtttcactcgtaccaccgtatcgaagcgacgtccgtaggaccgtaccggtagtttacgttttacgggtacggttttaaacttacgttacgtcacggtcgtaacgggtcgtaccggtccggtaccgtcccgggtacccccttagggtacccgggtttaccggggacccggggtaaaccggggtacccgtaaacggggtacggaaaccgtacggttaaacccggaaaaccgtagtcgggtaaccggtccttaggaccctaacggtctcggttcttacccgttactaccgtttaccccgttccccgtaacgtcgtttaacccgg

SEQ ID NO: 30622 - DNA, 729 bp, Homo sapiens
  misc_feature: GYAE6OF01A4SBQ.40.67.G01.1.454.CMB.1.raw
  modified_base (178)..(178): a, c, t, g, unknown or other
  misc_feature (178)..(178): n is a, c, g, or t
  modified_base (242)..(242): a, c, t, g, unknown or other
  misc_feature (242)..(242): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggccaggnttggtgaaaccgttcgggaccctgtccctcaattgctttgtctctggaacttctatcgaaggtncagtccttcgacgtgggctggactccgaccacgccccgaggaaacgggcctaccgaagtcggtacgttggactagtcgtactaagtttcgttagtcgggtaccgtccgttaccccgaacttaccgaacggttccggcccggtaccccttaccgaaggacggttccggaaccgtccccttacaagttacctacctaagtaacgaacctaccgtaaccgtaaacgtaacccgttacgttttccccgacgtacgtccgtacgtaccgttccgtacggtaccgacccggaccgtacgacgtaccgtaccggtacttacggtaccttagtttacgtcggttcgaacgtacgtacgtacgtccgtttacgtaggttacgggtacgggttacctacgaaccggtacccggtacttaccgaccttcccgtacgtttacggtccgttaacggacctacggttccggtacggggccggccgggttcgtttccccggg

SEQ ID NO: 30623 - DNA, 797 bp, Homo sapiens
  misc_feature: GYAE6OF01D3NWD.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggtaacttctatcaagggtagcagccttccacgtggggctggactccgccgacgacccccgaagggaaacggggcctaccgaagtcggaccggttaggacctagttacggtactaaactttcgttaagtcggggccgtcctaccccaacgttaccaggtcggcccggtccctacgaacggtacgtccggacggtcccctacaagttactacctaactacgacctaccgtaccaaacgtaacccttacgttttccccagtaccgtcctagtaccgtcgttacggtaccgacccgccgacgacggaccgtaccggtcttacgttaccttaagttttagttcggtacggaccgtacggttaaccgttaccggttcccgtttacggttacggggttacggggttacggggggtttaccttaccgggaacccgggtaaaccccgggttaactttaaccccgtttacccgtaccccgttaacccgggttttccgggtaccggtttaaccgggacctttacgggttacccgggtaccgggggggacccggttaccggggggttcccgtttaccccggggg

SEQ ID NO: 30624 - DNA, 831 bp, Homo sapiens
  misc_feature: GYAE6OF01B8MOW.40.67.G01.1.454.CMB.1.raw
  modified_base (820)..(820): a, c, t, g, unknown or other
  misc_feature (820)..(820): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccacggagaagttgtcctgacacagtcctccagccaccctgtccttgtcctccgagggacaaaagcgccctccctctccgtggccggggcaggtcagcagttgtcgcctccttcttagccgtacggtaaccaaaactaaacgtccgtacggaccgaacggcctacccgaacgtacctccctactacgttcctaatcggtaatcggtccgttcccgttaccggaccggggtaccctaccggtccggggtccccgttaccccgggaccgttaacggggttacacgggttagggccgttaagggggttcggggtacgttaccgggggaaaccgtcggttaccctttacgaaccctttcgacccgtaaaccctattaccggaccggtacgaacggtccccgttaacgggaacccggtacccggttaaagttttacggtttttacggttaacccggtttttaacgtaaccgtcggtttaaccgacgttaccgacgggttacccgtccggtacccgtacccggtcccggtacccccgttaagggtccccggggtttaacgggaccggggtaaccggggtaaccgtaacggggttacaaaccgacgttaaaacccgaaacgggttacgtcgggtacgccgtacgccctaacttctacgttcgtacttacccgacttcccgtcccngtaccttacgg

SEQ ID NO: 30625 - DNA, 782 bp, Homo sapiens
  misc_feature: GYAE6OF01CXCRT.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgtctttgtctctggaacttctatcgaagggtagcagcttccgacgtggggctggactccggcccacggacccccgaagggaaacggggcctaccaagtcgcggttggacagttgtactaatttcgttagtcgggcgtcctcccgaacttacgaggtcgccggtcccctccgacgacgtccggacgtccctacaacgttactacccaagttacgacctaaccgtaaccaaacgtaacccttacgtttttaccccgagtaaccgtccgttacggaccgttccgttacggttaccgaacccggccgaccgaaggacccgtacggtccttacgttacctttaagttacgttaggtcgacggtaacgtaccgttacggtacccgttttcggttacgggtttaagggtttcgggggtttaaccttccgggtaaacccggtaaaccccggggttacttaaaccccgttacccgtaccccgttaaccccggttttccgggtacccggtttaacggacccgttaacggttcgggtacccggggggtcccgggtaccgggggtccccgtttacccgggg

SEQ ID NO: 30626 - DNA, 737 bp, Homo sapiens
  misc_feature: GYAE6OF01D278L.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatggtcctgtccctgatgcaggtgcgggagtcgggcccaggattggtagtaaaccgttcggggaccctgtcctcaattgcttgtctctgaacttctatacgaaggtagcagtcttccacgtgggctgactccgccacgccccgagggaacgggctaccgaagtcgcgttgactagtgtactaattctagtcggccgtacctccactacgacggtcgccggtccctcgacgtacgtcgacgccctacaatacaccgtactaacggaccgtaccgtaaccgaaacgtaacccgttacgttttacccgacgaccggtccttaacgtacgttcctacggtaccgaccccggaccgtccgaaccgaccgtacggtcttacggttaccttaagtttacgtttgggtcgaacgtacgaaccgttacgttcccgtttacgttacggggttacgggttacgggggtttacctaaccgggtaacccgtaaacccccgggtaattaccccgttaacccgtcccgtttaaccggttccgggtaccgtttaggaaacccgttcggttacccgggaccggggggttaacccggtcgggggtcccgtttcccgggg

SEQ ID NO: 30627 - DNA, 636 bp, Homo sapiens
  misc_feature: GYAE6OF01CG3H8.40.67.G01.1.454.CMB.1.raw
  modified_base (326)..(326): a, c, t, g, unknown or other
  misc_feature (326)..(326): n is a, c, g, or t
  modified_base (357)..(357): a, c, t, g, unknown or other
  misc_feature (357)..(357): n is a, c, g, or t
  modified_base (408)..(408): a, c, t, g, unknown or other
  misc_feature (408)..(408): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagctagcttccactggggctggatccgccacgcccccaggaaacggggctccaatgcgttggacatgtcaattcttagtgggcnctcccactacagtgcggccctcagctcgacnccctcatacgtaccatacgacaccgtaccaaacgtaacctacgttttcccngaccgtctgaacgtctacgtcgacccgccgtacacgaccgacggcgtcgtacttaattacttgtacgccgtagaaccttagtccctttagtggttaggtcgggggttacttccggaccgtaacccgggtattacccgttaccgttcccctaccgtttcgggaccgtttacggacgtaacgttcccgggtagggggtcccccggtaagggggtccccgtttcccggggg

SEQ ID NO: 30628 - DNA, 825 bp, Homo sapiens
  misc_feature: GYAE6OF01C7NLO.40.67.G01.1.454.CMB.1.raw
  modified_base (137)..(137): a, c, t, g, unknown or other
  misc_feature (137)..(137): n is a, c, g, or t
  modified_base (731)..(731): a, c, t, g, unknown or other
  misc_feature (731)..(731): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagntcgggtcctgtccctgatgcgaggtggcgggagtccgggccaggtagttggtacggtaaacccgttccggggacccttcgtaccctactaagtttgtcttttcgtcttaccgttaggtaacctttctagtacgtaagggttacgcacgtccttaccgacggtcggggactacggtacgtcccgacccgacccggacccccggaaagggtaaaccggggcctacgtaaaggtcgtacggttaggactaagttcgtacttagttaccgtttacggcgggtaccgtaccctacccgtaaccgtacgtaacggtccggtacccgtaccccgtacggtaacgtaccggttaccgacccgttaccctaagttaacctaacgtacctaacgtaacccggtactaacccggtaacccttaaaaccggttaaacccttaccgttttacccgaccgtaccgttacgtacggtacgtccgttacgccggtaccgcccgagtacgacgtaccggtcttacgttattattcgtgacgtacggactccgttacgtccgtttaggtcggttaagggttcgggacttacccgggaccgttaaacccggtntaacccgttaccgtaccgttacgttccggggtacttaccggacgttaccggagggttccccgggggtaccggtccgggttccgtttaccccggg

SEQ ID NO: 30629 - DNA, 669 bp, Homo sapiens
  misc_feature: GYAE6OF01EJOVC.40.67.G01.1.454.CMB.1.raw
  modified_base (376)..(376): a, c, t, g, unknown or other
  misc_feature (376)..(376): n is a, c, g, or t
  modified_base (619)..(619): a, c, t, g, unknown or other
  misc_feature (619)..(619): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagacgcctccctctccgtgcggggccagtcagcatgttcggcctacctccttacgccgtggtaaccaaacaaaagcctggccaggcctcccgagacctcctcatctatgatgcgtcttccgacggccacgtcggccgtcccggctaggttcaggtcgcgaggtcggtgtagggacncgtccttacactccgactacctactcgacgcgacggtccgtacgggaaccgtacccggtaagtttacgttttacggttacgttttaacttacgttcgtaccgacgcgtacgtccggtcgtcccgtaccgtcccggcccctcggttaccgggttacgggaccggggaccggtaccggtagggtacggaacgtacgtaaccgaaaccggtacgttcggtacggtaccgtcggaccctaaccggtnttccgttacgttcccttacgtccttaccccgtcccgtacctggttaaccg

SEQ ID NO: 30630 - DNA, 680 bp, Homo sapiens
  misc_feature: GYAE6OF01CAP19.40.67.G01.1.454.CMB.1.raw
  modified_base (273)..(273): a, c, t, g, unknown or other
  misc_feature (273)..(273): n is a, c, g, or t
  modified_base (303)..(303): a, c, t, g, unknown or other
  misc_feature (303)..(303): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagcccaccggagaagttgtcctgacacagtctccacgcccaccctgtccttgtcctccgagggcaaagcgccctccctctccgtggccggggccagtcagcagtgtcgctacctccttagcctagaaccaaanaacgccgtgccaggcctccagtacctccanatctatgatcgcgtcctccgaggcccagtcggccggtccccggcgtagggttacaggtcggacgtagggtcgggttcaggggacctacggttcccttcactcgtaccacctagtccagcctaacggtcccgtagggaacccgtacccggttaagttcggtttttacggtacggtttttaataccgttgtacgagtcgagtccgtccgacccgtaccgtcgtcccccttaggtaccggttccgggacggtaacggacgtaaggggtctaacccagtaaaccggtaacgtacgtcgggtacggccgtacgaccctaaccgtgtttccggtacctttacccgtacgttaccgttccccctacccggtatccgtttaacgg

SEQ ID NO: 30631 - DNA, 749 bp, Homo sapiens
  misc_feature: GYAE6OF01BO1C9.40.67.G01.1.454.CMB.1.raw
  modified_base (260)..(260): a, c, t, g, unknown or other
  misc_feature (260)..(260): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgcctgacacagtctccagcccaccctgtccttgtcctccgagggcaaagcgccctccctctcctggcggggccagtcagcatgtgcacctctagctgtaccaanaaagctgcagctccanactcncatctatgatgcgtctccgaggccacgtcggccgtcccggcacggttcaggtcggcgtaggtcgggtcgtaggggacctacggtccctttacgaccttcctacccgaacctacgtccgaacggcgaaccggtcccgttacgggaaccggtaccccggtaagtttacggtttttcgggtaaccggtttttattaccggttcgttacaacggtcgaacggttcggtccgacccgggtaccgttccgggccccccttacgggtacccgggtttaccgggaccgggggtaaccgggtaacccggtaaggggtaccgggtaaaccctacggttaaaccccggaaaaaccggtacccggttcggggtaaccgggtaccgtaccggtaacccgaccccgttaacgttcccgtttacggttaccctttacccgtacccttttcccccgttacccccggaactttccgttaacccgg

SEQ ID NO: 30632 - DNA, 674 bp, Homo sapiens
  misc_feature: GYAE6OF01A9CVU.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagcgcctccctctcctggcggggccagtcagcatgttggcctacctccttagcctggtaaccaaacgaaaacgccgtggcctacggcctacccagacctcctctactctatgatcggtccgtcgttccgacgggtccaccgtcgggcccggtccccggaccgtacgggttcaggtcgggtcgtacgggttcgggtcgtcggggacacgttccttaccaccgtccgttccacctacgtaccgacgccgacgtccgtacgggaccggtacccgtaagttcgttttacggtacggttttaattacgtcggtacacggtcgtacggtcgtacggacccgtcgtccggtccctcggtaccggttcgggacgggtacgggacgagggtcgaactacgtacgaaacggtacgtggtacggtcgtacgaccactcgttcgtaccgttcttcgtaccttacccgttcccgtctacgttaccg

SEQ ID NO: 30633 - DNA, 676 bp, Homo sapiens
  misc_feature: GYAE6OF01BCXS5.40.67.G01.1.454.CMB.1.raw
  modified_base (343)..(343): a, c, t, g, unknown or other
  misc_feature (343)..(343): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcgaggtgcgggagtcgggcccaggattggtagaaaccgttcgggacctgtcctcaattgctttgtctctggtaacttctatcgaagggtagcagtccttccgacgtggggctggactccgaccacgaccccgaagggaacgggctaccgaagtcggtcgtaggactatgtactaagttctagtcggcncctaccatacgagtcgccgcctacgagacgtcgacgtccctacgtatactacctaagacgaccacgtaaccaaacgtaacccgttacgtttcccagtacgtacgttcgacgttcgtacgtacgacccgcgacacgaccgtacggtcttagtacttagtttacgtcggtcgaacgtaacgtaccgttacgtccgtttagttcgggttaacggttcggggttacctcggaaccgtaaccgggtacttaccgtacctacccggttacgttcggtacgttaggaaccgttcggttaccgggtacggggtacccggtacggggttcccgttaccgggg

SEQ ID NO: 30634 - DNA, 698 bp, Homo sapiens
  misc_feature: GYAE6OF01C7WST.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcgaggtgcgggagtcgggcccaggattggtacgaaaccgttcgggaccctgtccctcgaattgtctttgtctctaggtaacttctatacgaagggtagcagtcttccgagtggggctaggacgtccgccgacggccccgaaagggaacggggcctaccgaagtggtcggttacggaactagtcgtactaatttcgttacgtcgggccgtcctacccacgttaacgacggttccggcccggtacccacgaacggaacggttccggaaccgtccctactaactacctaccgtaactacggaacctaccgtaaccgaaacgtaacccgttacgtttacccgtcgaacgtcgtacgtacgtcgtcgtaccgaccgcgacgaacgaccgtacggtactgtacttattagtgtacgcgtaacgtctaccggtccttggtcgttacggtcgggttactcgggacctaaaccggattacccgtacgtacccgtcggttccggtcgtacgtaccgtacggtcggtacgggcccgggtgggtcccgttccggg

SEQ ID NO: 30635 - DNA, 620 bp, Homo sapiens
  misc_feature: GYAE6OF01EMNVU.40.67.G01.1.454.CMB.1.raw
  modified_base (205)..(205): a, c, t, g, unknown or other
  misc_feature (205)..(205): n is a, c, g, or t
  modified_base (265)..(265): a, c, t, g, unknown or other
  misc_feature (265)..(265): n is a, c, g, or t
  modified_base (356)..(356): a, c, t, g, unknown or other
  misc_feature (356)..(356): n is a, c, g, or t
  modified_base (387)..(387): a, c, t, g, unknown or other
  misc_feature (387)..(387): n is a, c, g, or t
  modified_base (587)..(587): a, c, t, g, unknown or other
  misc_feature (587)..(587): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagcccaccggagaagttgtcctgacacagtctccagccaccctgtccttgtctccagggcaaagngccctccctctccgtggccggggccagtcagctatgttgccacctctagcctgtaccaanaaagcctggccaggcctacccagacctcctcatctatgatcggcttccttccgagggccctacgtcggccgtcccgctaggttcagtggcnggttcggtcgtgggacaggtcctacgactcncaccatccagcacgccgtaggaccgtacccgtaagttagttttcggtacggttttaactacgttgtacaggtcgagtcgcgtcccgtagtcccggcccctcggtacgggtccgggaacgggtacgggacgtaagggtcgaacgtataccggaaagtacgttggacggtacgtcgacccactacgttcctagtttcccttnaccccgtttacccttcccgactcgtttacccgg

SEQ ID NO: 30636 - DNA, 628 bp, Homo sapiens
  misc_feature: GYAE6OF01B5YVU.40.67.G01.1.454.CMB.1.raw
  modified_base (339)..(339): a, c, t, g, unknown or other
  misc_feature (339)..(339): n is a, c, g, or t
  modified_base (431)..(431): a, c, t, g, unknown or other
  misc_feature (431)..(431): n is a, c, g, or t
  modified_base (484)..(484): a, c, t, g, unknown or other
  misc_feature (484)..(484): n is a, c, g, or t
  modified_base (487)..(487): a, c, t, g, unknown or other
  misc_feature (487)..(487): n is a, c, g, or t
tcagtctagcgactcacgaccggtgctcgatttagagtatacatattgggtttgggggctttctgagagtcatggatctcatgtgcaagaaaagtgaagcacctgtggttcttcctcctgctggtggcggctcccagatgggtcctgtccctgatgcaggtgcgggagtcgggcccaggattggtgaaaccgttcggggaccctgtcccctcaattgctttgtctctggaacttctatcaagggtagcagccttccgacgtggggctggactcccgccacgcccccgaagggaaacgggctccaagtgcggttggacatgtactaattcttagtgggcncctcccactacgagtcgccgccctcgaggacgtcgacgccctcactacgtccagtacgaccaccgtaccaaacgacccttagttttccccgngaccgtcgtcgtacgtcgtcgtcgacccgcgacacgacgcggctgtcttattntgngcgatacgtctccgttgtggtaggttcggggttactcggacccgtaaccgggtattaacccgtaccgttacccgacccggtttcggccgttaggacctcggttccgggacgggggtcccggtggggttcccgttcccgggg

SEQ ID NO: 30637 - DNA, 722 bp, Homo sapiens
  misc_feature: GYAE6OF01CR4B0.40.67.G01.1.454.CMB.1.raw
  modified_base (712)..(712): a, c, t, g, unknown or other
  misc_feature (712)..(712): n is a, c, g, or t
tcagtctagcgactcacgaccggtgctcgatttagagtatacatattggggtttgggggaggaactgctcagttaggacccagagggaaccatggaacgccccagcccagcttcctcttcctcctgctactctggctccagcagccacggagtagttcgtcctgacactagtctccacgcctaccttgtcccttgtcctccgagggacaaagcgccctccctctccgtggccgggccagtcagctagtcgttcggacctaccttacgtacgccgtaggtaaaccaaacgaaacgccgtacggaccgacggtcctaccgagtacctcctacacttacctagtcaagtccgtcgttcctaccggaacggtccctaacggttcgggaccccggttacccgggtacgttacgggttcagggttcggacggtaacgggtcggttaccggtacgggaacctcggttacccttacgaccgttcctaaccgtacgtactaccggaacgtccgaccgtacggtaaccgggaccgtaccggttaaagttcgtttaggttaccgttttatacgttgacgacgcgtacggtcgcgtaaccgtcgttccggcctagggtaccgtcgggacggacgccgtaagcgaactacgtacgaaacgtcgtggacgacgtccgtaatcccttgttccgttaacgtcttaaccgttacttcccgtctccggtnttaacccggg

SEQ ID NO: 30638 - DNA, 663 bp, Homo sapiens
  misc_feature: GYAE6OF01AURMS.40.67.G01.1.454.CMB.1.raw
  modified_base (348)..(348): a, c, t, g, unknown or other
  misc_feature (348)..(348): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggtatggtagaaaccgttcggggaccctgtccctcaattgtctttgtctcgtggtaacttctatcgaaggtagcagtcttccgacgtggggctggactccgccgacgccccgaagggaaacgggcctaccgaagtgcggttaggactatgtactaattcgttagcgggtccncctacccacgtacgacgtcgccgtccctccgacggtcgtccgacgccctcactactaccatacgacctaacgtaccctaaacgtaacccttacgttttacccgacgtaccgacttacgtacgtcgtgtacgaccgccgtacgacgaccgaccgtgtacgtacttagttctcgtcgtacgacgtacgtacgtcccttagtggtacgggttacgggtactcgggaaccgtaaccggtacttaccgtacctaccgttaccggttccggacgttacggacgtcggtcggtaccggggtccgccggggtccgttaccggg

SEQ ID NO: 30639 - DNA, 600 bp, Homo sapiens
  misc_feature: GYAE6OF01ECYI3.40.67.G01.1.454.CMB.1.raw
  modified_base (254)..(254): a, c, t, g, unknown or other
  misc_feature (254)..(254): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagcgcctccctctcctgcgggcagtcagcatgtgcacctctagcctgaccaanaagcctgccagcctccagactcctcatctatgatgcgttctccgaggccacgtcggccgtcccggctaggttcaggtcgcgaggtcggtctgggacacgtcctctacctctacacctatcacgcacgcctaggacgtacccgtaagttcgttttcggtacggttttaacttactgtacccgagtcgagtccgtacgcccgtacgtccggccccctgtaccggttccgggacggtacgggaccgaagggtcgaacacgtaacaaacggtacgtggtacggtacgtccgtacacgtacgtcgtttagttcccgttctacccgttcccgtttccccgagtcgttaccgg

SEQ ID NO: 30640 - DNA, 579 bp, Homo sapiens
  misc_feature: GYAE6OF01DZH7C.40.67.G01.1.454.CMB.1.raw
  modified_base (243)..(243): a, c, t, g, unknown or other
  misc_feature (243)..(243): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
  modified_base (439)..(439): a, c, t, g, unknown or other
  misc_feature (439)..(439): n is a, c, g, or t
  modified_base (457)..(457): a, c, t, g, unknown or other
  misc_feature (457)..(457): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgctctggaacttctatcaagggtancagcttccactggggctggactccgccacgcccccgaagggaaacgggctaccaagtcgcgttggacatcgtcaatttctagtcggctcctcccattacagtcgcgccctcagcgtcgacgccctnactacnccatacgacacgtaccaagaacctagtttcccngacnctgacgtctgtcgaccgccgacagacncggctgtctattagttgngacgtatactagtccttgtgtaggtcgggtactcggacacccgggtatacccgtactacccgtacgttcggcgtttaggaccttacggtcggtagggggaccgtacggggtcccttccgggg

SEQ ID NO: 30641 - DNA, 654 bp, Homo sapiens
  misc_feature: GYAE6OF01C5ODN.40.67.G01.1.454.CMB.1.raw
  modified_base (204)..(204): a, c, t, g, unknown or other
  misc_feature (204)..(204): n is a, c, g, or t
  modified_base (257)..(257): a, c, t, g, unknown or other
  misc_feature (257)..(257): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcggggccagtcagcatgtgcactctagcctggtaccaanaaaagcctggccaggcctccagactcctcatctatgatgcgtcttccgagggcccacgtggccgtcccggccaggttcaggtggcagtggtcgtgggacagtcctttcacctctaccacctatcagcacgcccgtagggacgccccgtaaagtacgttttcggacggtttttaataccgttggtcacgacgaggtccgtcgacccggtactcccggggcccccttgtaaccgggtttccgggaccggggtacgggtacccgtaaggggttcgaacgtacgtaaccgaaaaccggtaactgggtacggtaccgttacgggccctaaaccgttacgttaccgtttcggttaccctttcctaacctttccccgtttacccccgccgttaacttacccggg

SEQ ID NO: 30642 - DNA, 558 bp, Homo sapiens
  misc_feature: GYAE6OF01AJ23T.40.67.G01.1.454.CMB.1.raw
  modified_base (376)..(376): a, c, t, g, unknown or other
  misc_feature (376)..(376): n is a, c, g, or t
  modified_base (412)..(412): a, c, t, g, unknown or other
  misc_feature (412)..(412): n is a, c, g, or t
  modified_base (442)..(442): a, c, t, g, unknown or other
  misc_feature (442)..(442): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtcctccagggcaaagacgcctccctctcctgccggggccagtcagcatgttggcacctcttagcctggtaccaacaaagcctggccaggcctcccagacctcctcatctatgatgcgttcttccgagggcctacgtcggccgtccccggcctacggttcaggtggcgtaggttcgggtctggggacncggccctttcacctctcaccatcagcagcctggacncgaagtgtttgtcgtttatctgtcagtcgngcgtgccgactcggcccctgtccggtcggcgggacggaaccgagggtgacgtacgacgaacgacgtcgtcgtcgtcgaccactcgttcgtcgttcttcacttccctccgctgtacg

SEQ ID NO: 30643 - DNA, 819 bp, Homo sapiens
  misc_feature: GYAE6OF01C9ACI.40.67.G01.1.454.CMB.1.raw
tcagtctagcgactcacgaccggtgctcgatttagagtatacatattgggtttgggggctttccgagagtcatggatctcatgtgcaagaaagtgaagcacctgtggttcttcctcctgctggtggcggctcccagatgggtcctgtccctgatgcaggtgcgggagtcgggcccaggattggtgaaaccgttcggggaccctgtccctcaattgctttgtctctggaacttctatcgaagggtagcagtccttccgacgtggggctggactcccgccaccggacccccgaagggaaacggggcctaccaaagtcggtcggttggactagttagttacctaagtttccgttaaggtcgggccgtcccttacccgaacgtacgtacggttccggcccggtccccctaccgacggtacgtccggacgccccttacaacgttactacccgtaaagtaacgtaaccctacccgtaaccgaaaacgtaacccgttaccgtttttacccctacggtaaccgtccgttacggtaccgttacgtcggtaccgacccgtaccgaccgacgtaccgtaaccggtcttacgttactttaacttttagttcggtacggtaccggtaacgtaaccgtttacggttcccgttttacggttagggttacgggttacggggggtttaccttaccgggtaaacccccggtaaaccggggttaccttaacccgttacccgttccccgtacccggtttccgggtaccgttacgggaccttacggttcccgggtacgggggtacccgggtaccggggttcccgttccgggtttacccgg

SEQ ID NO: 30644 - DNA, 737 bp, Homo sapiens
  misc_feature: GYAE6OF01EY6N8.40.67.G01.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
  modified_base (541)..(541): a, c, t, g, unknown or other
  misc_feature (541)..(541): n is a, c, g, or t
tcagtctagcgactcacgaccggtgctcgatttagagtatacatattgggtttgggggaggaactgctcagttaggacccagagggaaccatggagccccagcccagcttctcttcctcctgctactctggctcccagcagccaccggagaagttgtcctgacacagtctccagccaccctgtccttgtctccagggcaaagngcctccctctcctgcggggccagtcagcatgttggcacctccttagcctggtaccaacaaaagcctggccaggctcccagactcctcatccttaagtgtactcngtccgttccgttccggaccgggtacccgtaccgtcgggtcccggtccccggtacccgtacggttcgtacggtcggtacggtagggttcggggtcggtacgggtaccgtaccgtcccgttaccgtacccgttcctacctaccgtactaccgacgtaccgtaccgtaccggtacgggtaccggacccggtaacgttacgttttacgggttacggaaaacgtttacgttacgtacgntacggccgtacggcccggtaccgtcggaccccgttcggtaccccgttaccggtaccgggttacggggtcccgggaacgggtaccggtaacggtacggtaccgtaaaccgtaaccgtaaccggtaaccggtacgtacgggtaccgtaccgtacgtacccgtacgttaccttaccgttaccgtttccgttcccgtccg

SEQ ID NO: 30645 - DNA, 550 bp, Homo sapiens
  misc_feature: GYAE6OF01CHFT0.40.67.G01.1.454.CMB.1.raw
  modified_base (204)..(204): a, c, t, g, unknown or other
  misc_feature (204)..(204): n is a, c, g, or t
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
  modified_base (546)..(546): a, c, t, g, unknown or other
  misc_feature (546)..(546): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcgggccagtcagcatgttggcacctcctagcctggtaccaacaaagcctggccaggctcccagacctcctcatctatgatgcgtcttccgagggccacgtcggccgttccccggcgaggttcaggtcggcaggtggtcgtggggcagccttcactctcaccatcagcagcctggacncccgaagtnttttcggcggttttatacgtgtcagctagcgtcgccgactcggcccctgacggttcgggcggagggacccaagggtcgaacagtaccgaaacgtacgtggtacggctcgcaccgtgtctgtcttcacgttcccttcccgctnttcg

SEQ ID NO: 30646 - DNA, 590 bp, Homo sapiens
  misc_feature: GYAE6OF01DDEO5.40.67.G01.1.454.CMB.1.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
  modified_base (408)..(408): a, c, t, g, unknown or other
  misc_feature (408)..(408): n is a, c, g, or t
  modified_base (581)..(581): a, c, t, g, unknown or other
  misc_feature (581)..(581): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccaggggcaaagngcctccctctcctgcggggccagtcagcatgttggcacctccttagcctggtaccaanaaaagcctggccaggcctcccagacctctcatctatgatgcgttcttccgagggccacgtcggccgtcccggccaggttcagtggcaggtgggtctgggacacgtcttcactctacacatcagcacgcctaggacgcccgtaagtntttaggtacggttttatacttgtctagctagcgtgcccgacgtcggcccctgaaccggttcgggacgggtagggaccgaagggtcgactagtacgaaaccgtacgtcgtagggtcctagtaccaccgtagttccgttgttcccgtttacacgtttccctttacccggcccttnttacccggg

SEQ ID NO: 30647 - DNA, 696 bp, Homo sapiens
  misc_feature: GYAE6OF01AEPTT.40.67.G01.1.454.CMB.1.raw
  modified_base (340)..(340): a, c, t, g, unknown or other
  misc_feature (340)..(340): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccgttcggggaccctcgtccctcaattgtctttgtctcgtggtaacttctatcgaagggtagcacgtcttccgacgtggggctggactccgccaccgaccccgagggaacgggctacagtcgcgtgactagtgtactattcgttagcgggcncctccactacgacgtcgccgccctaccgagtacgtccgaccgtccctactactactaccaagtacgaaccgtaccgtaaccgaaacgtaacccttacgttttacccgagtaccgtcgtacgtaccgtcgtcggtaccgacccgtcgacacggacgcgtcttgtacttagttcgtcgtcgaccgtaacgtccgttacgtccgtttcgtagggttacgggttacgggttacgttacggacccgttaaaccgggtcttaacccgtcccgttccggttacccgttcggttaccggttacgaacccgttcgggttacccgggtacgggggtccccggtacggggtttcccgtttcccgggg

SEQ ID NO: 30648 - DNA, 731 bp, Homo sapiens
  misc_feature: GYAE6OF01AFOUG.40.67.G01.1.454.CMB.1.raw
  modified_base (560)..(560): a, c, t, g, unknown or other
  misc_feature (560)..(560): n is a, c, g, or t
  modified_base (578)..(578): a, c, t, g, unknown or other
  misc_feature (578)..(578): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcgagggtggcggggagtccgggcccgagggagttggtagaaaccgttccgggggaccctcgtccctctaattgtctttgtctcgtggtaacttctatacgaagggtagcgacgtccttccgacggtggggcgtcggacctcccgaccaccggacccccggaaggggaaaccggggcctaccgaaatcggtcggttaggactagtgtactaattcttagtcgggccgtcctaccctaactcgtacggtcggcccggtacccctcgtaacggacgtaccgaccgtcccctactacctactaccgaagtaaccgtacaacccgtaccaaacggtaacccttacgttttaccccaggtaccgtccgtaggtaccgttcgtacggtccggacccggcaccgacgacccgnggtcttcgtacttagttntggtcgacgagtaccttcgtcctttaggtggttacgggttgggtacctcgaacccggtaaccggttactacccgttccttacccgtcccgtttcgggtcctacggactcggttcggggaccggggtcccgggtcggggtcccgtttcccgggg

SEQ ID NO: 30649 - DNA, 837 bp, Homo sapiens
  misc_feature: GYAE6OF01CHR9Q.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccgagggacaaaagcgccctccctctccgtggcggggccagtcagctatgttacggctacccttccgttagcccgtacgggtaaaccaaaacgaaaaacgcccgttgggacccgaacgggcccttaccccaacggtaacctcctacctactaccgttaatcggtaatcgtcccggttcctttacccgaggggccctacgttcggggcccggtccccgggtcccgtaaagggtttccacgggttgggacctaaggggttcggggttaccgtcggggaactacggtccctttacgaactcctacctaacctagtacgaacgtccgaaggtccccgtagggaaccggacccggttaaaagtttcggtttttaacgggtaccggtttttaatttaaccgttggtaaccgtaacggacgttaacgtccgggtacgtaccccggtaaccgtccggggtacccccctttacggtaacccgggtttaccggggaccggggaaaccggggtacccgtaaacggggttacgggaaacccttaggtaacccgtaaaaaacggtcgttaccgggtaagggccttaacggaacctaccgtacgttcgttaacgttcccgttactacccggttaccctccccgggtactccgttaacgg

SEQ ID NO: 30650 - DNA, 810 bp, Homo sapiens
  misc_feature: GYAE6OF01DO6FH.40.67.G01.1.454.CMB.1.raw
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccacctgtccttgtctccgagggcaaagacgcctccctctcctcggcggggccaggtcagcatggttcggcctaccttccttacggcctacggtaaccaaacgaaaacgccgtgggacccaacggcctaccccgagaccttcctactacttctaagtgaatcggtaccgttccttccggaacggggccctaccggtcgggtcccggtccccgggaccgtaacgggttccgaacgggtcgggacgtacggggttcggggtccgtacggggaacctacgggtccctttacaaccgttcctaccaaccgtactaccgacgtccgtaaccggtccggttacgggaaccggtacccggtaaaggtttacgtttttacgggttacggtttttaacgttaacgttgtaccgtaacggtcgtaacggtcccggtacggtacccggtaccgttcccgggtaccccttaccgggtaaccgggtttcggggaaccggggtaacggggtaaccggtaacggggtacggaacctaacggtaaccggtaaaaccgtacgggtcggtacggtcgtacggaccttaccggtattaccgttcgtttaaaccgtttaccgttacccgttaccccgtactacgttcggtaaacgg

SEQ ID NO: 30651 - DNA, 642 bp, Homo sapiens
  misc_feature: GYAE6OF01BZCFC.40.67.G01.1.454.CMB.1.raw
  modified_base (323)..(323): a, c, t, g, unknown or other
  misc_feature (323)..(323): n is a, c, g, or t
  modified_base (380)..(380): a, c, t, g, unknown or other
  misc_feature (380)..(380): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagcccaccctgtccttgtctccgagggcaaaggcgcctccctctccgtggccgggccagtcagcatgttcggcctacctcgttagcctaggtaaccaaacaaaagccgtggccaggcctcccagacctcctcatctatgatgcttctccngggccacgtcgggccgtccccggctaggttcacggtggcgtaggtgggtctgggacncgccttcacctcacaccatcacgcacgccgtaggacgtacccgtaagtcgttttggacggttttaatcgtgtacaggtcaggcgtaccgccgtacgtccgggccccttgtaccgggttcgggaccgggacgggtaccgtaaggggtcgaacctacgtaaccgaaaaccgtacgttcgggtaccggtcgtaccgtacctaacctcgttccgttaccggtttaccttcccgtacgttccccgttccccgacgtaccgttacccg

SEQ ID NO: 30652 - DNA, 662 bp, Homo sapiens
  misc_feature: GYAE6OF01BU1ZB.40.67.G01.1.454.CMB.1.raw
  modified_base (263)..(263): a, c, t, g, unknown or other
  misc_feature (263)..(263): n is a, c, g, or t
  modified_base (387)..(387): a, c, t, g, unknown or other
  misc_feature (387)..(387): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagtcaccggagaagttgtcctgacacagtctccagccaccctgtccttgtctccgagggcaaagcgccctccctctccgtggccggggccagtcagcatgttgccacctctagcctgaccaanaaagctgccaggcctccagactcctcatctatgactgccgttcttccgaggccacgtcggccgtcccggctagggttcaggtggcgtaggttcgggtcgtgggacacgtccttcactctcaccntcagcacgccgtaggaccgacccgtaagttacgtttttcgggacgtttttaactacgttggtaccaggtcgtaggtccggtaccgtacccggtaccgttccggtacccccgttcgtaccggggtttccggggaccggggtacgggtacccgtaaggggttcgaactacgtaaccgaaacggtaccgttgaacggggtctacggacccaaaccgtcttaccgttccgttacttaccctaccgtttaccccgtttccccgtacgttacgttaccggg

SEQ ID NO: 30653 - DNA, 887 bp, Homo sapiens
  misc_feature: GYAE6OF01A78TS.40.67.G01.1.454.CMB.1.raw
  modified_base (870)..(870): a, c, t, g, unknown or other
  misc_feature (870)..(870): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccctaccctgtccttgtcctccgagggcaaagcgccctccctctccgtggccggggcctagtcagtcgagttcggttcggcctacccgttccgtttacgcccgttacggtaacccaaacaaagtcccgtagggcccacggcctccccgaagaccttcccgtactatcctagtcggatcggtccgttccttacccggacggggtccctaccgtcgggtacccggtccccgggtaccgtacgggtttcgtaacgggttcggaccggtagggttaccggggtcgtacgggggtaaccttacccggttccctttacgtaccccttacctaccccgtaacctaacgttccgaacggtacccgaccggtcccgtacgggaaccggtaacccccggttaagggtttaccgtttttacggttacccggttttaacgttaccgttacggttaccgaccggttacgtaccgggtaccgggttacggtaccccggttaccggttcccgggtcccccctaacgggtttccgggggttaccggggtacccggggtaaacgggtaaccccgggttaaaggggttaccggaacccgtaacgtaaaccgtaaacccgggttaacgtggggtacccgtacggttcccaaccgtaccccggttattacccgttacgtttaccccggttactacccgtttccccgggttacccnccgttcgttaacccggg

SEQ ID NO: 30654 - DNA, 722 bp, Homo sapiens
  misc_feature: GYAE6OF01B491T.40.67.G01.1.454.CMB.1.raw
  modified_base (316)..(316): a, c, t, g, unknown or other
  misc_feature (316)..(316): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagcccaccctgtccttgtcctccgagggcaaagcgccctccctctccgtggccggggccaggtcagcatggttcgctacctcttagcctaggtaaccaacaaaacgcctcggaccacggctacccgagacctcctcactctangatgccgttctccgacggccacgtggcccgtacccgcgtagggttcaggtcggacgtaggtcgggtacgtggggaacctacggtccctttacgaccgttctacccaccgtacgtaccgagaccgacggtcccgtacgggaaccggtaccccggttaaagtttacgtttttcgggtacggtttttaacttaccggttaggtaccgacgtaccggaggtccggttacggacccgtccggtcccgacccccgttggtacccgggttaccggggaccgggaacgggttacgaaacggggttgaacctacggtaaccgaaacggtacgtgggtaccgtcgtacgacccacttcttccgttcggtttaccttaccctaaccgttccccgttacccgtacgttcgtacccggg

SEQ ID NO: 30655 - DNA, 900 bp, Homo sapiens
  misc_feature: GYAE6OF01B8UBI.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtcctccgagggcaaagcgccctccctctccgtggccgggccaggtccagccagttcggttcgcctaccttcttacgcctaggtaaaccaaacaaaacgtccgtacggccaacggtcctacccgaacggtaacctccctacgtactccgttaatggtaactcggtccgttaccgttcccgaacggggccctaacggttcgggcccggttacccccgggccgtaacgggtttccaacgggtcggtaccgtaggggtcgggttacgtacgggtacctaacggtcccctttaacgaccgtttccttaacccgaacccgtaacgtacccgtaacggaccgtaacgggttacccggtacggggtaaccccggttaaccccggttaaaggttttacccggttttttacggttaccccgggggtttttttaaacttaaccgggtttacggtaccgtacgggttaccctaaacggggtcccgttaaccggggtaccccgtacgggttcccccgggtaccccgttcgggtaaccgggttacccgggggaaccggggaaccgggttaacccggtaaaggggtcccgaacgtaacggttaacccgaaagggttaacttcggggtacggcccgttacgggacctacccggttactttaccgttacgggtttaccctttacccgtaccctttaccccttaaccccggttagtacccttaacgggg

SEQ ID NO: 30656 - DNA, 714 bp, Homo sapiens
  misc_feature: GYAE6OF01BCKEX.40.67.G01.1.454.CMB.1.raw
  modified_base (282)..(282): a, c, t, g, unknown or other
  misc_feature (282)..(282): n is a, c, g, or t
  modified_base (405)..(405): a, c, t, g, unknown or other
  misc_feature (405)..(405): n is a, c, g, or t
tcagtctagcgactcacgaccggtgctcgatttagagtatacatatttggggtttgggggaggaactgctcagttaggacccagagggaaccatggaagccccagcccagcttctcttcctctgctactctggctcccagcagccaccggagtaagttgcctgacacagtcctccagcccaccctgtccttgtcctccgagggaccaaaagcgtccctccctctccgtggcggggccagtccagtcatcgttggccaccttcgttagcctaggtaaccaaanaaacgccgtcggcaggcctccagtacctctacatctatgatgtcgttctaccgacggcctacgtcggccgtcccggactaggttcaggtcggacgtaggtcggtcagggacacgtccttcacnctaccgacagtccagccgacgtccggtggacgaccggtaatttacggttttcgtacgggttttaattcgtacggttacgaacggctaacgggttccgacggtaccccgtacgtccgggtaccccctagggttacccgggttaccggggaacggggtaaccgggtaaccgtaagggtccggtaaacgaaccgttaaacggaaacccggtaggttacggttacggaccgttaacgaccctaaccgttaacgttccggtaacgtttccttaaccctacgtttccccgtaccccgtacgtagtttaacccggg

SEQ ID NO: 30657 - DNA, 839 bp, Homo sapiens
  misc_feature: GYAE6OF01AJL5E.40.67.G01.1.454.CMB.1.raw
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
tcagtctagcgactcacgaccggtgctcgatttagagtatacatattgggtttgggggctttctgagagtcatggatctcatgtgcaagaaagtgaagcacctgtggttcttccttcctgctggtggcggctcccagagtcgggtcctcgttccctgatgcgagggtggcggggacgtccggggcccgaggtagttggtacgtaaacccggttccggggacccttcgtccctactagttcgtctttcgtcttcgtggtacttntactcgaaggtcncgacgtctcctaggtcgggctcggacgcccgaccaccgaccccggaagggaccgggtcctaccgtaagtcggtacgtacggtactaggtcgttacctaatttccgttacggcgggtacctaccctacccgtacctacgtaccggtccggtccccggtccctaccggaacggttaccgaccggtacccgtacccgttcaaaccgtttctacccgtaaggacctaaccgaacccgttacgtaaaccgtaacccgtttcctttaccgtaccggtactccgtcggttaccgttcctacggtacccgcccggacccgcgtaaccggcgtacccggttcgttaccttacgtttacgtttacggttacgcgtaccgtaacgtaccgttcggttacccgtttagtacggtttacgggttaccggggttacttaccgggaacccgttacccggtaacgtttacccgttacccgttaacccgttcccggtttacgtacccggttaccgtacggttcccggttaacgggtcccgggggtaccccgggtcccgggtttcccgggtttaccccggg

SEQ ID NO: 30658 - DNA, 693 bp, Homo sapiens
  misc_feature: GYAE6OF01BEWIE.40.67.G01.1.454.CMB.1.raw
  modified_base (209)..(209): a, c, t, g, unknown or other
  misc_feature (209)..(209): n is a, c, g, or t
  modified_base (243)..(243): a, c, t, g, unknown or other
  misc_feature (243)..(243): n is a, c, g, or t
  modified_base (399)..(399): a, c, t, g, unknown or other
  misc_feature (399)..(399): n is a, c, g, or t
tcagtctagcgactcacgaccggtgctcgatttagagtatacatattgggtttggggctttctgagagtcatggatctcatgtgcaagaaagtgaagcacctgtggttcttcctcctgctggtgcggctcccagatgggtcctgtccctgatgcaggtgcggagtcggcccaggtattggtacgaaaccgttcggggaccctgtccctnaattgctttgctcgtagacttctatcgaaggtcncagtcttcgacgtgggctggactccgccgacgccccgaaggaacggcctacgaagttggcgttgactagtcgtactagtttcgttaagtcgggtcctactcccaacgtaccgtagtacgtccggtacctaccgaacgtacgtaccggacgtccctnaacttaccgtctaacgtacgaaccgacgtacccgaaacgtaaccttacgtttcccgagtaccgtctacggacgttcgtacgtaccgtaccgacgtacgacgtacgtaccggtcttacgtacttagtttacgtgtcgaccggtaacgtacttaacggtcctttagtacggttaggtcgggttaacttccggaaccgtacccggtaacgttaccgtcgttaccccgacgtttccgggacttacggggacttaacggttccggtaccggggtaccgttacgggtcccgtttcccggg

SEQ ID NO: 30659 - DNA, 605 bp, Homo sapiens
  misc_feature: GYAE6OF01B5PZ0.40.67.G01.1.454.CMB.1.raw
  modified_base (448)..(448): a, c, t, g, unknown or other
  misc_feature (448)..(448): n is a, c, g, or t
  modified_base (598)..(598): a, c, t, g, unknown or other
  misc_feature (598)..(598): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccacggagaagttgtcctgacacagtctccagccaccctgtccttcgtctccgagggacaaagcgcctccctctccgtggccggggccagtcagcatgtcgcacctctagcctgtaaccaacaaagccgtggccaggcctaccacgacctcctacatctagtgatcgtcttcctccgaggcctacgtcggccgtccgcgtacggttcaggtcggcgtaggtcggtcgacgggacacgtccttcacctctacacatcgagccacgccgtggacgtaccggtaattagttttcggacgtttattacgngtcgagtcgacgtccgtcgaccgtcgtccggtccctcgtacgggttccgggacggtaacgggtaccgtaacgggtcggaactacgtaaaccgaaacgtcgtcgggtcgcgtaccgacacgtcttctcgttacctcgtacttcccttcccntcgttcg

SEQ ID NO: 30660 - DNA, 821 bp, Homo sapiens
  misc_feature: GYAE6OF01DMUYX.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcgagggtcggcggggaggtccgggcccgaggtagttgggtacggtaaaacccgtttccggggaccccttcgtcccctactaattcgtctttgtctcgtaggtaacttctagtcgaagggtgcacgtccttccgacggtcgggctacggaccgtacccgcccgaaccgacccccggaaaggggaaccggggtacctaccgaagtcggtaccggttacggactaagttcgttacgttaacgtttccggttaaggtccgggcctacccgtacccctaacgtaccgtacgtccggacccgtacccctacgtacggtacggtaccgtacccgtccctactacttaacctaccgtaacgtaaccgtaccgtaaacccgtaaccgtaaaaccgtaacccgtttaccgttttacccgacggtaccgtacgttaccggttaccggttccgtaccggtacccggaccccgggacctaccggaacgacccggtaacggtcgttcttaacgtttagttacggtgtacgacggttacgtaaccgttcggttaccgttaggtttacgggttaaggggttccggtaaccttacgggaacccgtaaccggtacttaccggtaccctccgtacgttcgtacgtgaacgtcggtacgggccgggtcggcggttcccgttccggg

SEQ ID NO: 30661 - DNA, 999 bp, Homo sapiens
  misc_feature: GYAE6OF01ENZ7H.40.67.G01.1.454.CMB.1.raw
tcagtctagcgactcacgaccggtgctcgatttagagtatacatattgggtttgggggaggaactggctcagttaggacccagagggaaccatggaagccccagcccagtcttctcttcctcctgctactctggctcccagcagccaccggagaagttgtcctgacacagtctcctagcctaccctgtccttgtctccagggcaaagcgcctccctctccgtggcggggccaggtcgagcagttcgtcggcctaccgttccgttacgccgttacggtaaccctaaacgaaaaacgtcccgttcgggaccctaacgggtcccttaccccgtaaggttaaccctttccccgttacgtaactttcccgttaagttacggtaacgtttcggtacccggtttacccgttttcccccgggaacgggggtccccctaaccggtttccgggggtccccgggttaccccccggggtaccggttaaacggggttttacccgtaacgggttcggggacccgttaagggggtttcggggtttaccgtacggggggaacctaacgggttccccgttttacgaaacccgtttcccgttaacccgtaaacccgtaaacgttaccgtaaaggttacccgaacgggttaccccggttaggggaaaccccggtaccccccggggttaaaaggtttaaccggttttttttaccgggtacccgggttttttaaacttaacccggtttaggtaccgtaacgggtaccgtaacgggtccgttaccggtaccccggtaacgttcccgggtaccccttacggttacccgggttaccgggggaacgggtaacggggtaaccccggttaaaggggtcgtaaaccgaacggttaacccgaaaaaccgggttacgttacgggtaccggtaccgttacggtaaccctaacccgttcgttccgttacggtttaccctttacggacccgttttaccccggtttaccccgacggtttaacgttaacccggg

SEQ ID NO: 30662 - DNA, 593 bp, Homo sapiens
  misc_feature: GYAE6OF01AL31X.40.67.G01.1.454.CMB.1.raw
  modified_base (331)..(331): a, c, t, g, unknown or other
  misc_feature (331)..(331): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctcctctcctgcggggccagtcagcatgttggcacctccttagcctggtaaccaacaaaagcctggccaggcctcccagacctcctcatctatgatgctcttccaggccacgtggcgtcccggcnggttcaggtggcaggtcggtcgtgggacacgtccttcgctcctcaccgatcagcacgccgtggaccgacccgaagttacgttttgtacggttttattctcgtacacgtcagcgtcgccgtactccggcccctgccggttcgggcggaacggaccgaaggtcggactagtacgaaacgtacgtcggacggcgtacgaccaaccgtgttacccttgttaccttaccgttacgttccccttacccggtccctacgtttacccggg

SEQ ID NO: 30663 - DNA, 807 bp, Homo sapiens
  misc_feature: GYAE6OF01ATZUS.40.67.G01.1.454.CMB.1.raw
  modified_base (757)..(757): a, c, t, g, unknown or other
  misc_feature (757)..(757): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagcccaccctgtccttgtctccgagggcaaagacgccctccctctccgtcggccggggccagtcagcagttggtcggcctaccttctacgccttacggtaaccaaacgaaacgccgtacggccacgggtcctacccgaagaccttcctacagttcctaagtgtaactcggtccgtttccgtaccggacgggtccctaccggtcgggtccccggttccccgggaccgttaagggtttccagggttacgggacgtagggggttcgggtaccggtagggggaacctaccggtaccctttacgaccctaccgttaccaacccgtaattcgaacgccgtacggtcccgtagggaaccgttacccggaagtttacgttttacgggtaacgtttttaacgttcgtaacgttccgaaggtccgtacgggtccggtccgtacccggttacccgttccgggccccccgtttaacgggtacccgggttacccgggggtaccggggtaaacgggtaaccccggtaaagggggtaccgtaaccgtaacgtaaccgaaacgggttaacgttcggacgggtactaccggaactaccgtnttaccgttcgttaccgttactaccgttcccctaccggtctaaggtacccg

SEQ ID NO: 30664 - DNA, 767 bp, Homo sapiens
  misc_feature: GYAE6OF01DQD1O.40.67.G01.1.454.CMB.1.raw
  modified_base (428)..(428): a, c, t, g, unknown or other
  misc_feature (428)..(428): n is a, c, g, or t
  modified_base (712)..(712): a, c, t, g, unknown or other
  misc_feature (712)..(712): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagcccaccggagaagttgtcctgacacagtctccagccaccctgtccttgtctccgagggcaaagcgcctccctctcctggcggggccagtcagcatgttcgcctacctccttagccgtaggtaaccaaacaaaacgtccgtggccgaacggtcctaccccgaagaccttcctacctaacttctaatgagtcggtaccgttccgttcccgacgggtcccaccggtcgggcccgttccccgggctacgggttcgaggtcggacgtagggttcgggtcgtcggggaaccncggttccctttaccgaccttccgtaccacctactacgacggtcgacggtcccgtacgggaccgtacccggtaaaggttttacgtttttacgggtaccggttttttaattaacgtttcggtaccgtagtaccgtacgggtcccggtacggtcccggtaccggttcccggtcccccgtacggttacccgggttcggggaccggggaacggggtaaccgaagggtcgtaacgtacgtaaacccgtaaaacggtcgtacgggtacggtccgtaccgaccgtaccgttnttcccgttacgttccctttacctaccttacccgttccccgccgttacgttaccgg

SEQ ID NO: 30665 - DNA, 866 bp, Homo sapiens
  misc_feature: GYAE6OF01CJ08U.40.67.G01.1.454.CMB.1.raw
tcagtctagcgactcacgaccggtgctcgatttagagtatacatattggggtttgggggctttctgagagtcatggatctcatgtgcaagaagtgaagcacctgtggttcttcctctgctggtggcggctccagatcgggtcctgtccctgatgcgagggtggcggggacggtccgggacccgagggtagtttcgggtaccggtaaacccggtttccgggggacccttcggtcccctactacgttcggtctttcgtcttcgtacgtaacttcgtagtacgaagggtacgctacgtccgtaccgacggtcggggtacgtcggtaccgtcccggaccgaccggaaccccggaaagggggaaaccgggtcctaccggaacgttcggtacggttacgggaactacgtcggttaacttacttacggttacggtcggggtacctaccctaaccccgtaacgttaccgacggttcccggacccggtccccgtaggaacggtacggtacccgaccgtccctaacgtaacttacgtacctaaggtaaccgtaaccgtaaacccgtaaccgtaaaaccgttaaacccgtttaccgtttacccgacggtaaccgtccggttaccggttaaccggttcggtacggtacccggacccggtccgacggtaacccgaccggttaccgtcgttacgtttacgtacgtttagtccgggtagtccgaacgttacttccggttccgttaggtcggtaacggggtcggtaacctcgggtaaccggtacccggtaactaccgttacccgttacgttacccggttcggtacgttacggtaccgtcgggtaccggggttccggggaccgtttcggggtccgttcccggg

SEQ ID NO: 30666 - DNA, 722 bp, Homo sapiens
  misc_feature: GYAE6OF01EFAGT.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccacggagagttgtcctgacacagtctccagccaccctgtccttgtctccgagggacaaagcgtccctccctctccgtgccggggccagtcagctagtgttcggcctaccttccttagccgtacggtaaccaaacaaaacgcctacggcctaacggcctcccgaacgtaccttccctacaacgttctaagtcgagtcgtaccgttccgttcccgaagggtccctacgtcgggcccgtcccggccgtacggttcgaggtcggcgtaggtcgggtcgtggacgtacgtcctactacgtccacaccacgtcgacgcgtaccgccgttagggaccgtacccggtaaggttacttttacgggtaccggtttacttaacggtcgtacgtacggtccgtacgggtccgtacggcccgtacggttcccggcccttacggtaccgggttccgggacgggaaccgggtaccgtagggtaccgaacgtacgtaacggaaacggtacgttggtacgtaccgttcgaccgtaccgtcgttccgttagttacccgttcctaacgttccccttacccggtccttaacggtaccgg

SEQ ID NO: 30667 - DNA, 694 bp, Homo sapiens
  misc_feature: GYAE6OF01C1XMI.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctcagggcaaagcgcctccctctccgtggccgggccaggtcaggctagtgttcggcctaccgttccttagccgttaggtaacccaaacgaaaacggcccgtggaccgaggcctacccgacgtaccttccctcacgttctaagttcgacttcggccgttccttaccgacgggccctacgtcggcccggtacccggcgtaggtttccaggtcgcgtaggtgggtcgtgggacacggtccttacgaccttcaccgtacctagtcgaacgccgacgtccggtacggtacgtacccggtaagttacgtttggtacggttttattacgtcgtagacgcgttagccgtcgacccgtactccggtaccctcggtaccggttcgggacggtaccggtacgtagggtagaacctacgtacgaaacgttcgcggttacggaccgttcgacctaaccgtgttccgttacgtttccgttaccgtaccttttcccggacccccttcgtagttacccgg

SEQ ID NO: 30668 - DNA, 758 bp, Homo sapiens
  misc_feature: GYAE6OF01D4BFV.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccacggagaagttgtcctgacactagtcctccagccctaccctgtcctttgtcctccgaggggacaaagcgccctcccctcgtccgtggccggggccagtcagcagttggtcgctacctcttagcctaggtaaccaaacgaaacgccgtaggccacggcctacccgaagacctcctcatctatgactgtccgttcctaccgagggacctacgtcgggtcccgtcccggacgtaggtttacacggtggcctaggggttcgggtccgtacggggtaacacgtccgtttaccaacctcgtacctaaccgacttcgagaccgtcgtcccgtacgggtaaccgacccgtaaggtttaacgttttacggtaccggtttttataaccgttgtacgtacgaccgtaaggccggttcccgacccgttacggtccccgtccccgtttaggtacccgggttcggggaaccggacgggtaaaccggtaacgggttacggaaccaacgttaacccgaaaaacggttccgttaggggccgttaccgtaccgtaacgtacccggttaattcccggttacgtttaccttccggtacccctttcccgttaaccccggtataaccgtttaccgg

SEQ ID NO: 30669 - DNA, 965 bp, Homo sapiens
  misc_feature: GYAE6OF01A2UNE.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcgaggtgcggggagtcgggcccaggtagttggtacgtaaacccgttccggggacccttcggtcccctactaattgtcttttcgtccttcgtacggtaacttctaagtcgaagggtcacgtagtccttccgacgtggggctggactccgaccgaccgaccccgaagggaacggctaccgaagtcggtcggttacgaactagtacgttacctaagtttccgttaacggtccgggaccctaccccgttaccctaacgtaccgtaacgggttccggaccccggtaccccttaccggaacggtaccgtaccgggaccctaccccgttactaacgtttaacccgtaccgtaacgtaccgtaaacccgtaacccgttaaaccggaaaccgttaacccgttaccgttttacccggaccgtaaccgtccgtaccgtaacgttccgttacgggtaccgaccccggtaccgtaaccggaaccgtacccggtaccgggttactttacgggttaccttttaaacggtttacggttccggttacgaaccgggttaactaacccggttttccgggttaccttttacggggttacgggtttaaccgggggtttacggggtttaacccgttacccgggtaaaccccggggttaaaccccgggttaacctttaaccccgggttaaccccgtttacccggtttaaaccccgggggtttcccgttaaccgggttaacccgttaacccgggtttaaccggggttacccgggggtttaccccggggggaacccgggttcccggggggtttaccccccgttttaccccggggg

SEQ ID NO: 30670 - DNA, 578 bp, Homo sapiens
  misc_feature: GYAE6OF01DNT7B.40.67.G01.1.454.CMB.1.raw
  modified_base (203)..(203): a, c, t, g, unknown or other
  misc_feature (203)..(203): n is a, c, g, or t
  modified_base (255)..(255): a, c, t, g, unknown or other
  misc_feature (255)..(255): n is a, c, g, or t
  modified_base (379)..(379): a, c, t, g, unknown or other
  misc_feature (379)..(379): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcggggccagtcagcatgtgcacctctagcctgaccaanaaagcctggccaggcctcccagacctcctcatctatgatcgcgtcttccgagggccacgtggccgtcccggcaggttcaggtcggcaggttcgggtctggggacacgcctttcactctcacctntcagcacgcctagggactcccggtaagtcgttttggcgttttatacgtcgtcagctagtcgtgcccgtagtccgccctgaccgttccgggcggaacgggaccgaaggttcggaactagtaacgaaaacgtacgtggtcggactcgaccctaccgagttccctgttccgttccactttccccgttacccgctagttaccg

SEQ ID NO: 30671 - DNA, 680 bp, Homo sapiens
  misc_feature: GYAE6OF01A06MJ.40.67.G01.1.454.CMB.1.raw
  modified_base (563)..(563): a, c, t, g, unknown or other
  misc_feature (563)..(563): n is a, c, g, or t
  modified_base (642)..(642): a, c, t, g, unknown or other
  misc_feature (642)..(642): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtagaaaccgttcggggaccctgtccctcaattgctttgtctctggaacttctatacgaaggtagacagtcttccacgtggggtctcggacgtccgacccacgacccccgaagggaaacggggcctaccgtaagtcggtacggttacggacctaagtcggtacttaacgtttcgttaacgtccgggtcgtaccctacccgaacctacgacggtcgccggtaccctaccgacgacgtccgacgccctacatacgacaacgtacgaccgacgtaaccaaacgtaaccttaccgtttacccgtaggacccgtctacggtaccgttcgtacgaccggtacccgacgacgaacgtaaccgacggttccttacggtacttaagtttnttaggcgtacgagttacctacgttccttgtaggtacgggtgggttcacggaccgacgtataccgtctacctacggtcgntacggactcgttcggacgggcggtccgggtcgttccgg

SEQ ID NO: 30672 - DNA, 720 bp, Homo sapiens
  misc_feature: GYAE6OF01D04V5.40.67.G01.1.454.CMB.1.raw
  modified_base (421)..(421): a, c, t, g, unknown or other
  misc_feature (421)..(421): n is a, c, g, or t
  modified_base (459)..(459): a, c, t, g, unknown or other
  misc_feature (459)..(459): n is a, c, g, or t
  modified_base (476)..(476): a, c, t, g, unknown or other
  misc_feature (476)..(476): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctccagatgggtcctgtccctgatgcgagggtgcgggagtccgggcccgaggattggtacgaaaccgttcggggaccctgtccctactaattcgtctttgtctcgtacggtaacttcgtatacgaaggtacgcgtacgtcttcgacgtgggactggactccgccaccggaccccgaagggaacgggctaccaagtcgcgttaggactatgtactaagttctacgtcgggccaccgtacccaacgtacgtacgtcgcccggtaccctcgaaggtacgtaccgacgtcccctanactactcatacgacctacgacaacgtacctcgtttccncgacgctacgcgttcgngtaccgacgccgacgacgaccgtacgtcttacgtacttacgtttagtacgacgtacggaactacccgttacgttcccgtttacgttacggggttacggggttacggggtttaaccgttaccgggaacccgttaaacccgggtaacttaacccgttaccccgttacggttaccccggtttcggaccgttacgggacttacgggttccgggtaccggggaccggtccggggtccgtttacccgggg

SEQ ID NO: 30673 - DNA, 958 bp, Homo sapiens
  misc_feature: GYAE6OF01DPVAU.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccacctgtccttgtcctccgagggacaaacgacgtccctccctcctccgtggccggggccagtcagcagtgttcgccaccttccttagcctacggtaacccaaacgaaaacgtccgtacggcccacggtccctacccacgtacctacctctacgttactagtgtacgtcgtcgttaccttccggacgggtaccctaccggtccgggcccggttaccccggaccggttacgggttacccgtaggtacgggtcgtaacggggttcgggttaccggttaacggggtaacccttaccggttaccccgtttaccgtaaccctttccccgtaacccgtaacccgtacccttaaccggaacggttaccccggtaacccgggtacccgggttaaccgggggtaacccgggtacccccggggtttaaaaggttttacccggttttttaaccggggtttaaaccggggttttttaaccgtttacccgggttaaccgggtttaaccggtacccgggtaacggttaccgggtcccggtttaacccgggtaccccggttacccgggttaccccgggtaccccccgtttaccgggttacccggggttaccggggggtaacccggggaaccgggggttaaacccggtacgggggttaaccgaaccccgttacggtaaacccgggtaaaacccgtacgggttcggtacgggtacccttacgggacccttaaccgtacgttacccgttcggtaacccgttcgttaaccctttccccgttacccggccttcggttaaccgg

SEQ ID NO: 30674 - DNA, 850 bp, Homo sapiens
  misc_feature: GYAE6OF01EH7DO.40.67.G01.1.454.CMB.1.raw
  modified_base (819)..(819): a, c, t, g, unknown or other
  misc_feature (819)..(819): n is a, c, g, or t
  modified_base (828)..(828): a, c, t, g, unknown or other
  misc_feature (828)..(828): n is a, c, g, or t
tcagtctagcgactcacgaccggtgctcgatttagagtatacatattggggtttgggggaggaactgctcagttaggacccagagggaaccatggaacgccccagcccagcttctcttcctcctgctactctggctcccagcagccacgggagaagttgtcctgacacagtctccacgcccacctgttccttgtctccgagggcaaagcgcccttccctctccgtggcggggccagtcagcagttggttcgcctacctcttacgcctacggtaaccaaacgaaacgtcccgtacggaccaccgggtcccttacccgaacgtacccttccctactaacgttcctagttcggactttcgggtcccgtttacccgtttacccgggacgggggtcccctacggttccggggtcccccggttaccccgggtaccgtaacggggttttcccaaggggttcggggtaccgttacggggggtttacgggggtccggttacggggggaaacccttccgggttaccccttttaaccgaccccgtttaccgttacccaacccggttactaacccggaaggtcccgtaacgggtccccggttaacggggacccggtaccccggttaaaggtttaccgtttttacgggtaacccgggtttttaattaccgttcgggaacctacgggtaccgtacggggtccgtcggtaccccggtacggtcccggtacccccgtggtacccggttcggggaccgggacgggtaaccggtacgggtacgaacctaacgtaacgaaccgtggttacgcggtcgaccgtcaactttcgtccgttntccccgttnaccttcccgtcactcgttacgg

SEQ ID NO: 30675 - DNA, 918 bp, Homo sapiens
  misc_feature: GYAE6OF01EJ6X7.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtcgaaaccgttcggggaccctcgtccctctaattgtctttgtcttacgtggtaacttctatacgaaagggtagctacgtcctttaccgacgttggggctcggacgtcccgccgaaccggacccccgaagggtaaacggggcctacccgaagttcggcgttaggactaagttcggttactaactttcgtagtcggggtcctaccctacctactaacggacgtccggtccggtcccctacgaggtacggtccgaccggtccctactaactacgtaccaacgtacgaaccctacccggtaaacctaaacgttaaacccttacggtttttaccccgaggtacccgtcgttaccggtaaccggttcgtcgggttaccgaaccccgggtcccgtaacccgtagggaacccgtacccgggttacgttaccggtttaaccttacgtttttaccgggtacgttacgggtaacggtaaaccggtaacccggttttaacccggttcccgttttaaccgggttaggggttttaaaccgggggttacgggggttttaaccggttaaccccggggtaacccggtaaacccgggggttaacctttaaacccggttaccccgttaacccccgttacccggggttttaacccgggtccggttttaaacggtccccggttaaacggggttcccgggttaaccggggggtacccccggggtttaccgggggtacccccggtttttcccgggggg

SEQ ID NO: 30676 - DNA, 714 bp, Homo sapiens
  misc_feature: GYAE6OF01D7LOY.40.67.G01.1.454.CMB.1.raw
  modified_base (272)..(272): a, c, t, g, unknown or other
  misc_feature (272)..(272): n is a, c, g, or t
  modified_base (533)..(533): a, c, t, g, unknown or other
  misc_feature (533)..(533): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagcccacctgtcccttgtcctccgagggcaaagcgccctccctctccgtggcgggccagtcagctatgttggccacctccttagcctaggtaacccaanaaacgccgtaggccaggcctcccgacgtacctcctacaagttctatgatcgtcgttccgttaccgacggtacccgtacgtcgggcccggtaccccggtacgtacggttccgaaggtcggcgtagggtcggttcggtacggggactaccgtcccgtttacaaccgttcctacccaccgtactcgacgccgtaacggtccgtacgggaaccggtacccggtaagtttcgttttacgggttacggttttactacgttcgtacgngtcgacgtccggtcgtaccgtacgtcccggtccctacggtacccggttcggggaccggtaacgggtaccgtagggttacgaaccttaggtaaccgtaacgtagtcggtagtaccgtcgaccgtactcgttccgttcgttaccctccttacccgtttaccccgtcccgtcgttacgtaccgg

SEQ ID NO: 30677 - DNA, 653 bp, Homo sapiens
  misc_feature: GYAE6OF01AUSV0.40.67.G01.1.454.CMB.1.raw
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
  modified_base (334)..(334): a, c, t, g, unknown or other
  misc_feature (334)..(334): n is a, c, g, or t
  modified_base (613)..(613): a, c, t, g, unknown or other
  misc_feature (613)..(613): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctccagatgggtcctgtccctgatgcaggtgcgggagtcgggcccaggattggtgaaaccgttcggggaccctgtccctcattgctttgtctctggacttntancaaggtancancttccacgtggggctgatccgccacgcccccgagggaaacgggctaccgatcgtcgttacggacagtgtactaatttcttagtcgggccncctacccgactacgagtcgccggccctccgagtacgcgacgtcccctcactactccaatacgtacgacctaccaaacgtacctacgttttcccagacgtctcgacgttctacggtaccgaccgccgaccgtacgaccgtacggccttagtacctttacgttagtttcggacgtcgtagtaccgtagtcccgtttagtgggttacgggtgggtaccttacggaccgtaaacccgggtatacccgttaccttccgtaccgttccggtacgtagtaaccgtntacgggtaccggggcccggtaggggtcccgtttacccggg

SEQ ID NO: 30678 - DNA, 733 bp, Homo sapiens
  misc_feature: GYAE6OF01EPUIF.40.67.G01.1.454.CMB.1.raw
  modified_base (342)..(342): a, c, t, g, unknown or other
  misc_feature (342)..(342): n is a, c, g, or t
  modified_base (437)..(437): a, c, t, g, unknown or other
  misc_feature (437)..(437): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcgaagggtagctagcttccacgtgggggctggactcccgccaccgcccccgaagggaaacgggcctaccgaatcgcgttggacatgtactaattcgttagtcgggcncctcccactacgagtcgccgccctcgagtacgtcgacgccctactatactccaatacgaccgaccgtaccgaaacgtaaccctacggttttcccncggaaccgtctacggtaccgtcgttggtaccgaccccggccgtaccgaacggtacgtaaccggtcctttacggttacctttaagttttaacgttcggtacggtacgtacggttacttaccgggtcccttttggtacgggtttacggggttacgggggtttacctcgggtaacccgtaacccgggtaacttacccgttacccggttcccgtaacccggttcgggtaccgttacgggaacccgtacggttacccggggtacggggggtcccggtacgggggttccccgttacccgggg

SEQ ID NO: 30679 - DNA, 977 bp, Homo sapiens
  misc_feature: GYAE6OF01CFUC6.40.67.G01.1.454.CMB.1.raw
  modified_base (212)..(212): a, c, t, g, unknown or other
  misc_feature (212)..(212): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctcggctcccagcagccacggagaagttgtcctgacacagtctccagccctacccttgttccttgtctaccgagggacaaagcncctcctctccgtggcgggccagtcgagctagttgttcgacctaccttcgttacgcctacggtaaacccaaaacaaaacggtccgtacggacccgtacgggaccccttacccgaacgtaccttccctactaacttacgttaacgtacggttaacgtccggttccggtttaccgtttacccggaccggggtaccccgttacccgggttcgggggttaccccggttaccccccggggtaaccgttaaacgggggttttcccgtaacggggtcgggtaccggtaacgggggtttcggggttacggttaccgggggaaccttaccggtttccccgtttaacaccccgtttcctacccaaaccctaacgttaccgaacggacccgtacgtaccccgggttaacggggaaccccggtacccgggttaaagttttaggtttttttacccggttaaccggttttttaacgttaacgttacggtaaccgtacgggttaccgtacggggttcccggtccggtacccccggttacggttaccccggttacccccggtttacgggtacccggggtttacggggacccggggtaaacgggggtaaccccgaaggggttacccggaacttaacccgggtaaacctaaaccgggtttaaggtccggtaacgggtttacccgaccggtaccttaaaccccgttagttccccgttttcgttaacccgtttaccgtttacccccgttaacccgtttacccccgtacgttaacgttttacccggg

SEQ ID NO: 30680 - DNA, 703 bp, Homo sapiens
  misc_feature: GYAE6OF01AK1UB.40.67.G01.1.454.CMB.1.raw
  modified_base (490)..(490): a, c, t, g, unknown or other
  misc_feature (490)..(490): n is a, c, g, or t
  modified_base (496)..(496): a, c, t, g, unknown or other
  misc_feature (496)..(496): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccgagggcaaagcgcctcctctccgtggcggggccagtcagcatgtgcacctctagcctgtaaccaacaaagcctggccaggcctcccgagtacctcctacattctatgacgtcgtcctcttaccgacgggccctacgtcgggtcccgtccccggacgtaacggttcgaaggtcgggactaggggttcgggtacggtcggggacctacggtccctttacacctctaccaccgtataccgagccacggtccgtagggacacccgtaagttcgttttaggaccgttttatacgtgtaccgnggtacncggtcgtacgacccgtacgttccggacccccttaggttacccgggtcgggacgggaacgggtaccgtaaggggtcgtaaccgtaacgtaacccgtaaaaggtcccgttagggtccggaacccgttcggaacccctaacgttcgttccggtttaccgttaccctttaccgaccctttacccccgcccgttaaaccttcgttacccggg

SEQ ID NO: 30681 - DNA, 737 bp, Homo sapiens
  misc_feature: GYAE6OF01A0LX9.40.67.G01.1.454.CMB.1.raw
  modified_base (204)..(204): a, c, t, g, unknown or other
  misc_feature (204)..(204): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngccctcctctcctggccgggccagtcagcatgttggcctacctccttagcctaggtaaccaacaaaagcctggaccaggcctcccgagacctcctcatctatgatcgcttctccgacgggccacgtcggccgtcccggcctaggttcaggtcggactagggtcggtcgtacggggactacggtccttacgtacctcctacgaccctagtacaacggcctacggtcccgttagggaccggtacccgtaaaggttacgtttttcggtaccgggtttttaacttacggtcgttaccgagtaccgtcgggtccgttacggacccgtaacggttccccggcccccttacgggtacccgggtttcccggggaccggggtaaccggggtaacccggtaacggggttaccgggaactaacgtaaccgaaaaccggtacgttcgggtaccgggcttaccggacccaacccgttagttcccgttacgtttacccgtttccacccggtttaccctttacccccggtattaaccgttaacccggg

SEQ ID NO: 30682 - DNA, 836 bp, Homo sapiens
  misc_feature: GYAE6OF01C6PXB.40.67.G01.1.454.CMB.1.raw
  modified_base (249)..(249): a, c, t, g, unknown or other
  misc_feature (249)..(249): n is a, c, g, or t
  modified_base (270)..(270): a, c, t, g, unknown or other
  misc_feature (270)..(270): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtagaaaccgttcggggaccctgtccctcaattgctttgtctcgtggtaacttctatcaagggtacncgagtccttccgacgtggggntggactccgccgacggcccccgaagggaaacggggctaccgaagtcggtcgttaggactagtcgtactaactttcgttagtcgggccgtctccctaactacgagtcgaccggtccctcgacgtacggtccgacgtccccgtactactaactacctaagtaaccggaaccgtaaaccgtaacccgtaaaacggtaaaccccgtttaaccggttttttccccgaacggtaaccccggtaccggtttaacgggaaccgttttcccggtaaccggttaccggaaccccggtacccgaccgtaacggaacccggtaaccgggtcctttgtttaccgttagttttaacgttcgggtacgaaccggtaacggtaacccgtttacggttcccgtttacggtacgggtttaacggggtttacgggggttaacccttcgggaacccggtaaacccgggttattaacccgttaaacccgttcccgttaacccggtttccgggtaccgtttcgggtaccgttaacggttccgggtaccggggggacccgggttaccggggtcccggtttaccccgggg

SEQ ID NO: 30683 - DNA, 1200 bp, Homo sapiens
  misc_feature: GYAE6OF01D5DLJ.40.67.G01.1.454.CMB.1.raw
tcagtctagcgactcacgaccggtgctcgatttagagtatacatattgggtttgggggctttctgagagtcatggatctcatgtgcaaagaaagtgaagcacctgtggttcttcctcctgctggtgcggctcccagagtcgggtcctgtccctgatgcagggtgcgggagtccggaccaggtagttacggtacgtaaacccgttccggggaccccttcgtaccccgtactaagtttcgtccgttttcggtcttcgtacggtaacctttcgtatacggtaaagggtcgacacgtccttaccgacggtcgggtcgtaggtaccgtcccgacccgaccggacccccggaagggaaccgggtcctaccgtaagtcggtccgttaggactagtcgtactactttcgttagtcgggccctacccgtacctacgtacgacggtccggaccccgtccctaccggaggtaccggtaccggtaacccgtcccgttaactaaccgttaaccgtacccgtaaagtaccgtaaaacccgtaacccccgtaacccgtaaaaccggtttaaaccccgtttaccggtttttaaccccccggacggttaacccgttacccggttaaccggtttaacccgggtttaccggttacccgggtaccccggttaacccccgggtacccgggtaaccggaaaaccccgggtaccccgggttaaccccgggttttacccgttttaaccgggtttttaacccgtttttaaacgggttttttacccggttaacggggtttaacccgggaaacccgttttaaaacccggggtttaccccgttttaaacccccgggttttttaacccggggttttttaccgggggtttaaaaccccgggggtttttaccggggggtttaacccccgggggggttttaaacccgtttaacccccgggggtaaaaccccccccggggtttaaaaccccggggtttaaaaccccgttttttaaaccccccccgggttaaaaccccccgggtttttttaaaccccccccccgggggttttttaaccccggggttttaacccccccggggggtttaaaccccccccgggggttttttttttaaaaaacccgggggggaaaaaccccccccccccggttttaaacccccccgggggggggggggttttttttttaaaaccccccccccccgggggggggggggg

SEQ ID NO: 30684 - DNA, 668 bp, Homo sapiens
  misc_feature: GYAE6OF01C9KQB.40.67.G01.1.454.CMB.1.raw
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
  modified_base (383)..(383): a, c, t, g, unknown or other
  misc_feature (383)..(383): n is a, c, g, or t
  modified_base (391)..(391): a, c, t, g, unknown or other
  misc_feature (391)..(391): n is a, c, g, or t
  modified_base (599)..(599): a, c, t, g, unknown or other
  misc_feature (599)..(599): n is a, c, g, or t
tcagtctagcgactcacgaccggtgctcgatttagagtatacatattgggtttgggggaggaactgctcagttaggacccagagggaaccatggaagccccagcccagcttttcttcctcctgctactctggctcccagcagccaccggagaagttgtcctgacacagtctccagccaccctgtcccttgtcctccgagggcaaagacgccctccctctccgnggccgggcagtcagcatgtggacncctctagctaggaaccaacaaagcctaggcaggctccagactccnatctatgntagctctcacggcccagtcgccgtacccgactggtcgagtgcagggtcggtcagggtacagccttcgactcacgacatcgagnacgtccgnggtacgaccgtaagtattttcgacgtttaattaacgtcggtacaggacagggtacccttgacccggtaccgtaccgggtacccttacggtaccggttaccgggacgggaacggttaaaccccggaagggttaccgaacgtaaacgtaaccgtaaaaccgggtaacttacgggtccgggtaacgtcgtaacccgaacgtttaaacccgnggtttacccgttaacctttacccgtaaccttacccgtaccccggtaactacgtaacggttaaacccggg

SEQ ID NO: 30685 - DNA, 619 bp, Homo sapiens
  misc_feature: GYAE6OF01BV3QB.40.67.G01.1.454.CMB.1.raw
  modified_base (318)..(318): a, c, t, g, unknown or other
  misc_feature (318)..(318): n is a, c, g, or t
  modified_base (342)..(342): a, c, t, g, unknown or other
  misc_feature (342)..(342): n is a, c, g, or t
  modified_base (429)..(429): a, c, t, g, unknown or other
  misc_feature (429)..(429): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcggggagtcgggcccaggattggtgaaaccgttcggggaccctgtccctcaattgctttgtctctggtaacttctatcgaagggtagcagcttccagtggggctggactccgccacggcccccgagggaacgggcctacgaatcggcgttaggactntgtactaacttcgtagtcgggccncctcccactacagtcggccgccctcgagcgtcgacgtccctcatacaccatacgacaccgtaccaacgtaacccttacgtttcccgngaccgtctacgtacgtcgtgtcgaccgcgcagaccgcggtctacgtcttattgtggcgcgtagtacttgtaccttgtgtacgggttcgggtactcggaccgtaacccggtacttaccgtaccgtccctaccggttcggccgttacggacgttcgtcccgggtggggccccggtggggtcccgttaccggg

SEQ ID NO: 30686 - DNA, 940 bp, Homo sapiens
  misc_feature: GYAE6OF01AZLH5.40.67.G01.1.454.CMB.1.raw
tcagtctagcgactcacgaccggtgctcgatttagagtatacatattgggtttgggggctttctgagagtcatggatctcatgtgcaagaaagtgaagcacctgtgttcttcctcctgctggtggcggcctcccagagtgggtcctgtccctgatgcgagggtgcggggaggtccgggcccgaggtagttcgggtacgtaaacccggtttccgggggaccccttcggttcccctacgtaagttcgtcgttttgtccttcgttaggtaacctttctacgtaccgaaagggtacgctacgtcgttaccgacggtcgggtcgttcggaccgtcccggaccgaaccggacccccggtaaaggggtaaaccggggccttacccgtaaaggttccggtaccggttacgggtaacctacgttacggttaccgtttaaaccgtttcggtttaaacggtccggggtaccgtcccgttacccgtaaccgtacggtacggtccggtaccccggttccccgtaaccggtacgggtaacccggtccgtaaacccggttccctacgtaaaccgtttacccgtaacctaacggttaaccggaaacccttaacccggtaaacccgtaaaaccggttaacccgtttaccggtttttaccccgaacggttaacccggtcccgttaacggtacccgtttaaccggtacgttaacccgggacccggtacccgtaaccgaaccgggaccgttaccgggtctttacggttacttaacgttttaggttacgaccggtaccgtaacggttccgtaccgtttccgtttggtaccgggttaagggttcgggttacccagggttaaccccggtaccggtactttaacccgcccgttacccgtacggtttcggaacgtttacgacgttcggttccgggaccggggtacggccgggttcggttcccggg

SEQ ID NO: 30687 - DNA, 628 bp, Homo sapiens
  misc_feature: GYAE6OF01A0N5A.40.67.G01.1.454.CMB.1.raw
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
  modified_base (431)..(431): a, c, t, g, unknown or other
  misc_feature (431)..(431): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagacgcctccctctcctgcggggccagtcagcatgtgcacctcttagcctgtaaccaacaaagccgtggccaggcctacccagacctcctcatctatgatcgcgtcttccgagggccacgtggccgtcccggcctacggttcaggtggctaggtggtctgggacncggtctcgactctcacntcagcagccgtggaccgccgtaagtcgttttggtacggtttatacgtntacgagctagcgttacgcccgactcggccccctaggtaccgttcgggcggaacgggtacccgtaagggtcgaaccgtactaaccgaaaacggtaacgttcgggtaccgggtccgtacggacccgtaaccgtcgtttcccgttaggttaccccttacgttaccctttaccccgttcccccggtcttaacgttacccgg

SEQ ID NO: 30688 - DNA, 855 bp, Homo sapiens
  misc_feature: GYAE6OF01D3GQY.40.67.G01.1.454.CMB.1.raw
tcagtctagcgactcacgaccggtgctcgatttagagtatacatattggggtttgggggctttctgagagtcatggatctcatgtgcaagaaagtgaagcacctgttggttcttcctcctgctggtggcggctcccagatgggtcctgtccctgatgcgaggtggcgggagtccgggacccaggtagttggtaggaaacccgttccgggggaccctcggtcccctactaattcgtctttgtcttcgttaggtaacttctatacgtaagggtagcgcgtcttccgacggtcgggcgtgactccgccgaccgccccgaagggaaacgggctaccgaagtcgtcggttacggactagttcgtacgtaacgtttcgttaggtacgggctcctacccgactacgacggttacggcccgtacccgtaccgacggtacggtacccgtacgacccctactaaccgtaacgtaccgtaacgtaacgaacccgtaaccggtaacccgtaaaaccgttaacccgttaccgtttttaacccgtacggtaccgtacccggttacggtacccggtttcgtaccggttaccggaaccccgtaccggtaccgaaccggtaccggtaacccgggtacgtttacggtttaacctttacgtttacggttacggtacggtaacgtaacgttaccgtttaccggtacccgttttacggttaggggttaacgggttacggggttaccttacgggaaccccggttaaaccgggtaacccgttaacccgtcccgttacccgttacccggttccggtacggttacggtaccgtacggttccggggacgggtacccgggtcggggtacccggtttcccggg

SEQ ID NO: 30689 - DNA, 812 bp, Homo sapiens
  misc_feature: GYAE6OF01EI013.40.67.G01.1.454.CMB.1.raw
  modified_base (258)..(258): a, c, t, g, unknown or other
  misc_feature (258)..(258): n is a, c, g, or t
  modified_base (378)..(378): a, c, t, g, unknown or other
  misc_feature (378)..(378): n is a, c, g, or t
  modified_base (498)..(498): a, c, t, g, unknown or other
  misc_feature (498)..(498): n is a, c, g, or t
tcagtctagcgactcacgaccggtgctcgatttagagtatacatattgggtttgggggcctttctgagagtcatggatctcatgtgcaagaaagtgaagcacctgtgttcttcctcctgctggtggcgctcccagatgggtcctgtccctgatgcaggtgcgggacgtcgggcccaggtattggtacgtaaaccgttcggggacccttgtccctactaagttgcctttgtctctaggaacttctagtacgaaggttancagtcttccgacgtggggcttggactcccgccacgcccccgaaggaacgggcctaccaagtcgtcggtaggaccagtcgttactaaatttcgttagtcgggccgtccaccctactaacgngtcgccggtccctaccaggactcggacctcccgtctaacgtactacctaactacgacccgtacgtaaccaaacgttaaccccttacgttttcccgaagacccgttacgtagtaaccgttnttaccggttaccgaaccccgccggacccgtacgacccgtacccggtctttacgttacgtttacgtttacgttcggtacgaccggtaacgtacccttaaccggtttccctttacgggtttagttacgggggttacggggtttaacctccggggtaaaccccggttaaacccggtaccgttttaaccccgttacccgtacccccgttaccggggttttacccgtaacggtttacccgggttacctaaaccgggtttccgggggtaccccgggggtacccgggtttacccccggggggtccgtttttcccccggggg

SEQ ID NO: 30690 - DNA, 855 bp, Homo sapiens
  misc_feature: GYAE6OF01AKDAR.40.67.G01.1.454.CMB.1.raw
  modified_base (214)..(214): a, c, t, g, unknown or other
  misc_feature (214)..(214): n is a, c, g, or t
  modified_base (635)..(635): a, c, t, g, unknown or other
  misc_feature (635)..(635): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcggggagtcggccaggattggtagtaaaccgttccggggaccctcgtccctanaattgtctttgtctctggtacttctattacgaagggtcgcacgtccttccgacggtcggggtcgtcggtacgtcccgccgaccggacccccggaaggggaaccggggtcctaccgaagtcggtaccggttcggaacgtacgttcgtactaagtttcttaggtcgggtaccgtaccctaccctaaccgtacgtacggtcggccccggtcccgtacgtacggacgtccggtaccgtccccttactacgttactaccctaacgtacgaaccgtacccgtaacccgtaaaaccgtaacccgtttaccgttttaccccgacggtaccgttccgttaccgggtaccgtttacggtcccgttaaccggcccggtaccgtacggaaccgtacccggtaccggtccgtttacggtttacttaacggtttnttacgggtcggtaccgtaacggtccctttacggttcccggttttacggtacgggtttagggggtttaccgggttaccgttcggaaacccggggttaaccggtacctttaacccggtaccctttacccggttaaccggttccgttaccgggttaggtacccgtaccggggtttcggggaccgggggtccgggttaccccgggggttcggttttccccgggg

SEQ ID NO: 30691 - DNA, 831 bp, Homo sapiens
  misc_feature: GYAE6OF01EY9DY.40.67.G01.1.454.CMB.1.raw
  modified_base (247)..(247): a, c, t, g, unknown or other
  misc_feature (247)..(247): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtcctgatgcaggtgcggagtcggccaggattggagaaaccgttcgggaccctgtccctacaattgtctttgtctcgtaggtaacttctatcgaagggtacncgacgtccttccgacgtggggctcggactcccggaccaccggtacccccgaagggtaaacggggcctaccgaagtcggcggtttaggactagtacgtactaaactttcgttaaggtcgggaccgtcctaccctacgtacgacggtcgcccggtccctaccgagtacgtccgacgtccgtacgtactacgtccaagtacgaacgtaccgtaaccgaaacgtaacccgttacgttttacccacggtaaccgtccttaggtaccgttacgttacggtacccgaacccgtccgtaaccgaacgggtaaccgtaccgggtaccttttacgttaaccgtttacgttttaacgttccggtagtaaccggtaacggtacccgttaacgggttcccgttttacggttacggggttaacggggttacggggtttacctaccgggtaaccccggttaaaccccggggtaacttttaaccccgtaaccgtttaccccggttaccccggtttagggtaccccgtttaagggtaacccgttcggttacccggggtacgggggtccccggtaaccgggggttccccgggtttacccggg

SEQ ID NO: 30692 - DNA, 803 bp, Homo sapiens
  misc_feature: GYAE6OF01BEMTX.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtagaaacccgttcggggaccctgtccctcaattgtctttgtctctggtaacttctatcgaagggtagcagcttccacgtgggctggactccgccacgacccccgaagggaaacgggtctaccgaagtcggtcgttggaactgttcgtacctaaagtttccttaaggtcggggtccgtaccttacccccgtaacttaccgaaggtccggccccggtaccccttaccgaaggtacggtaccggacgtaccccgttactaactactaccaataaccggaaccctaccggttaacccgaaaacgtaaccccgtttacggttttccccgacggtaaccgtacgttaccggtaaccgttcgttacggtaccggacccgcccgtacgtaccgaaccggtaccgtccttacgtacgttactttacgtaggtcgtaccgtaagtaccgttaccgttccgtttacggttagggttaacggggttacggggtttaacccgttacgggaacccggttaaccgggtaaccttaccgttaacccgtacccgttacccgggtttcggtaccgttagaacgttccggttacggggacccgggggtaccggtaccggggttccccggttacccgggg

SEQ ID NO: 30693 - DNA, 694 bp, Homo sapiens
  misc_feature: GYAE6OF01EJ77A.40.67.G01.1.454.CMB.1.raw
  modified_base (281)..(281): a, c, t, g, unknown or other
  misc_feature (281)..(281): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagcgcctccctctcctggccggggcagtcagcatggttggcctacctcttagccgtcgtaaccgaaacaaaacgtcccgnggccacggcctacccagactcctcaacgtctatgtactgtccgttcttccgagggcctacgtcgggccgttaccccggctacggttctaggtcgggctaggtcgggtcgttacggggactccggtccttacgtaacctcgtaacccgaccctagtaccgagtccacggccgttacgggaccgtacccgtaaggttcttttcgggtacggtttaattacgtacgtacgacgggtctacgggtccgtcggacccgtacgtcccgggcccccttaggaacccgggtttgggacccgggtagggtaacccgtagggtaccgacaaggtaccaaacggtacgtgggtagccgtacgaccgtactccgttaccgtcgttaccctttacgcctttaccccggtccctccgtaagtaccgg

SEQ ID NO: 30694 - DNA, 726 bp, Homo sapiens
  misc_feature: GYAE6OF01B1IQA.40.67.G01.1.454.CMB.1.raw
  modified_base (209)..(209): a, c, t, g, unknown or other
  misc_feature (209)..(209): n is a, c, g, or t
  modified_base (334)..(334): a, c, t, g, unknown or other
  misc_feature (334)..(334): n is a, c, g, or t
  modified_base (417)..(417): a, c, t, g, unknown or other
  misc_feature (417)..(417): n is a, c, g, or t
tcagtctagcgactcacgaccggtgctcgatttagagtatacatatttggggtttgggggaggaactgctcagttaggacccagagggaaccatggaagccccagcccagcttctcttcctcctgctactctggctccagcagccacggagtaagttgtcctgacacagtcctcagcccaccttgtccttgtcctccgagggcaaagcncctcctctcgtgcggccagtcagctagtcgttcgacctaccttcgttacgccgttaggtaaacccaaagaaacgtccctagggaccaacggtccctaccaagtacctcctaacgtactcctaagngtacgtcggtcttccgtaccgacggtccacgtcgggaccgtccgacgtaggtcgtaggtcggctagggttcggatcgggaacncgttccgttacacttaccagtaccctagtccaaggtccacgccgtacgacgtacccgtagtttacgtttcggtaacgttttacacgttacgtacgtagtacctaggtcgtaccgtaccgtaacgtccgtcccgtaacggttccggttaccggggaacggtaccgggttaaaccggaacggttaccgggtaacctaacgggtaacccgaaaagggttccggtagggtaaccgtacttccgggaacttacggtccgttaccgttcgttacttaccgttacctttacccggttccgaacttccggttaacgg

SEQ ID NO: 30695 - DNA, 845 bp, Homo sapiens
  misc_feature: GYAE6OF01CS7JV.40.67.G01.1.454.CMB.1.raw
  modified_base (496)..(496): a, c, t, g, unknown or other
  misc_feature (496)..(496): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccacggagtaagttgtcctgacacagtctccagccctacccttgttccttgtcctaccgaaggggaccaaaaggcgtccctcccttcgtccgtcgggaccggggccacggtcacgctagttggttcggcctacccgttcgttacgcctacggtaaccaaaacgaaacggtccctacgggaccacgggtccctacccgaacgtaccttccctactaacttcgtaaactggtaactcggtccgttacctaccggaccgggtcctacggtcgggtccgtcccggtacgtacggtttcgagggtcggcgtacggttcggtcggttagggacctcgtaccttcactccgtccgaacctntaccgtacgctacgggtccgtaacgggaccgtaaccggttaagtttacggttttccggtacgtttttaaacgttctaacgggtcacgggtaccctaagggttccggtacccggtcccggtaccgggtccccgttaaccccggttcgggttacccgggtacccggggtaccgggggtaacccggggaaccggttaaggggtacccgggtaactaacccgtaaaccgggtaaaaacgttccgggtaggtcgttaaccggttcccgaacgtacccgtttcggttacccttaccgggttttcccttaccggtaccccttttaccggaacccccgttgtaaccggtttaaccgg

SEQ ID NO: 30696 - DNA, 687 bp, Homo sapiens
  misc_feature: GYAE6OF01BXFDU.40.67.G01.1.454.CMB.1.raw
  modified_base (640)..(640): a, c, t, g, unknown or other
  misc_feature (640)..(640): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctacccagcagccaccggagaagttgtcctgacacagtctccagccaccctgtccttgtctccagggcaaagagccctcctctccgtggcgggccagtccagcatcgttcgcaccttcttagcctggtaccaaacgaaagtcctggaccgacggcctcccgagtactcctacatcctatcgtatcgtaccgtcgttaccgagggtccacgtcggccgtcccggctaggttcgaggtcgggtacacggtcgggtcgcgggaccacgttcccttaccgaccttccgttaccacccgtacgttccgacgtaccgaaccgggtccgttacgggaacccgtcccggtaaagttcggtttttcggtacggtttaacttacgtcgtaccacgtcgtaaggtcccgtaggtccccgtacgttacccgtccccgttagtacccggggtgggtacccgggaacgggtacgtaacgggtacgtactaaccgtacgaaaacgttcgtggaccgtcgtacgntaaccgtgtccttcggttacttctaccgtccgttcccgctgtaccgg

SEQ ID NO: 30697 - DNA, 1020 bp, Homo sapiens
  misc_feature: GYAE6OF01DJ77U.40.67.G01.1.454.CMB.1.raw
  modified_base (806)..(806): a, c, t, g, unknown or other
  misc_feature (806)..(806): n is a, c, g, or t
tcagtctagcgactcacgaccggtgctcgatttagagtatacatagttgggtttgggggagaactgctcgtagttacggacccagacggtaaccagtggaacgccccagcccagtcttctcttcctctgctactcgtcggcctccaggccacgaccccgacggaagtaacggttcgtacctagaccacgtacgtcctacccgacgtacccctacccgttcgtttcccgtttgtacccgtaccggaacgggtaaccaaaccggtccgtccccttccccgttccggtacccggttcgggacccggggtaccacggtccgacggtaccgtagtttcgggttaccgccgttaacccgtttccgtaacggtacccgttaacggtaaaacccaaaagtaaccggtccccgtacggaccccgtacggtaccgtaccctaacgtacccgttcctactacgttaccgttaacgtacgggtaccgtttaccgggtcccggtttacccggttaccccgggaacccggttacccggtacccgggtttacccgggtaccccccgggttaccccgggtaacccggtttacggtttaaccggggaccggttacgggtaccggtaggggtttaccgggtcggttaaccgggtaacccgtaaccgtttcccgtttacccgtaaaccggttcccgtaaaccctaccgggtttaacaccgggtaaccacggtacccgggttccgaacggggttaaccgtaaccggtttaagttttccggttacgttaacgggttttactacggtcgtacgacgtggttacccggngtacccgtcggtaccctccgggtaccctacgggtacggttccggggaaccgggtacgggttaaaccggacggttaacgaacccgttaacgggaaacccggtttaagtacgggttcccggtaacggacccgtaaccggtaccgttccttcccggttaccttacccggtttaaccccccgggtttaccttacccccggtactccgcggtttaacgg

SEQ ID NO: 30698 - DNA, 678 bp, Homo sapiens
  misc_feature: GYAE6OF01A6PC9.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagtcttccacgtggggctggactccgccacgcccccaagggaacgggctccaagtcgcgttaggacagtgtctaattcttagtggccgcctacccacgtacacgtcgccggccctaccaggacgtcgacgtccctgactactaccaagtacgactacggtaccaacgaacccttacgttttaccccagtaccgtaccgttacgtaccgtcgtacggtaccgaacccggccgtacggacgtacccgcggacctttaggacctttagtttactgggtacgaccgagtacctcgtaccgtttcgtaggttacgggttcggggttaacttcggaccggtaacccgggtacttaaccgtccgttaccctaccggttcggtaccgttcgaccctaggttccggtacgggggccgtaaccgggggttcccgttcccgggg

SEQ ID NO: 30699 - DNA, 716 bp, Homo sapiens
  misc_feature: GYAE6OF01EV645.40.67.G01.1.454.CMB.1.raw
  modified_base (444)..(444): a, c, t, g, unknown or other
  misc_feature (444)..(444): n is a, c, g, or t
  modified_base (711)..(711): a, c, t, g, unknown or other
  misc_feature (711)..(711): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccacgggagaagttgtcctgacacagtctccagccctaccctgttcccttgtcctccgaggggacaaaggcgccctccctctccgtaggccgggccagtcagcatgtgcctacctcttagcctacgtaaccaaacgaagccgtcggcctaggcctacccgacgtacctccactatacgtactggtactcggtccgttaccgtccgacgggtcccacgtccgggacccggtccccggtaccgtacgggtttcgacgggttcggcgtacggggttcgggtccgtaggggactacggtccgttacnccttaccaccgtacctactcgacgtccgacggtacccggtggaacccgtaaccgtaggttcgttttacgggttacggttttaaattcggtgtacacggtcgacgtccgtgcccggtacttcccgggcccttagggtccggttacggggaccgggaacgggtaccggttaagggacggaactacgtaaccgtaaacggtcggttacgggccggtactccgaccgtaccgtgttccgtattcccgttatccgttaccccgtctaccgtntacgg

SEQ ID NO: 30700 - DNA, 689 bp, Homo sapiens
  misc_feature: GYAE6OF01AUGY3.40.67.G01.1.454.CMB.1.raw
  modified_base (204)..(204): a, c, t, g, unknown or other
  misc_feature (204)..(204): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagncctcctctcctgcggggccagtcagcatgtggcacctctagcctgaccacaaagcctggccaggcctcccagactcctcactctatgatgcgtctccgaggccacgtcggccgtccccgcgacggttcaggtcggctaggtcgggtctggggactacggccctttcacttctaccactactcgagcacggtcctgggaccgacccgtaagttacttttacggtagttttactttaatcggtacacggtctagggtcgttacggtccccgtacgtccgggcccccgtacggtacccgggttaccggggaccgggtaacggggtaaccccggtaaggggtacgaaccccggtagttaaaccccggaaacggttaaccggtcgggttaccggaccgttaccgggtacccctaacgtacctttacccggttccgtttaccttacccgttactttacccccgttccccgtaacccttggtttaaccccgg

SEQ ID NO: 30701 - DNA, 628 bp, Homo sapiens
  misc_feature: GYAE6OF01A2HRA.40.67.G01.1.454.CMB.1.raw
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (623)..(623): a, c, t, g, unknown or other
  misc_feature (623)..(623): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctgctcccagcagccaccggagaagttgtcctgacacagtctccagccaccctgtccttgtctccagggcaaagcgccctccctctcctggcgggccagtcagcatgttgcacctctagcctaggtaaccaanaaacnctgacagctccanactcctcatcatgatcgccgtcttccgaacggccacgtggccgtcccgctaggttcagtcggtcaggtggtcagggacacgtcttccacgtcctaccacagtccaggtacacgccgtacggacgacccgtaagtacgttttcgtacggttttaaattccgttaggtacccgtagtccgaagtcggtaccgtcccgtacgtccggtcccctacggtaacggttcccggggacgggaacggggtaacccgaaaggtcgaacgtaactaaccggaaaccggtaacgtgtaaccggcttacggacctaaccgattcccggtattcctactacggttccctcccgactntaccg

SEQ ID NO: 30702 - DNA, 868 bp, Homo sapiens
  misc_feature: GYAE6OF01D5A68.40.67.G01.1.454.CMB.1.raw
  modified_base (843)..(843): a, c, t, g, unknown or other
  misc_feature (843)..(843): n is a, c, g, or t
tcagtctagcgactcacgaccggtgctcgatttagagtatacatattgggtttgggggaggaactgctcagttaggacccagagggaaccatggaacgccccagcccagcttctcttcctcctgcttactctcggcctccagcacgccgaccggaagtaaggttgtcctgacactagttcctaccaacgccctacccttcggttcctttcgtcctaccgaacggggaacaaaacggctccccttcccgttcctcccggtcgggccggggtcccagttcacggctagttcggtacgtccctacctttccgttacgccgtacggtaaaccaaacgtaaacgccgttacggccggacggtacctacccgaacgtacctcccttactaacttcgtaacgtacgtcgttccggtaccgtttccgtacccgggacgggtacccgtacggtccgggtaccccggttacccggacgtacgggttaaccgcgggttcggacgtcgggttcgggtacgtacgggacctacgttcccgttacgtaccttaccgtactaaccggtactcccggtaagcccgtaacgtccgggttacggaaccggtcccgtttaaagggtttattttttccgggttaaaggtttaccgttacgtagtaccggaagtccggtacggttaccggtaacctccgggttaccgttcccggaccctcgggtaccgggtacgggtaccggggaacggtaacgacgggttactaacgacttaaacggaacgtacggttccggtaacggtacgttacccgtacttaacggtccgtttacttccggtttacccttaacttaccccggtttaaccnccccggtaaagtcccgtttaacggg

SEQ ID NO: 30703 - DNA, 865 bp, Homo sapiens
  misc_feature: GYAE6OF01BCPNY.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctccagagtgggtcctgtccctgatgcgagggtggcgggacggtccgggcccgtagggtagttgggtacgtaaacccgttccgggggaccctcggttccccctagttacgttcgttcgtttcgttcgttacgtaacggttaacctttacgttacggtaacggtaaagggtcgtaccgtacgttcccgttaccgtacgggtcggggtacgtacggtaccgtccccggacccgaccccgggaaccccgggaacggggtaaccggtccctaacggtaacgttcgggtacggttaacggtactacgtacgttaacctttacgtttacgtacgggtccggtacccgtaccctacccgtaacgtaccggtacggtcccggtaccccgtacccgtaaccggtacgggtacgacccggtacccgtaccctacctaacgttacccacctaacgtaaccgtaacccgtaaacccgtaaaccgtaaaccggtaacccttttaccggttacccgtagggtacccgtcggtaccggtaccgttcgtacccggaacccggaccgacccgacgggaacccgtggttaccctgtttactaccttttgttacgtcggacgtacgtaccgttacgtccgtacggtttggtacgggttcggttacggtctaccggtaccggtactaccgttctacccgtacgttcggtcggtacgacgtcgtacgggcgggaccgggtcggtccgtcgttaccgg

SEQ ID NO: 30704 - DNA, 915 bp, Homo sapiens
  misc_feature: GYAE6OF01A79YP.40.67.G01.1.454.CMB.1.raw
tcagtctagcgactcacgaccggtgctcgatttagagtatacatattgggtttgggggaggaactgctcagttaggacccagagggaaccatggaacgccccagcccagcttcctcttcctcctgctactcgtggcctcccagcacgaccctacggagtaagtttcggtaccagaccacgtagttcctaccgacgcccctaccgttgttcctttcgtcctaccgaaggggacaaaggtccgtccccttccccgtctccggtccggggaccgggaccgtaggtaccgacgtcctgtttggtccggaccccttaccgttccgtttaacggtccccgtaacggttaaaacccgaaaacaaaaccggttcccgtacgggacccgacccggaccccttaccccggaacgtacccttaccttaccttattttaccgaagtttccggggtacctttccggttcccgtttaaccccgtacccggtaaccgggtcccgaccggtttcccggggaccccggttccccgggaaacgttacgggtcctaccggggtagaccgggttgggttaccgggtccggtaggggtaacccgtcgttcccttaccgtcccgtacctacgtacccaaggtacgaccgtccggcggtaccgggtacggaccctaacggttacggttttacgttttcgggttacgttttacgttacggtacgtacgtaccggtcgtacggtcccggtaccgtaccccggttccgtttcccgacccgggttttaacccggacgggggttacccgggacggggtacccggtaacgggaccggttaacgaacgtaacgaactaaccgggtgtccgggtaacgtccacgggtccctacgtcgttaccttcgtaccgttaccttccggtaccttaccgtgtaccgttaccgg

SEQ ID NO: 30705 - DNA, 768 bp, Homo sapiens
  misc_feature: GYAE6OF01A6IH3.40.67.G01.1.454.CMB.1.raw
  modified_base (165)..(165): a, c, t, g, unknown or other
  misc_feature (165)..(165): n is a, c, g, or t
  modified_base (181)..(181): a, c, t, g, unknown or other
  misc_feature (181)..(181): n is a, c, g, or t
  modified_base (260)..(260): a, c, t, g, unknown or other
  misc_feature (260)..(260): n is a, c, g, or t
  modified_base (344)..(344): a, c, t, g, unknown or other
  misc_feature (344)..(344): n is a, c, g, or t
  modified_base (702)..(702): a, c, t, g, unknown or other
  misc_feature (702)..(702): n is a, c, g, or t
  modified_base (721)..(721): a, c, t, g, unknown or other
  misc_feature (721)..(721): n is a, c, g, or t
  modified_base (754)..(754): a, c, t, g, unknown or other
  misc_feature (754)..(754): n is a, c, g, or t
tcagtctagcgactcacgaccggtgctcgatttagagtatacatagtttgggtttgggggaggaactgctcagttacggacccagacgggaaccatggaacgccccagcccagtcttcctcttccctctagctactcgcgctccagcacgccacgagtacgttcnccgtgacacgcgtacnccacgaccctcctcgttccgttagtccgtccgaacggacaagtcctcccctccgtgtccgcgggaccggtctagccganacgtcgttgaccgtacctaccgtcgttacggccgttaacggaaaccataaccggtctaccggccgtaaccggtccaccgtaccncctactacgactactgacgtctaccgtcgtccttaccggcgacgtccgtaccgtccgcccggtacgtacggttgacggtcgaccgtcggggtacgttacggcgggtaacctcggttaccctacccgtaaactccggtaacctaccgttacggaaatcccggacgttacccgggacggtacggtaacggtaccgttaaggttttacggttaccgtttacgtaccttacgtacgtacggacgtcgaaccggttcggtaccgccgttaccggtccggttacccgtacgggtaccgggtaaccggggcgtaacggggtacggtaccgacgttaccgaacgaccgtacggtacgtacggtacncggtacccgagtcttccgngtttaccgtaccgccgttactaccccggtttanccgttcgttacccg

SEQ ID NO: 30706 - DNA, 1033 bp, Homo sapiens
  misc_feature: GYAE6OF01EGGKT.40.67.G01.1.454.CMB.1.raw
  modified_base (169)..(169): a, c, t, g, unknown or other
  misc_feature (169)..(169): n is a, c, g, or t
tcagtctagcgactcacgaccggtgctcgatttagagtatacatattgggtttgggggctttctgagagtcatggatctcatgtgacaagaaagtgaagcacctgtgttcttcctcctgctggtggcggctccagatgggtcctcgtcctgatcgcgaggtggcggggnggtccgggcccgaggtagttaggtacggtaaccggttccgggaccctcgtcccctataacgttcgtcgttttgtcttacgtacggtaaccttcgtactacggaagggtacgaccgtacgtccgttacccgtacggtcggggtacgttacggtacctaccccggacccgaccccgggtacccccggaaagggggtaaacccgggccgttaaccgaacggttccggtacggttacggtaacgtacgttacgttacttaacgttttcgttaaggtccgggtacccgtacccgtaacccctacgttaaccgtacggtcggaccccggttacccctaccggtaacggtaccggtaccgaacccggtaccccctacgtaaccgttttaaccgaaccccgtaaagtaaccgtaaacccggtaccccgttaaaacccgtaaaccgtaaccccggttttaccggttttaaccccgacgggtaacccgggttacccttaccgggtaaacccgtttccgttaaccccgggtacccggaccccggtacccggaacgtaacccgggttacccggaaccggtttaccctttacggtttaacctttacgtttacggtacgggtaccggaaaccgttaaccgtaccgtttaccggttaccgttttaacggttacggggtttaacgggggttacgggttaccccggttaaccgtaaccccgggtaaacccgggttacctttacccccgtttaaacccggtcccccggtttaacgtttcccgggggttacttaaccccggggtaacgttttcccgggtacccggggggtttaaccccggggggtacccggttcccggggggttcccctttaaccccgggggg

SEQ ID NO: 30707 - DNA, 764 bp, Homo sapiens
  misc_feature: GYAE6OF01CRZAS.40.67.G01.1.454.CMB.1.raw
  modified_base (269)..(269): a, c, t, g, unknown or other
  misc_feature (269)..(269): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagccagccaccggagaagttgtcctgacacagtcctccagcccaccctgtccttgtctccgagggcaaagcgcctccctctccgtgccggggccagtcagcatggttgctacctcttagcctggtaaccaanaaacgcctggcctaggcctcccgagtacctcctctacttctagtgatcgtccgtctaccggacggccacgtccggtccgtaccccggcgtacggttcgaggtcggacgtacgggtgggtacgtacgggacctcgtacctttcaccgttctacccgacctaacgtccgacgcgtaccggtcccgtgggacccgtaccggtaagtttacgttttcgggttaacggtttttacgttaccgtaggttaccaggtaccgtacgggtcccgaccgggtcccggtaacccggttcccgggcccccctttagggtacccgggttccggggaacgggggtaacccgggtaccggtaacggggttaccggtaaaccaccggtttaaaccggaaaccggtacggttacggggtacgtacccgtccgggacctacccggttacttaccgtttaccgttaccgttacccggtacccttttccccggccccgtacgtcctttaaccggg

SEQ ID NO: 30708 - DNA, 842 bp, Homo sapiens
  misc_feature: GYAE6OF01ACCSL.40.67.G01.1.454.CMB.1.raw
  modified_base (794)..(794): a, c, t, g, unknown or other
  misc_feature (794)..(794): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtcctccagtccacccttgtcccttgtcctccgaggggaccaaaaggcgccctcccgttctccgtggccgggccagtcagctagtgtcgccaccttaccgttacgcctacggaaccctaaaacgaaaacgcccgtacgggacccgtacggtcctaccccgacggtaaccttcccgttacctacgttaccttatcggtaacgtccggtaccgttccgttacccggacgggtccctaccggtcgggtccccgtaccccgggtccgtacgggttcgtacggtcgggtacgtcggggtttacgggtccggtaacggggtacccgtacgtcccgtttacgacccttacgtacccgaccgtacctcggaacgtacctacgggtccgtaacggtaccggaccgtaacggtttaacggttttccgggttaacgttttaacgtttacgttacgtaccggtaacggccgttaagggccgtaccgaacccgggtccggtcccgggtacccccgttagggtacccgggttacccggggaccggggtaaccgggtaaccggtaacgggttccgggaactaccgtaaacggtaaacgtccggtaggtccggtcgtaccgtacccgtacgttcttaccggttnttacccgttacttaccccgttcccgtttacccgacgttctaacccggg

SEQ ID NO: 30709 - DNA, 877 bp, Homo sapiens
  misc_feature: GYAE6OF01A8XYK.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcgaggtgcgggagtccgggccaggtattgggtagaaaccgttcggggaccctgtccctctaattgtctttgtcttctcggtaacttctaactcgaagggtagcagtccttccgacgtggggctggactcccgaccgaccgacccccgaagggaaacggggcctacccgaagttcgcggttacggacacgttggtcctaagtttccgtttaaggtcgggccgtaccgtaccccgaactaaccgaggtccggccccggtccctaccggaggtaccgtccgaaccgtcccctagtaacttactacccgtaaacgtaccgaacccgtaacccggtaaccgtaaaacgtaaacccgtttaccgttttaccccggacgtaaccgtaccgttccgggtaaacccgtttccgtaacgtacccgggtaaccccggcccgtacccggtaacgggaacccgtacccgggtaccgtttcgttaccttttaatttaacggtttcgtacggtaacgggtacccgttaaccggtaccgttttccccggtttggtttacgggtttaacgggttcggggttaacggttacccgggtacccgggtaaaacccgggttccttaaacccggtttacccttaccccggttacccggtttcgggtaccgtttaacgggtaccgtaaccgggtttccggggtaccggggggacccggttcggggggtcccggtttaccccggggg

SEQ ID NO: 30710 - DNA, 849 bp, Homo sapiens
  misc_feature: GYAE6OF01DKVGR.40.67.G01.1.454.CMB.1.raw
  modified_base (153)..(153): a, c, t, g, unknown or other
  misc_feature (153)..(153): n is a, c, g, or t
  modified_base (804)..(804): a, c, t, g, unknown or other
  misc_feature (804)..(804): n is a, c, g, or t
  modified_base (813)..(813): a, c, t, g, unknown or other
  misc_feature (813)..(813): n is a, c, g, or t
  modified_base (841)..(841): a, c, t, g, unknown or other
  misc_feature (841)..(841): n is a, c, g, or t
tcagtctagcgactcacgaccggtgctcgatttagagtatacatattgggtttgggggaggaactgctcagttaggacccagagggaaccatggaagccccagcccagctttctcttcctcctgctactctggcctccagcacgccgacgganaagttcgtcctgaacactacgtcctcccgaagcccgtaacccttgttccttgttacctaccgaggggaacaaaggcgccccttccctctacccggtcgggaccgggccagtcacgtctagttggttcggacccttacccgtttaccgttacgtcccgttaacggtaaaccccaaaaacgtaaaaacggtcccgtacgggtaacccacggggtacccttaaccccgtaacggtacccttcccgtacctacgttccttaagttcgtacgtttccggtaccgtttcccgttaccggaccgggtccctaccggtccggtcccggtccccggtacttacgggttacgacgggttcggaccggtacgggttcggtaccgggtcgggaccttaccggttaccctttaccgtacccgttccttaacccaccgtaagttaccgacggtaccgtaaccgggtcccgtaacggggtaacccgtaaccccggtttaaaggttttacgtttttaccgggtttaaccggtttttacgtaccgttaccgttacgacggtacggtcggtacccgtccgtaacccgtccggtccccgttcccgttacgggaccggttacgggaccgggtacggtaccggtaggtacgactacgtaacgtacgagtcgngtcgacgtnactctcgttctccttctacttcccgtcnttcgtacg

SEQ ID NO: 30711 - DNA, 839 bp, Homo sapiens
  misc_feature: GYAE6OF01BVFUG.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcacgccaccggagaagttgtcctgacacagtcctccagcccacccttgtcctttcgtcctccaagggcaaaagcgccccttccctctcccgtggccggggcccagtccagtccgtagttcggtttcggcctaccctttccgttacgccgttacggtaaaccaaactaaaacggccgtacggcccaggcccttcccgaacgtaccttcccgtactaacgttcctaagtcgtaacgtcgtccgttcctttacccggaacgggtccctaacggtcgggtcccggtcccccgggacgtacgggtttccgacggtcggtcggtacgggtttcgggtccgtacgggggtaacctacggtacccgttttccgacgttccgtaccctaacctattaccgacggactaccggccgttacgggaaccgtacccgtaagtttcggtttttagttacggttttaactacgtcgttacgacgacgttacgggtcgtccgtacccggacgtttccgggcccccttacgggttacccgggttcggggaacccggtaacgggggaacccgtaacggggtacggtaaaccctaacggtaacccggaaaaacggtccgttcgggtaacgacccgttacggaccctaccgttacctaccggtttaccgttccgttaaccgtaccctttaccccgtcccgtaacccgcgtttaacccggg

SEQ ID NO: 30712 - DNA, 875 bp, Homo sapiens
  misc_feature: GYAE6OF01B48MK.40.67.G01.1.454.CMB.1.raw
tcagtctagcgactcacgaccggtgctcgatttagagtatacatattgggtttggggaggaactgctcagttaggacccagagggaaccatggaaacgccccagcccagcttctcttcctcctgctctctgctccagcagcctaccggacgaacgttgtacctgacactacgtctaccacgtccacccgtgtaccttcgtctaccgaggacaaacggacgcctcccgtactcctcggccgggtccagtccagctacgttcgtcggaacctaccgttaccgttaacggtcccgttacggaacctaaaacgaaacgtcccgtggaacccgtacggccctaacccggtaacctccttacccgtaacttaccttacccgtaagtccggtaactttcggaacccgtttccgtaccgaacgggggttccctacccggtaacgggttccccgggtaccccgtaccggacgggttttaaccgacggttaccggtaccggttaacgggtcggtaccgggttaggaaaccggcccggttaaccttttcgacccgttacccttacccgtactaaccgttaccgatacccgtacggtaccgtaacgggtaccaacccgggtttaagtaccgggttttgtaaacccgggttttaattccgtaacggtttccggtacgtacggtaccgtacgggtacccgtaccgttaacccggttacccggccccttaacggttccgggtaccgggtaaccgggaacgggtacccggacggttaacgaccgggtataaacccgggaccttaagggtaccgtggtaaccgtcgaaccctaggttaacccggcttacggtttcccacggttacccgttacctcccgttagtcgttaaacg

SEQ ID NO: 30713 - DNA, 674 bp, Homo sapiens
  misc_feature: GYAE6OF01ALFBS.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctccccagcagccaccggagaagttgtcctgacacagtctccagccaccctgtccttgtctccaggcaaagagcctccctctcctgcggggccagtcagcatgttgcacctctagcctggtaccaacaaaagcctggccacggcctcccagacctcctcatctatgatgcgtcttccaggccacgtgccgtcccgctacggttcagtcggctaggtcgggtctggggaccaggtcccttcgacctctacccactataccgacgcacgccgtaggacgacccggtaagttacgttttggcggtttttaattacgtcggtacacggtacacggtcggtaccgcccggactaccggggtcccccttacggtaacccggtttcccggggaccggggtaacggggtaacccgaaggggttacggaacctaacgtaaccgtaaaaccggaccgttacgggcggtcccgttcggaccctaacccgtagtttcccgttacggttacctttaccgttacccttacccgtttccccggctaaccgttcccgg

SEQ ID NO: 30714 - DNA, 514 bp, Homo sapiens
  misc_feature: GYAE6OF02GTZZU.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggcaggttcagtggcagtggtctggggacagcctttcactctcaccatcagcagcctggagcccgaagattttgcggtttatactgtcagcagcgtgccgactcggcccctgaccgttcggcggagggaccaaggtgacatcaaacgactgtggctgccacatctgtcttcattccttcccgctatcg

SEQ ID NO: 30715 - DNA, 557 bp, Homo sapiens
  misc_feature: GYAE6OF02GKMIX.40.67.G01.1.454.CMB.1.raw
  modified_base (396)..(396): a, c, t, g, unknown or other
  misc_feature (396)..(396): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggcaggttcagtggcaggtggtctgggacagccttcactctcaccatcagcagcctggacgcccgaagtnttttgcggtttatactgtcagcagcgtgccgtactcggcccctcgacggttccgggcgggtagggacccaagggttcggaacagtaccgaaacgacttggtacgggactggaccaaccgagttccgtgttaccttcgacttcccgtccccgtcctattccg

SEQ ID NO: 30716 - DNA, 519 bp, Homo sapiens
  misc_feature: GYAE6OF02IH7RZ.40.67.G01.1.454.CMB.1.raw
  modified_base (443)..(443): a, c, t, g, unknown or other
  misc_feature (443)..(443): n is a, c, g, or t
  modified_base (473)..(473): a, c, t, g, unknown or other
  misc_feature (473)..(473): n is a, c, g, or t
  modified_base (485)..(485): a, c, t, g, unknown or other
  misc_feature (485)..(485): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcgggccagtcagcatgttggcacctccttagcctggtaccaacaaaagcctggccaggctcccagactcctcatctatgatgcgtcttccagggccactggcgtcccggccaggttcagtggcagtggtctggggacaggcctttcactctcaccatcagcagccctggacgcccgaagatttttggcggttttatactgtcagcagcgtgccgactggcccctnaccggttcggcggaggaccaagggtgacanacaaacgactgnggctgccacatctgtcttcattcctccgccatcg

SEQ ID NO: 30717 - DNA, 511 bp, Homo sapiens
  misc_feature: GYAE6OF02HLC0M.40.67.G01.1.454.CMB.1.raw
  modified_base (440)..(440): a, c, t, g, unknown or other
  misc_feature (440)..(440): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggcaggttcagtggcaggtggtctgggacagccttcactctcaccatcagcagcctggacgcccgaaagtattttgcggtttattactgtcagcagcgtgccgactcggcccctnaccgttcggcggagggaccaagggtgacatcgaaacgactgtggctgcacatctgtctcatctccgcatcg

SEQ ID NO: 30718 - DNA, 523 bp, Homo sapiens
  misc_feature: GYAE6OF02HYLJ5.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggtccagtggcagtggtctgggacagcctttcactctcaccatcagcagcctggacgcccgaagtattttgcggttttattactgtcagcagcgtgccgactcggcccctgaccgttcgggcggtagggaccagggtgacatacaaacgactgtggctgccacatctgtcttcattccttcccgcctatccg

SEQ ID NO: 30719 - DNA, 525 bp, Homo sapiens
  misc_feature: GYAE6OF02FR759.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggacgcccgaagattttgcggtttattactgtcagcagcgtgccgactcggcccctcgacggttcggcgggacgggaccgaagggtcggacagtcaaacgactgtggctgccaccatctgtcttcacttcctcccgctatcg

SEQ ID NO: 30720 - DNA, 596 bp, Homo sapiens
  misc_feature: GYAE6OF02JJ59D.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcgggccagtcagcatgttggcacctccttagcctggtaccaacaaaagcctggccaggctccagactcctcatctatgatgcgtcttccagggccactggcgtcccggccaggttcagtggcaggtggtctgggacaggccttcactctcaccatcagcagcctggacgcccgaagtacttttcgacggttttatacgtggttaccagtcaggtcgtcgcccgtactcggtccctcgacggtttcggcggtacgggacccaagggttcgaacgagtacgaaacgtactcggttacggacttcgggacctaaccgtaagttccgtttaggttacctttaccgaactttccccggtttaccccgaccgtaacgttcccgg

SEQ ID NO: 30721 - DNA, 510 bp, Homo sapiens
  misc_feature: GYAE6OF02GR8V3.40.67.G01.1.454.CMB.1.raw
  modified_base (439)..(439): a, c, t, g, unknown or other
  misc_feature (439)..(439): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtggtctgggacaggcctttcactctcaccatcagcagcctggagcccgaagattttgcggtttattactgtcagcagcgtgccgactggcccctnacgttcggcggagggaccaaggtgacatcaaacgactgtgctgcaccatctgtcttcatcttcccgcatcc

SEQ ID NO: 30722 - DNA, 537 bp, Homo sapiens
  misc_feature: GYAE6OF02GIUB3.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctcttagcctggtaccaacaaaagcctggccaggctcccagactcctcatctatgatgcgtcttccagggccatggcgtcccggcaggttcagtggcaggtggtctggggacagcctttcactctcaccatcagcagcctggacgcccgaagattttgcggtttatacgtgtcagcagcgtgccgactcggcccctgaccggttcggcgggacgggaccaagggtcggaactagtacgaaacccgtactggtaggctggccaccattctgtcttcagttccttcccgctattccg

SEQ ID NO: 30723 - DNA, 542 bp, Homo sapiens
  misc_feature: GYAE6OF02H9T76.40.67.G01.1.454.CMB.1.raw
tcagtctagcgactcacgaccggtgctcgatttagagtatacatattgggtttgggggaggaactgctcagttaggaccctagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctcttagcctggtaccaacaaagcctggccaggctcccagactcctcatctatgatgcgtcttccagggccactggcgtcccggcaggttcagtggcagtgggtctgggacagccttcactctcaccatcagcagcctggacgcccgaagtattttgcggttttatactgtcagcagcgtgccgactcggcccctcgaccgttcgggcgacggggaccaagggtggacagtacgaaacgactggtacggtctgccaccgattcctggttcttcgacttccgtttcccgccctattcccg

SEQ ID NO: 30724 - DNA, 640 bp, Homo sapiens
  misc_feature: GYAE6OF02HVYKZ.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcgggccagtcagcatgttggcacctccttagcctggtaccaacaaaagcctggccaggctcccagactcctcatctatgatgcgtcttccagggccactggccgtcccggccaggttcagtggcaggtggtctgggacagcctttcactctcaccatcacgcacgcctgggacgccccgtaaagtacgtttttggacgggtttttaattaccgtggttccaagtccaaggtccgtcgcccgacgttccgggccccttcgtacccgggtttccgggaccggggtaacggggacccctaaagggggtcggaaccgtagtaaccgaaaaaccggtaccgttggtacgggtccgttacggaccctaacccgtaagttcccgtgttcctttaccacgtttccccgtttccccggaccctattaccgg

SEQ ID NO: 30725 - DNA, 536 bp, Homo sapiens
  misc_feature: GYAE6OF02GVUEQ.40.67.G01.1.454.CMB.1.raw
  modified_base (394)..(394): a, c, t, g, unknown or other
  misc_feature (394)..(394): n is a, c, g, or t
  modified_base (512)..(512): a, c, t, g, unknown or other
  misc_feature (512)..(512): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaacggggctccaatgcgttggacatgtcaattcttatgggcgctcccactacagtgcggccctccagagtcgagccctcatatccatagacacgtccaagaaccagtttcccngacgctgacgtctgtcgaccgccgcagacacggctgtctattattgtgcgagactagcctttctgttagtggggttacttgccgaccgggatacgtactcctaccgttcgcttggacntcgtggggccgaggggtcctcggg

SEQ ID NO: 30726 - DNA, 549 bp, Homo sapiens
  misc_feature: GYAE6OF02IPE5H.40.67.G01.1.454.CMB.1.raw
  modified_base (400)..(400): a, c, t, g, unknown or other
  misc_feature (400)..(400): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaagcctggccaggctcccagactcctcatctatgatgcgtcttccaggggccacgtggccgtcccgggccaggtttcagtggcaggtggtctggggacagccttcactctcaccatcagcagcctggacgcccgaagnttttgcggttttatctgtcagcagcgtgccgactcggcccctcgccggttcgggccggagggaccaagggtgaaccagtaccgaaacgacttggtaggccgtagcctaaccgattccgtgttccttctattcccttcccggcctatccg

SEQ ID NO: 30727 - DNA, 591 bp, Homo sapiens
  misc_feature: GYAE6OF02GVGUZ.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccacgcccccaggaaacgggctccaatgcgttggacatgtcaattcttagtgggcgcctcccactacagtcgccggccctcagacgtcgacgccctcatactccaatacgaccacgtaccaaagtaaccctacgttttcccagaccgtctcgacgtctcgtcgacccgccgacgacgaccgacggcttgtctatttagtgtgcgagactcgtccttgtgttaggtcggggtacttggaccgtacccgggtataccgtcctaccgtaccgttcggtcgttacggactcgttccggtcgggggccggtacggggtcccttccggg

SEQ ID NO: 30728 - DNA, 515 bp, Homo sapiens
  misc_feature: GYAE6OF02GA2KT.40.67.G01.1.454.CMB.1.raw
  modified_base (482)..(482): a, c, t, g, unknown or other
  misc_feature (482)..(482): n is a, c, g, or t
  modified_base (492)..(492): a, c, t, g, unknown or other
  misc_feature (492)..(492): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtccggccaggttcagtggcagtggtctgggacagccttcactctcaccatcagcagcctggacgcccgaagtacttttgcggtttatactgtcagcagcgtgccgactcggcccctgacgttcgggacggacgggaccagggtcgacagtacaacgactgnggctgcaccntctgtcttcactctccgctatcg

SEQ ID NO: 30729 - DNA, 546 bp, Homo sapiens
  misc_feature: GYAE6OF02GQB2G.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtggtctgggacagccttcactctcacatcagcagcctggacgcccgaagtcttttgcgttttatactgtcagcagcgtgccgactcggcccctgaccggttcggcgggtacgggaccaagggtcgaacatacgaaacgtacgtggtacggcgtgacccactaagttccgttcgtcttcacttcccttacccggcctagtccg

SEQ ID NO: 30730 - DNA, 533 bp, Homo sapiens
  misc_feature: GYAE6OF02GCVM3.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtcccaagaaccagttttccctgacgctgacgtctgtgaccgccgcagacacggctgtctattattgtgcgagactacgccttctgtagtggggtacttgcacccgggatactactcctaccttcggcttggacacgtctggggccgaggggcctccggg

SEQ ID NO: 30731 - DNA, 515 bp, Homo sapiens
  misc_feature: GYAE6OF02FTUE6.40.67.G01.1.454.CMB.1.raw
  modified_base (483)..(483): a, c, t, g, unknown or other
  misc_feature (483)..(483): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctcctctcctgcgggccagtcagcatgttggcacctccttagcctggtaccaacaaaagcctggccaggcctcccagactcctcatctatgatgcgttcttccgagggccacgtggccgtcccggccaggttcagtggcaggtggtctgggacaggccttcactctcaccatcagcagcctggacgcccgaagtcgttttgacggtttatacgtgtcagcagcgtcgccgactcggccctcgcgtcggcgagggaccaggtgacatacgaacgctgngctgcacntctgtctcnttcctcccgctatcg

SEQ ID NO: 30732 - DNA, 523 bp, Homo sapiens
  misc_feature: GYAE6OF02FP6CP.40.67.G01.1.454.CMB.1.raw
  modified_base (391)..(391): a, c, t, g, unknown or other
  misc_feature (391)..(391): n is a, c, g, or t
tcagtctagcgactcacgaccggtgctcgatttagagtatacatattgggtttggggaggaactgctcagttaggacccagagggaaccatggaagccccagcccagctctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtccggcaggttcagtggcagtggtctgggacagccttcactctcaccatcagcagcctggacgcccgaagnttttgcggtttatactgtcagcagcgtgccgactcggcccctgaccgttcggcggagggacctagggtcgacactacgaaacgactggtggctggccaccgtatctgtcttcacttccttcccgcctatccg

SEQ ID NO: 30733 - DNA, 537 bp, Homo sapiens
  misc_feature: GYAE6OF02F0WTJ.40.67.G01.1.454.CMB.1.raw
  modified_base (403)..(403): a, c, t, g, unknown or other
  misc_feature (403)..(403): n is a, c, g, or t
  modified_base (464)..(464): a, c, t, g, unknown or other
  misc_feature (464)..(464): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccacgcccccaggaaacgggctccaatgcgttggacatgtcaattcttatgggcgctcccactacagtcgccggccctccagacgtcgacgccctcatactccatacgacacgtccaagaaccctagttttcccngacgctgacgtctgtcgaccgccgcacgacacgctgtctattattgtgcgagactagcttntgtagtgggtactgacaccggatacgtactcctaccttcggcttggactgtccgtggggccgagggcctcggg

SEQ ID NO: 30734 - DNA, 543 bp, Homo sapiens
  misc_feature: GYAE6OF02JAV23.40.67.G01.1.454.CMB.1.raw
  modified_base (517)..(517): a, c, t, g, unknown or other
  misc_feature (517)..(517): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgtggcacctccttagcctggtaccaacaaaagcctggccaggctccccagacctcctcatctatgatgcgtcttccagggccacgtcggcgtccccggccaggttcaggtggcaggtgggtctggggacaggcctttcacctctcaccatccagcacggcctaggacgcccgaagtcttttggcggttttattactgtcagcagcgtgccgactcggcccctcgacggttcggcgggtacgggaccgagggtcgactagcgaaacgactggtcggctgcaccnttctgtcttcattcctcccgctagtc

SEQ ID NO: 30735 - DNA, 584 bp, Homo sapiens
  misc_feature: GYAE6OF02HS2HV.40.67.G01.1.454.CMB.1.raw
  modified_base (364)..(364): a, c, t, g, unknown or other
  misc_feature (364)..(364): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcgggccagtcagcatgttggcacctccttagcctggtaccaacaaaagcctggccaggcctcccagacctcctcatctatgatgcgtcttccagggccactggcgtcccggcaggttcagtggcaggtggtctgggacaggccttnactctcaccatcagcagcctggacgcccgaagtcttttggacggtttatacgtgtcagcaggcgtcgccgactcggccccttcgaccggttcggaccgggagggaccgtaagggtcgaacgacgttaaccgaaacgtaccttggttacggccgttgccaaccgtacttccgttaggttcctttaccacgtttccccgtttccccgacccgttattcccgg

SEQ ID NO: 30736 - DNA, 537 bp, Homo sapiens
  misc_feature: GYAE6OF02ILFJA.40.67.G01.1.454.CMB.1.raw
  modified_base (394)..(394): a, c, t, g, unknown or other
  misc_feature (394)..(394): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattctatgggcgctcccactacagtgcggccctccagagtcgagccctcatatccatacgacacgtccaagaaccagttttcccngacgctgacgtctgtcgaccgccgcacgacacggctgtctattattgtgcgagactagccttcgtgtaggtggggtacttgcgacccgggatacgtctccaccttcggcttggactagtccgtggggccgagggccttccggg

SEQ ID NO: 30737 - DNA, 525 bp, Homo sapiens
  misc_feature: GYAE6OF02GFJPK.40.67.G01.1.454.CMB.1.raw
  modified_base (454)..(454): a, c, t, g, unknown or other
  misc_feature (454)..(454): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagttttccctgacgctgacgtctgtgaccgccgcagacacggctgtctattatgtgcgagactagccttntgtagtggggtacttgcaccggatacgtactccaccgttcgcttgactatcgtgggccgagggcctccggg

SEQ ID NO: 30738 - DNA, 518 bp, Homo sapiens
  misc_feature: GYAE6OF02HOHCV.40.67.G01.1.454.CMB.1.raw
  modified_base (262)..(262): a, c, t, g, unknown or other
  misc_feature (262)..(262): n is a, c, g, or t
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
  modified_base (497)..(497): a, c, t, g, unknown or other
  misc_feature (497)..(497): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaanaaaagcctggccaggctcccagactcctcatctatgatgcgtctcaggccactggcgtccgcaggttcagtggcagtggtctgggacagcctttcactctcaccatcagcagtcctaggacgacccgaagtacttttggcggttttaattactgttcagcaggtcgtgccgatcggccctgacgttcggcggaggaccaggtcgacancgaaacgntgtagctgacacgattcgngttctcatccttcccgcatcg

SEQ ID NO: 30739 - DNA, 568 bp, Homo sapiens
  misc_feature: GYAE6OF02HKQU1.40.67.G01.1.454.CMB.1.raw
  modified_base (204)..(204): a, c, t, g, unknown or other
  misc_feature (204)..(204): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcgggccagtcagcatgttggcacctccttagcctggtaccaacaaaagcctggccaggctcccagacctcctcatctatgatgcgtcttccagggccactggccgtcccggcaggttcaggtggcaggtgggtctgggacaggcctttcactctcaccatcagcagcctggacgcccgaagtattttggcggtttattacgtggtcggcagcgtcgcccgactcggcccctcgacggttccgggcggacgggaccgaagggtcggaactagtaccgaaaacgtacgtggtcggcttcggaccacctattcttggtaccttcgacttcccgttcccggctacgttctacgg

SEQ ID NO: 30740 - DNA, 547 bp, Homo sapiens
  misc_feature: GYAE6OF02GZS3R.40.67.G01.1.454.CMB.1.raw
  modified_base (505)..(505): a, c, t, g, unknown or other
  misc_feature (505)..(505): n is a, c, g, or t
  modified_base (529)..(529): a, c, t, g, unknown or other
  misc_feature (529)..(529): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccacgtggggctggatccgccacgccccaggaaacggggctccaatgcgttggacatgtcaattctatggcgctccatacagtgccgtcctcagagtcgacgccctacacttactccatacgacaaccgtaccaaacgtaacctacgttttccctagaccgtctggaacgttcgtggtcgaaccgccgacacgacacggctgtctaattattgagcgagtactagtccttctgtagtggggtacttgacaccggntacgtactccacgtcgcttgactntcgcgggcgacggctcgg

SEQ ID NO: 30741 - DNA, 675 bp, Homo sapiens
  misc_feature: GYAE6OF02I9H9H.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccacgcccccgaggaaacggggctccaatgcgttgacatgtctaattcttagtgggcgtcctcccactacagtcgcggccctcgacgacgtcgacgccctcatactccatacacaccgtaccaaacgtaacctaccgttttaccctacgaccgtactcggtaccgttcgtggttaccgacccggcccgtaccgaacggacccgaacgggtccttacggttaccttacttttaagttcggtcggaccgtaacgtaaccgttacgtcccgttttacgttacgggttagggttacgggggttaccttacggaccggtacccgggtattaccgtacccttcccgtacccgttcggtaccgttaggaccgtacgttcggtccggggtacccggacggggtcccgttcccggg

SEQ ID NO: 30742 - DNA, 595 bp, Homo sapiens
  misc_feature: GYAE6OF02HD7OP.40.67.G01.1.454.CMB.1.raw
  modified_base (417)..(417): a, c, t, g, unknown or other
  misc_feature (417)..(417): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccacgtggggctggatccgccacgcccccgaggaaaggggcctccaatgcgttggacatgtcaattcttatcgggcgcctcccactacagtcgccggtccctccgagacgtccgacgccctcactactaccatacgaaccacgtaccaaacgaacctacgtttcccngactctcgtacgtctgtcgacccgccgcacgaccaccggtctcgtacttattactggtgacgtagactacgtccttcgtgtacgggtgggtacttcgaccgtaccggattaccgtactcccgtacgttcggtcgttaggactcgtcggtccggggacggtaccggggtccgttccggg

SEQ ID NO: 30743 - DNA, 664 bp, Homo sapiens
  misc_feature: GYAE6OF02JVKW5.40.67.G01.1.454.CMB.1.raw
tcagtctagcgactcacgaccggtgctcgatttagagtatacatattggggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggactccgccacgcccccgaggaaacgggctccgaagtgcgttggaccagtgtactaattctagtgggcgcgtacccactacgacgtcgccggacctcgagacgtcgacgccctacactacgtccagtacgactacgtaccaaagtaaccctacgttttcccgaggaccgtactcgtaaccgtcttacggtaccgacccgtaccgcgtaacgaaccgtacggtcctacgttaccttaagtttacgtcggttacgcgtaacgtaccgttaacgtccttacgtagggttacggtacgggttaaccttcgaaccgtacccgggtacttaaccgtaaccgtcctaaccggttccggacgttacggacgtacgtccggtcggggtacccgtaggggtcccttccggg

SEQ ID NO: 30744 - DNA, 535 bp, Homo sapiens
  misc_feature: GYAE6OF02HQSCI.40.67.G01.1.454.CMB.1.raw
  modified_base (508)..(508): a, c, t, g, unknown or other
  misc_feature (508)..(508): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcgggccagtcagcatgttgcacctccttagcctggtaccaacaaaagcctggccaggctcccagacctcctcatctatgatgcgttcttccgagggccacgtcggccgtcccggctaggttcagtggcaggtggtctggggacagcctttcactctcaccatcagcacgcctggacgcccgaagtattttggacgtttatactgtacagcagcgtgcccgacgtcggcccttcgacggttcggcgggacggaccaagggtcgaacataccgaacgactgtggctgccacnttctgtcttcattccctcccgctatcg

SEQ ID NO: 30745 - DNA, 559 bp, Homo sapiens
  misc_feature: GYAE6OF02HYF08.40.67.G01.1.454.CMB.1.raw
  modified_base (359)..(359): a, c, t, g, unknown or other
  misc_feature (359)..(359): n is a, c, g, or t
  modified_base (522)..(522): a, c, t, g, unknown or other
  misc_feature (522)..(522): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctcttagcctggtaccaacaaaagcctggccaggctcccagactcctcatctatgatgcgttcttccgagggccactggccgtcccggccaggttcagtggcaggtggtctgggacnggtccttcactctcaccatcagcagccgtggacgcccgaagtattttggcggttttatactgtcagcagcgtgccgactccggtcccctgaccggttccgggacgggtacgggaccgtaagggtcggaacagtacgaaacgacgttggtcgcgtgaccacctnttcgtcgtcttcgtacttcccgttcccgcctataccg

SEQ ID NO: 30746 - DNA, 583 bp, Homo sapiens
  misc_feature: GYAE6OF02HQWDD.40.67.G01.1.454.CMB.1.raw
  modified_base (323)..(323): a, c, t, g, unknown or other
  misc_feature (323)..(323): n is a, c, g, or t
  modified_base (366)..(366): a, c, t, g, unknown or other
  misc_feature (366)..(366): n is a, c, g, or t
  modified_base (402)..(402): a, c, t, g, unknown or other
  misc_feature (402)..(402): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaacggggctccaatgcgttggacatgtcaattcttatgggcnctcccactacagtgccggccctcagacgtcgagccctcatacnccatagaccacgtaccaaagaacctacgttttcccngaccgctcgacgtctgtcgaccgcccgcacgacacggctagttctattattgtcgcgagactagtccttacgtggttacggtgggtacgttacgcctaccggggtattaccgtactccctaccgttccggtcgttacggactacgtccggtcggggtacccggacggggtccttaccgggg

SEQ ID NO: 30747 - DNA, 602 bp, Homo sapiens
  misc_feature: GYAE6OF02IKTNH.40.67.G01.1.454.CMB.1.raw
  modified_base (478)..(478): a, c, t, g, unknown or other
  misc_feature (478)..(478): n is a, c, g, or t
  modified_base (491)..(491): a, c, t, g, unknown or other
  misc_feature (491)..(491): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcgaaggtagcagcttccacgtgggctggactccgccacgcccccgaggaacggggctccaatgcgttggacatgtcaattctatgggcgctcccactacagtcgcggccctcagagtcgacgccctcatactccatacgacacgtaccaacgtaaccctagttttccctagaccgtctacggaccgttctggttacgacccgccgaccagaccacggtctcgttactatttacgtgtgacganactagccctttgnggttaggtcggggttaccttggaccgtaacccgggtataccgtaactcccgtaccgttccggacttaggacctacgttcggtaccgggggccgtacggggcccttccgggg

SEQ ID NO: 30748 - DNA, 541 bp, Homo sapiens
  misc_feature: GYAE6OF02HA1L4.40.67.G01.1.454.CMB.1.raw
  modified_base (205)..(205): a, c, t, g, unknown or other
  misc_feature (205)..(205): n is a, c, g, or t
  modified_base (378)..(378): a, c, t, g, unknown or other
  misc_feature (378)..(378): n is a, c, g, or t
  modified_base (473)..(473): a, c, t, g, unknown or other
  misc_feature (473)..(473): n is a, c, g, or t
tcagtctagcgactcacgaccggtgctcgatttagagtatacatattgggtttgggggagggaacgtgctcagttaggacccagagggaacatggaagcccagcccagcttctcttcctcctgctactctggctcccagcagccaccggagaacgttgtcctgacacagtctccagccaccctgtccttgtctccagggcaaagngcctcctctcctgcgggccagtcagcatgtgcactcttagcctggtaccaacaaaagcctaggccaggctcccagactcctcatctatgactgcgtcttcaggccatgcgtccgcagttcagtgcagtggtctagggacagcctttcactctcacagtcagctagcctggacncccgaaagtcttttcgtcggtttatacgtgtccagcgtagcgtcgccgactcggccctgacggttccggacggacggaccgtaagggtcgaactntaacgaaacgatggtcgctggccaacctagttcgtgtttctcgattcccgtttacccgcctattccgg

SEQ ID NO: 30749 - DNA, 607 bp, Homo sapiens
  misc_feature: GYAE6OF02HPF1W.40.67.G01.1.454.CMB.1.raw
  modified_base (326)..(326): a, c, t, g, unknown or other
  misc_feature (326)..(326): n is a, c, g, or t
  modified_base (366)..(366): a, c, t, g, unknown or other
  misc_feature (366)..(366): n is a, c, g, or t
  modified_base (406)..(406): a, c, t, g, unknown or other
  misc_feature (406)..(406): n is a, c, g, or t
tcagtctagcgactcacgaccggtgctcgatttagagtatacatattgggtttgggggatttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccacgtggggctggactccgccacgcccccgaggaacgggcctccaatgcgttggacatgtcaattctagtcggcnctccactacagtcgccggccctcgagacgtcgagccctanactactccatacgacacgtaccaacgaacctacgtttccngacgtctagacgtctgcgaccgcgacagaccacggctgtactattatggtcgacgtacgtactacgtcctttacgtgttacgggttacgggtacttcgaccgtacccgggtattacccgtacctacccgtaccgttccgggtaccttacgggactacggttccggttaccggggggcccgtacgggggtccccttccgggg

SEQ ID NO: 30750 - DNA, 573 bp, Homo sapiens
  misc_feature: GYAE6OF02F85O9.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctggcgggccagtcagcatgttggcacctccttagcctggtaccaacaaaagcctggtcaggctcccagactcctcatctatgatgcgtcttccagggccactggccgtcccggcaggttcagtggcagtggtctgggacagccttcactctcaccatcagcagcctggacgcccgaagtacttttggacggtttattactgtcagcagtcgtcgccgtacgtcggcccctcgtaccgttccgggcgggaacggggaccgtaagggtcggaaccagttaccgaaacgtacgtggtggccgtggaccaccgtagttccgttgttccttacctactttcccgttcccgactattacccgg

SEQ ID NO: 30751 - DNA, 539 bp, Homo sapiens
  misc_feature: GYAE6OF02HPC4E.40.67.G01.1.454.CMB.1.raw
  modified_base (379)..(379): a, c, t, g, unknown or other
  misc_feature (379)..(379): n is a, c, g, or t
  modified_base (401)..(401): a, c, t, g, unknown or other
  misc_feature (401)..(401): n is a, c, g, or t
  modified_base (519)..(519): a, c, t, g, unknown or other
  misc_feature (519)..(519): n is a, c, g, or t
  modified_base (525)..(525): a, c, t, g, unknown or other
  misc_feature (525)..(525): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggcctcccagactcctcatctatgatgcgtcttccagggccactcgggccgtcccggctaggttcagtggcaggtggtctgggacagccttcactctcacatcngcagctaggcgacccgaagttnttttggcgtttatacgtgtcagcagcgtcgccgactcggcccctgtaccggttcggacgggacggtaccgagggttacgacgtacgtaccgaaacgcgtgtcgcgtggaccacatctntcttcnttcctccgctatcg

SEQ ID NO: 30752 - DNA, 513 bp, Homo sapiens
  misc_feature: GYAE6OF02JEO2S.40.67.G01.1.454.CMB.1.raw
  modified_base (204)..(204): a, c, t, g, unknown or other
  misc_feature (204)..(204): n is a, c, g, or t
  modified_base (368)..(368): a, c, t, g, unknown or other
  misc_feature (368)..(368): n is a, c, g, or t
  modified_base (478)..(478): a, c, t, g, unknown or other
  misc_feature (478)..(478): n is a, c, g, or t
  modified_base (488)..(488): a, c, t, g, unknown or other
  misc_feature (488)..(488): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcggggccagtcagcatgttggcacctccttagcctggtaccaacaaaagcctggccaggctcccagactcctcatctatgatgcgtcttccagggccacgtgcgtcccggcaggttcagtgcagtggtctgggacagcttcactctcacntcagcagcctggacgcccgaagtattttcggacggttttatactgtcagcagcgtgccgctcggcccctgcgttcggcggaggaccaaggtcgacatcaaacgtactggngctgctaccntctgtcttcacttcctcccgcatcg

SEQ ID NO: 30753 - DNA, 604 bp, Homo sapiens
  misc_feature: GYAE6OF02IURJ0.40.67.G01.1.454.CMB.1.raw
  modified_base (204)..(204): a, c, t, g, unknown or other
  misc_feature (204)..(204): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
  modified_base (406)..(406): a, c, t, g, unknown or other
  misc_feature (406)..(406): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctcctctcctgcgggccagtcagcatgttggcacctccttagcctggtaccaacaaaagcctggccaggcctcccagactcctcatctatgatgcgtcttccgagggccacgtcggccgtcccggcctaggttcagtggcaggtgggtctgggacngtccttcgactctcaccntcagcagccgtggacgacccgaagtnttttggcggttttatcgtgtacagctatccgtcgccgtactccggcccctcgtaccggttccggacgggtacgggtaccgtaaggggtcggaaccacgttaaccgaaaccggtaccgttgggtcgtaccgtcggacctaaccgtacttcgttcgtttaccttccgtactttccccgtttccccggtacctacgttccg

SEQ ID NO: 30754 - DNA, 732 bp, Homo sapiens
  misc_feature: GYAE6OF02GC8G2.40.67.G01.1.454.CMB.1.raw
  modified_base (209)..(209): a, c, t, g, unknown or other
  misc_feature (209)..(209): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgactacagtctccagtccaccctgtccttgtctccagggcaaaaggcnccctcctctcctgggccggggctagtcagctagttggtcgcaccttccttacgccgttagtaaccaaaacgaaaacgccgtacggaccgacggtcctacccgacgacctcctacacttctatgtagtcgtaccgttccttaccgacgggcctacggtcgggcccggtccccggacgtacggttcgacggtcggactagggttcggttcgtacggggactacggttccctttacgaccttccgtaccctaaccgtactacgacgaccgtacgtccggttagggacccgtacccggtaaagttacgtttttacggttaccgttttaattaccgttacgtaccacggtcgacggtcgtacgacccgtacgtaccggtcccctagtaccgggttcgggacgggaacgggaaccgtaaggggtcgaacctacgtaacgtaaaaccgtagttcgggacggtacgtcggacctaaccgtacttccgttgttccttacgtacctttccgtccccgttaccgttcgtaacgg

SEQ ID NO: 30755 - DNA, 611 bp, Homo sapiens
  misc_feature: GYAE6OF02G9FQQ.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctcttagcctggtaccaacaaagcctggccaggctccagactcctcatctatgatgcgtcttccgacgggccacgtcggtccgtcccggccgacggttcgaggtggcaggtcgggtcgtggggacacggtcctttcacgtctccacctatcgacgcacgccgtggacgaccgaagttattttcggtcggtttattacgtgtacagcgagcgtcgccgacgtcggcccctcgaccggttccggacgggtacgggaccgtaagggtcggactacgtacgaaacgacgtcggtaggtcgtcggacctaacctacgttccgttacggtttcctttaccgtaccgttaccccgtttccccgacgtattacccgg

SEQ ID NO: 30756 - DNA, 527 bp, Homo sapiens
  misc_feature: GYAE6OF02IJLFX.40.67.G01.1.454.CMB.1.raw
  modified_base (213)..(213): a, c, t, g, unknown or other
  misc_feature (213)..(213): n is a, c, g, or t
  modified_base (513)..(513): a, c, t, g, unknown or other
  misc_feature (513)..(513): n is a, c, g, or t
  modified_base (522)..(522): a, c, t, g, unknown or other
  misc_feature (522)..(522): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctntcctgcggggccagtcagcatgttggcacctcttagcctggtaccaaacaaaagcctggccaggctcccagactcctcatctatgatgcgtcttccagggccactggcgtcccggcaggttcagtggcagtggtctgggacaggcctttcactctcaccatcagcacgcctgggacgcccgaaagtattttggcggttttatacgtgttcgagctagccgtgcccgagtcggcccctgacggttcgggcgagggaccaaggtcgacatccgaaacgatgtggctgccacatctgtccttnactcctccncatcg

SEQ ID NO: 30757 - DNA, 605 bp, Homo sapiens
  misc_feature: GYAE6OF02HTF7A.40.67.G01.1.454.CMB.1.raw
  modified_base (209)..(209): a, c, t, g, unknown or other
  misc_feature (209)..(209): n is a, c, g, or t
  modified_base (261)..(261): a, c, t, g, unknown or other
  misc_feature (261)..(261): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (565)..(565): a, c, t, g, unknown or other
  misc_feature (565)..(565): n is a, c, g, or t
  modified_base (582)..(582): a, c, t, g, unknown or other
  misc_feature (582)..(582): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaacgttgtacctgactacagtcctccgagcctaccctgtccttgtcctcagggcaagncctcctctcctgcgggcaggtcagcatgttgcacctcttagctggtaccaanaaagcctggccaggctcccagactcncatntangatgctctcgaggccatggctccgcaggttcagtgacaggtggtctgggactacggccttagactcctacgacctatccgagtccacggtccctagggacgtacccggtaagttacttttcggcgggttttaactacggtcgtaccgtagtccgacgtccggtggtacccgtacgtccggtaccccgtagtacccgggtttcggaacgggtacggtaacccgaagggtcgaacctagtacgaaacgacgttggtacgccgtagccaccgtntaccgttgtacccttcncgtttcccaccgtctattaccgg

SEQ ID NO: 30758 - DNA, 524 bp, Homo sapiens
  misc_feature: GYAE6OF02G1RYH.40.67.G01.1.454.CMB.1.raw
  modified_base (397)..(397): a, c, t, g, unknown or other
  misc_feature (397)..(397): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgtgcacctccttagcctggtaccaacaaaagcctggccaggctcccagactcctcatctatgatgcgtcttccagggccactggcgtcccggccaggttcagtggcaggtggtctggggacaggccttcactctcaccatcagcagcctggacgcccgaagtnttttggcggtttattacgtgtcagcagccgtgccgactcggcccctgaccgttcggcggagggaccgaggtcgacagtcaacgactgtggctgcacgatctgtcttcacttccttcccgcctatccg

SEQ ID NO: 30759 - DNA, 569 bp, Homo sapiens
  misc_feature: GYAE6OF02FWU1I.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcgggccagtcagcatgttgcacctccttagcctggtaccaacaaaagcctggccaggctcccagactcctcatctatgatgcgttctccgacgggccacgtcggccgtcccggcctaggttccaggtcggcaggtgggtcgtggggacacggtccttcactctcaccatccagcacgccgtggacgcccgaagtcgttttgcggtttattactcgtcagctagtcgtcgccgtacgtcggccctcgcggttcgggcggacgggaccagggtcgacagtaccgaaacgtactgtacggctcgacctaccattccgtcggttaccttcgacctttccgtccccgctacgtccg

SEQ ID NO: 30760 - DNA, 525 bp, Homo sapiens
  misc_feature: GYAE6OF02HWUAP.40.67.G01.1.454.CMB.1.raw
  modified_base (204)..(204): a, c, t, g, unknown or other
  misc_feature (204)..(204): n is a, c, g, or t
  modified_base (393)..(393): a, c, t, g, unknown or other
  misc_feature (393)..(393): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcgggccagtcagcatgttggcacctcttagcctggtaccaacaaaagcctggccaggctcccagactcctcatctatgatgcgtcttccagggccactggcgtcccggcaggttcagtggcagtggtctgggacagccttcactctcaccatcagcagcctggacgcccgaagtnttttgcggtttattacgtgttcagcagcgtgcccgtactcggcccctgaccgttcggcggacgggaccaagggtcgacgatacgaacgactgtgcgtgccaccatcctgtcttcacttcctcccgccattcg

SEQ ID NO: 30761 - DNA, 671 bp, Homo sapiens
  misc_feature: GYAE6OF02HJFJR.40.67.G01.1.454.CMB.1.raw
  modified_base (213)..(213): a, c, t, g, unknown or other
  misc_feature (213)..(213): n is a, c, g, or t
  modified_base (220)..(220): a, c, t, g, unknown or other
  misc_feature (220)..(220): n is a, c, g, or t
  modified_base (303)..(303): a, c, t, g, unknown or other
  misc_feature (303)..(303): n is a, c, g, or t
  modified_base (641)..(641): a, c, t, g, unknown or other
  misc_feature (641)..(641): n is a, c, g, or t
tcagtctagcgactcacgaccggtgctcgatttagagtatacatattggggtttgggggaggaactcgctcagttaggacccagagggaaccagtggaagccccaggccccagcttctcttcctccgtgctactctggctcccaggcacgccaccggagaagttgtcctgacacagtctccagccaccctgtccttcgtctccagggcaaagngcctccnctcctggcgggccagtcagcagtgtggccacttccttagcctggtaccaacaaagcctggaccaggctaccgagacctcctanattctatgaactgacgttccttccgaggtccagtcgggccgttcccggcgtaggttacgacggtggctaggttcgggtcgagggacacggtccttacgaccttcgtaccacctagtacgagaccacgcccggttagggaccgtcccgtaaaggttcgtttttaggtaccggttttaattacttcggtactaacggtcgtaaggtccgtccgaccgtaccgttcggacccctttagaccgggttccgggaccggtagggaaccgaagggtcgggaacctagaaccgtaaacgtacgtggtacggcttacggccctacctacgttaccttgttacccttntaacccttcccgttaccccgtcctattacg

SEQ ID NO: 30762 - DNA, 527 bp, Homo sapiens
  misc_feature: GYAE6OF02F12VX.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtacccaacaaaagcctggccaggctcccagactcctcatctatgatgcgtcttccagggccactggcgtcccggccaggttcagtggcagtgggtctggggacagcctttcactctcaccatcagcagcctggagcccgaagattttgcggtttattacgtgtcagtcagcgtgcccgactcggcccctgacgttcggcggagggaccaagggtggaacacgtacaaacgactggtcggctgcaccatcgtgtcttcattcctcccgcatcg

SEQ ID NO: 30763 - DNA, 561 bp, Homo sapiens
  misc_feature: GYAE6OF02HFHTO.40.67.G01.1.454.CMB.1.raw
  modified_base (257)..(257): a, c, t, g, unknown or other
  misc_feature (257)..(257): n is a, c, g, or t
  modified_base (402)..(402): a, c, t, g, unknown or other
  misc_feature (402)..(402): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcgggccagtcagcatgtgcacctctagcctggtaccaanaaagcctgccaggcctcccagactcctcatctatgatgcgtcttccgagggccactggccgtcccggcaggttcagtggcaggtggtcgtgggacacgtccttcacttcgtacaccactcagcacgcctggacgcccgtaaagtnttttcggacggttttatacgtgtcagcacgtcgtcgccgtacgtcggccccttgaccggttcgggcggacggaccgaagggtcgaactacgtaccgaaacgtacgtggtcgctcggaccacctattccgtgttccttcacttcccttaccgctattccg

SEQ ID NO: 30764 - DNA, 560 bp, Homo sapiens
  misc_feature: GYAE6OF02HB66P.40.67.G01.1.454.CMB.1.raw
  modified_base (393)..(393): a, c, t, g, unknown or other
  misc_feature (393)..(393): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcgggccagtcagcatgttggcacctccttagcctggtaccaacaaagcctggccaggctcccagacctcctcatctatgatgcgtcttccgagggccacgtggccgtcccggcaggttcaggtggcaggtggtctgggacaggcctttcactctcacctatcagcagcctggacncccgaagtcttttgcgtttatactgtcagcagcgtgccgtactcggcccctgcggttcggcgggacggaccgaagggttcgaacgtataccgaaacggtctaggtcggtacctggacccacctagttccttgttaccttcgtacttcccgttaccccgcctacttcg

SEQ ID NO: 30765 - DNA, 575 bp, Homo sapiens
  misc_feature: GYAE6OF02FW2BP.40.67.G01.1.454.CMB.1.raw
  modified_base (204)..(204): a, c, t, g, unknown or other
  misc_feature (204)..(204): n is a, c, g, or t
  modified_base (381)..(381): a, c, t, g, unknown or other
  misc_feature (381)..(381): n is a, c, g, or t
  modified_base (536)..(536): a, c, t, g, unknown or other
  misc_feature (536)..(536): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcgggccagtcagcatgttggcacctccttagcctggtaccaacaaaagcctggccaggctcccagacctcctcatctatgatgcgttcttccgagggccacgtggccggtcccggccaggttccagtggcaggtgggtctgggacacgccttcactctcaccntcacgcagccgtggacgcccgaagtcgttttgacgggttttattacgttgtccagtcacggtcgtcgccgtactccggccccttcgacggttcggcggacgggaccaagggtcgaactacgtacgaaacgacgtggtaggcttcggacctaccgngttccgtgttccttacacgttccctcccgcctagttccg

SEQ ID NO: 30766 - DNA, 570 bp, Homo sapiens
  misc_feature: GYAE6OF02FJ4M2.40.67.G01.1.454.CMB.1.raw
  modified_base (203)..(203): a, c, t, g, unknown or other
  misc_feature (203)..(203): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctcctctcctgcgggccagtcagcatgttggcacctccttagcctggtaccaacaaagcctggccaggctcccagacctcctcatctatgatgcgtcttccgaggccacgtcggcgtcccggcctaggttcagtggcaggtggtctgggacaggtccttcactctcacatcagcacgcctggacgccgtaagtattttggcgttttatacgtgtcgagcgagcgtcgccgacgtcggcccctgacggttcgggacggacgggacctaagggtcgaactagtacgaaacgtacgtggacggcgttacgcctaccggatttcccgttagttccttccgacttcccgtttaccccggcctaattcccg

SEQ ID NO: 30767 - DNA, 740 bp, Homo sapiens
  misc_feature: GYAE6OF02IDZVD.40.67.G01.1.454.CMB.1.raw
  modified_base (244)..(244): a, c, t, g, unknown or other
  misc_feature (244)..(244): n is a, c, g, or t
  modified_base (340)..(340): a, c, t, g, unknown or other
  misc_feature (340)..(340): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtancagccttccacgtggggctggactccgccacgccccccgaagggaaacggggcctccaagtgcggttaggacatcgtcaatttcttagtcgggccncctcccactacagtcgccggtcccctccgaggacgtccgacgtcccctacactactaccaataacgaccaaccgttacccaaacgtaaacccttacgtttttcccctagaccgtacccgttgaacccggttcctggttaccgaccccggcccgacgtaaacggaccgtaccgggtaccttcggtaccttaagtttacgttcgtagccggtaacggtaccttacggtcccttttcgttacgggttaagggtcggggtttaactttcgggaacccgttaaccccggggtaacttaacccgtaacccttacccgttaacccggtttccggttaccgttacgggtaccctacggttcccgggttccgggggggaccccggtacgggggttccccgttcccgggg

SEQ ID NO: 30768 - DNA, 648 bp, Homo sapiens
  misc_feature: GYAE6OF02IT4RX.40.67.G01.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
  modified_base (372)..(372): a, c, t, g, unknown or other
  misc_feature (372)..(372): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcggggccagtcagcatgttggcacctccttagcctggtaccaacaaaacgcctggccaggcctcccagacctcctcatctatnatgtcgtcttccgacgggccacgtcggccgtcccggccgtaggttcaggtggcaggttcggtcgtgggacncgtccttcacgtctcacctactcacgcacgtccgtgggacgtacccggtaagttacgtttttcggtacggtttttacttacgttgtaccgagtccgaggtcggtacggtacccgtaccggtccggccccgtcgaccggtttcggggacgggaacggggtaccgtaaggggtcgaacgtacgtaacgaaaccgtagttcgggtacggtcgtcggacctaccgtacttccgttagttccctttaccgtaccttcccgtttaccccgacgtacttacgg

SEQ ID NO: 30769 - DNA, 566 bp, Homo sapiens
  misc_feature: GYAE6OF02JGSRX.40.67.G01.1.454.CMB.1.raw
  modified_base (362)..(362): a, c, t, g, unknown or other
  misc_feature (362)..(362): n is a, c, g, or t
  modified_base (418)..(418): a, c, t, g, unknown or other
  misc_feature (418)..(418): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtggtctgggacagccttnactctcaccatcacgcagcctggacgcccgaagattttgcgtttatactgtcagcngcgtgccgactcggcccctgaccggttcggacggtacgggaccaagggttcggaactacgtacgaaacggacttggtacggctcggaccaaccctaagttccttggtcctttaccgactttcccgtttaccccggcctacgttaccgg

SEQ ID NO: 30770 - DNA, 584 bp, Homo sapiens
  misc_feature: GYAE6OF02GIPYW.40.67.G01.1.454.CMB.1.raw
  modified_base (244)..(244): a, c, t, g, unknown or other
  misc_feature (244)..(244): n is a, c, g, or t
  modified_base (357)..(357): a, c, t, g, unknown or other
  misc_feature (357)..(357): n is a, c, g, or t
  modified_base (398)..(398): a, c, t, g, unknown or other
  misc_feature (398)..(398): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtancagcttccactggggctggatccgccagccccaggaaagggctccaatgcgttggacatgtcaattcttatgggcgctcccactacagtcgcggccctcagagtcgagccctnatactccaatacgacacgtaccaagtaacctagttttcccngaccgctgacgtctgtcgacccgccgacagactacggctcgtcttattattgtgtcgagactcgtcctttcgtgttacggtcgggttaacttcgaccgtaaccgggtattaccgtcgtaccctaccgtttccggcgtttacggactacgttccggtcggggacccgtacggggtcccttaccgggg

SEQ ID NO: 30771 - DNA, 897 bp, Homo sapiens
  misc_feature: GYAE6OF02H08DA.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccacgtggggctggactccgccacggccccccgaagggaaacggggcctacccgaaagtcggtaccggtttagggactagttaggttacctaaacgttttaccgttaaggtcggggccgtaccgttaccccgtaacttaaccgacggttccggacccgggtaccccctccgaacggtacgttccggaacgtccccttactacgttaactacccgaagttaaccgaacccgtaaccgttaacccgaaacggtaaacccgtttaacggtttttaccccgtacggtaacccggtaccgttacggttacccggttccgttacgggttaccggaacccggtcccggaccgtaacggaacccgtaaccgggtccgttacgtttaccgtttaaacgttttacgtttcggttacggtaccggtaacggtaacccgtttacggttccccgttttacggttacggggtttaaggggttccggggggtttaaaccctttcggggtaaaccccggttaacccccgggggttaactttaacccggttaacccgttaccccgttaacccggtttccgggttaccgtttacgggtaaccgttacggtttcccgggttacggggggtaccccgggttaccgggggtccccgtttacccggggg

SEQ ID NO: 30772 - DNA, 510 bp, Homo sapiens
  misc_feature: GYAE6OF02F8WXH.40.67.G01.1.454.CMB.1.raw
  modified_base (478)..(478): a, c, t, g, unknown or other
  misc_feature (478)..(478): n is a, c, g, or t
  modified_base (487)..(487): a, c, t, g, unknown or other
  misc_feature (487)..(487): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatcctatgatgcgtcttccagggccactggccgtcccggccaggttcagtggcagtggtctgggacagccttcactctcaccatcagcagcctggacgcccgaagtattttgcggtttatactgtcagcagcgtgccgactcggccctgacgttcggcggacgggaccaggtgacatcaacgactgngctgcaccntctgttctcatctcccgctatcg

SEQ ID NO: 30773 - DNA, 656 bp, Homo sapiens
  misc_feature: GYAE6OF02GPNE8.40.67.G01.1.454.CMB.1.raw
  modified_base (336)..(336): a, c, t, g, unknown or other
  misc_feature (336)..(336): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccacgtggggctggatcccgccacgcccccgaaggaaacggggctaccgaagtgcgttaggacagtgtcaattcgttagtcgggcncctcccactacgagtcgccggccctcgagacgtccgacgccctacatactaccatacgaccacgtaccaaacgaacctacgttttcccagaccgtctagacgttcgtacgcgacccggcgcacgaccgacggtcttacgtaccttattagtggtacgacgagtacgtacgtcctttacgtggttacggttcggggttaacttcggaccggttaacccgggtacttaacccgttaccgttacccgtacccgtttccggtacgtttacggaaccttacgggttccgggtcgggggacccggtacgggggtccccttccgggg

SEQ ID NO: 30774 - DNA, 660 bp, Homo sapiens
  misc_feature: GYAE6OF02GNSYI.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccacgccaccctcgtccttcgttcctccacgggacgaaacgacgcctccctcctcctcgcggggccagtcagcatgttggcacctccttacgcctcggtaaccaaacaaaaacgcctcggccaggcctcccacgacctcctcactctatgatcgcgtccttccgacgggccacgtcggccggtcccggccgtacggttcgaggtcggcgaggttcgggtcgtcggggacgacgtccgttccactcctacaccactcgacgcgacgtccggtggaccgaccggtaagttcgttttacggttcggtttacttacgtgtcgtacgcgtacgtcgtcggaccgtccgtcgtcccccgttacgtccgggttacgggaccgggtacggtaccgtaacgggtacgacaacgttaaccgaaacggtcgtacgtcggacgtcgcctaaccgtgttccgttgttacttaccgtaccgttccctacccgtctacgtacgg

SEQ ID NO: 30775 - DNA, 547 bp, Homo sapiens
  misc_feature: GYAE6OF02G97K3.40.67.G01.1.454.CMB.1.raw
  modified_base (354)..(354): a, c, t, g, unknown or other
  misc_feature (354)..(354): n is a, c, g, or t
  modified_base (540)..(540): a, c, t, g, unknown or other
  misc_feature (540)..(540): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcgggccagtcagcatgtgcacctctagcctgaccaacaaagcctggccaggctccagactcctcatctatgatgcgtcttccgagggccacgtcggccgtcccggctaggttcaggtcggctaggtggtctgggacncgtccttcactcacaccatcagcacgcctggacgcccgaagtcgttttggacgtttatacgtgtcagtcgagcgtcgccgacgtccgccctcgacggttcggcggaggaccgaagggtcgaacgactacgaaacgtcgtgtcggacgtcgacctaccagttcctgttcttcgacttcccgtacccnctatccg

SEQ ID NO: 30776 - DNA, 606 bp, Homo sapiens
  misc_feature: GYAE6OF02JCK9Q.40.67.G01.1.454.CMB.1.raw
  modified_base (320)..(320): a, c, t, g, unknown or other
  misc_feature (320)..(320): n is a, c, g, or t
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
  modified_base (424)..(424): a, c, t, g, unknown or other
  misc_feature (424)..(424): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagccttccacgtggggctggatccgccacgccccaggaagggctccaatgcgtggacatgtcaattctagtggcnctcccactacagtgcgcccncgagcgtcgagccctnactactcatagacacgtaccaagtaacctacgttttcccagaccgctacgtacgtctgtcgaccgccncgacgacgacggcttcgttctagttacgttgtcgacgtacgtacgttacgtcccgtttacgtcggttagggtcgggttacttacggaccgtaaccgggtacttaccgttaccgtacccgtacgttccggcctttaggaccgtacgttccgggtacggggccgtacggggtcccttaccgggg

SEQ ID NO: 30777 - DNA, 599 bp, Homo sapiens
  misc_feature: GYAE6OF02IN9VH.40.67.G01.1.454.CMB.1.raw
  modified_base (204)..(204): a, c, t, g, unknown or other
  misc_feature (204)..(204): n is a, c, g, or t
  modified_base (360)..(360): a, c, t, g, unknown or other
  misc_feature (360)..(360): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcgggccagtcagcatgttggcacctccttagcctggtaccaacaaaagcctggccaggctcccagactcctcatctatgatgcgtcttccagggccacgtggccgtcccggccaggttcagtggcaggttggtctggggacncggtccttcactctcaccatcagcagccgtaggacgcccgaagtattttggcggttttatcgtgtcagcagtcgtcgccgtacgtcggcccctcgaccgttccgggcggtaacggaccgtaagggtcgaactacgtaaccgaaacgtaccgtggtacggaccgttgacccgtaaccgtacgttccgttcgttccctttaacgaccgtttcccgttacccccggtacctactttacccgg

SEQ ID NO: 30778 - DNA, 617 bp, Homo sapiens
  misc_feature: GYAE6OF02G1VDI.40.67.G01.1.454.CMB.1.raw
  modified_base (203)..(203): a, c, t, g, unknown or other
  misc_feature (203)..(203): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcgggccagtcagcatgtgcacctctagcctgtaccaacaaagcctggccaggcctcccagacctcctcatctatgatgcgtcttccgaggccacgtggccgtcccggccgaggttcaggtggcaggtggtcgtgggacagtccttcgactctccacctatccagcacgtccgtgggaccgtacccgtaagttcgttttcggaccgttttattaccgtggttcacgtcacggtccgtcggcccgtacgttccgggtccccctagtacccggttcgggccgggtaacgggaaccgtaaggggtcggtaacgacgtaccgaaacggtacgtcgtcggaccgtacggacctaccgtacgtccgttagttacccttctacgttccccgttcccgactacttccgg

SEQ ID NO: 30779 - DNA, 817 bp, Homo sapiens
  misc_feature: GYAE6OF02IEUW1.40.67.G01.1.454.CMB.1.raw
  modified_base (402)..(402): a, c, t, g, unknown or other
  misc_feature (402)..(402): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatacgaagggtagcagcttaccacgtgggggctgggaactccgcccaacgcccccgaagggaaacggggcctaccaagtggcgtttacggactagtggttactaatttccgttaagtcggggccgccttcccaactacgagtcgccggtccctccgagtacgtcggacncctagactactaccaattacgaacctacggtacccaaacgtaacccttacgtttttacccaggtaccgtaccgttacggtaccgttacgttcggttaaccggacccggacccgacgtaaccggaaccgttaaccggggtctttaggttacctttaagttttaacttacgggttcggaaccggttaacggtaacctttaacggttcccttttacggttagggggttaaccggtttacggggggttaacctttacggggtaaccccgtaaaccccgggggttatttaaaccccgttaacccgttaccccggttaacccgtttacccggggttccgttttaacggggaccttaaccgggtttccggggtaccggggggtaccccgggtaccggggggttccccgtttaccccgggggg

SEQ ID NO: 30780 - DNA, 518 bp, Homo sapiens
  misc_feature: GYAE6OF02HHRIY.40.67.G01.1.454.CMB.1.raw
  modified_base (420)..(420): a, c, t, g, unknown or other
  misc_feature (420)..(420): n is a, c, g, or t
  modified_base (484)..(484): a, c, t, g, unknown or other
  misc_feature (484)..(484): n is a, c, g, or t
  modified_base (515)..(515): a, c, t, g, unknown or other
  misc_feature (515)..(515): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaagcctggccaggctcccagactcctcatctatgatgcgtctccaggccactggcgtccggcagttcagtgcagtggtctgggacagccttcactctacaccatcagcagcctggacgcccgtaagtattttgcgtttatactgtcagcagtcgtcnccgtacgtcggcccctgacgtttcgggacggagggaccgaaggtcgacgatacgaacgacgtgnggctgctacatctgtcttcattcctccgctntcg

SEQ ID NO: 30781 - DNA, 554 bp, Homo sapiens
  misc_feature: GYAE6OF02GKZW6.40.67.G01.1.454.CMB.1.raw
  modified_base (406)..(406): a, c, t, g, unknown or other
  misc_feature (406)..(406): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccgttcggggaccctgtccctcaattgctttgtctctggaacttctatcaagggtagcagcttccactggggctggatccgccagcccccgaggaaacggggctccaatgcgttggacatgtcaattcgttatgggcgctcccactacagtcgccggccctcgacgagtccgacgcccctcatactccatacgacacgtccaaagacctagtttcccngaccgctcgacgtctgtcgacccgccgcagaccgacgcttgtctattatgtgcgagtactagtcttcgtgtaggtgggttactgacgtaccggataccgctccaccgttcgtcgttcgactgttcgcggggccgacgggccttccggg

SEQ ID NO: 30782 - DNA, 751 bp, Homo sapiens
  misc_feature: GYAE6OF02JXTO1.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctgctcccagcagccaccggagaagttgtcctgacacagtctccagccacctgtccttgtctccagggcaaagacgccctccctctcctcgcgggccagtcacgcatgttacgcacctccttacgcctggtaccaacaaagcctcgccaggcctccagcctacctcaactctatcgatcgccgttccttccgacgggtcccacgttcgggcccgttccccggaccgtaaggttccgagttacgggcgtaggttcgggtccgtacggggtaacctacgtcccgtttaccgtaaccgttccttaccgacccgtaacctttacggacgtaccgtaaccgtcccggtacgggtaacccggaccccgggtaaagttaccggtttttaacgggtcccggtttttaaacttaacgttcgtaccgtacgtacgacggtccggttcggacccgttacgttccggcccctttacgtacggttacccgggcggttaacggggaacccttaggggttccggaaccgacgttaaccgaaacgggtacccgtggttaccgggcctagggaaccccttaggaaccgtttcgtaccggtttacctacgtaaccgtttccctacccgtcctaagttaccg

SEQ ID NO: 30783 - DNA, 597 bp, Homo sapiens
  misc_feature: GYAE6OF02HLAYG.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagacgccctcctctcctgcgggccagtcagcatgtggcacctcttagcctggtaccaacaaagcctggccaggcctcccagactcctcatctatgatgaccgtcttccgagggccctacgtggccgtccccggccgtaggttccaggttcggctaggtcgggtctaggggactacgtcctttcacgtcctcaccctatcagcaggtcctggacgccgtaagtcgttttaggcggttttatacgttcgtacgagtctagtccgtgccgtacgtccggcccttcgacggttccggaggtacgggaccagggtcgaactatacgaaacgtacgtcgtacggctcggaccaccgtaattcgtacgttcctcgaccgtttcctccccgtactaccgttacg

SEQ ID NO: 30784 - DNA, 734 bp, Homo sapiens
  misc_feature: GYAE6OF02IM7QE.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggtaacttctatcgaagggtagcagtccttccacgtggggctggactccgcccacgcccccgaagggaaacggggcctaccaagtggcgttggacattggtactaatttcttagtcgggtccgcctcccactacgagtcgccggtccctcagacgtccgagccctcgatactccaatacgacctacgtaccaaagtaaccctacgtttcccgtacgaccgtctacggtacgtcgttagtaccggacccggccgacgacgaaccgacggtcctcgttacttaatttacgttgtcgtaccggacgtaccgtaacgtccgtttacgttacgggttacgggttacggggttaaccgttaccggtacccggtaaacccggggtacttaacccggttacccgttaaccccgtacccggttttcccgggtacccgttttacgggacccgttacggtttacccggggttccgggggggtaccccgggttacggggggtcccccggttttacccggggg

SEQ ID NO: 30785 - DNA, 649 bp, Homo sapiens
  misc_feature: GYAE6OF02IY7XF.40.67.G01.1.454.CMB.1.raw
  modified_base (204)..(204): a, c, t, g, unknown or other
  misc_feature (204)..(204): n is a, c, g, or t
  modified_base (610)..(610): a, c, t, g, unknown or other
  misc_feature (610)..(610): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctggcgggccagtcagcatgtggcacctccttagcctggtaccaacaaagcctggccaggcctcccagacctcctcactctatgatgcgtcttccgacgggccacgtcggccgtcccggccgtaggttcgaggtcggcgaggttgggtcgtggggaccacggtcctttacgaccttcctaccaccagtaccacgcaacggtcccgtacgggaaccgacccggtaagttacgtttttcggtaccggttttaatttacgttcgtacgagtccgtaggtccggtcgcccgtaccgtccggtccccgttcggtaccgggttccggggacgggtaacggggtaaccgagggtacggactacgtaaccgaaacgtacgtgtacggactcggacctaaccgngttacgtcgttacttcctacttcccgtccctctacgtcg

SEQ ID NO: 30786 - DNA, 643 bp, Homo sapiens
  misc_feature: GYAE6OF02HYNG0.40.67.G01.1.454.CMB.1.raw
  modified_base (356)..(356): a, c, t, g, unknown or other
  misc_feature (356)..(356): n is a, c, g, or t
  modified_base (378)..(378): a, c, t, g, unknown or other
  misc_feature (378)..(378): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagcgccctcctctcctggcgggccagtcagcattggttggccaccttcccttagcccttggtaaccaaacaaaagcccgtggccacggccgtcccagacctcctcattctatgatcgcgtcttccacgggccagtcggccgttcccgctaggtcngtggcaggtcggtctcgggacncgtccttacgactcctacaccgtatcacgcagccgtacgggacgacccgtaaagttcgtttttacggtacggtttttaactaccggttcgtacgtacgtgtacgttccgggtacgcccggtaccgtccgtccccgtgtaccgggttcccgggagggaccgggaccgtaagggtcgaacacgtaacgaagtaccgtaggtcggtgtcgaccgcttaacgtcgttacgttcttacgtaccctttccgtacccgtacttacgtcccgg

SEQ ID NO: 30787 - DNA, 679 bp, Homo sapiens
  misc_feature: GYAE6OF02IPMUE.40.67.G01.1.454.CMB.1.raw
  modified_base (205)..(205): a, c, t, g, unknown or other
  misc_feature (205)..(205): n is a, c, g, or t
  modified_base (261)..(261): a, c, t, g, unknown or other
  misc_feature (261)..(261): n is a, c, g, or t
tcagtctagcgactcacgaccggtgctcgatttagagtatacatattggggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcggggccagtcagcatgtggcacctccttagcctgtaccaanaaagcctggccaggctcccagactcctcatctatgatgtcgttcctccgacgggccacgtcgggccgtcccggacctacgggttcaggtggcgtaggtcgggtcgtgggactacgtccctttcaccttctaccaaccctattaccacgtcctaggcccgttagggaccgacccggtaagttacgttttcggtaccgggttttaatttacgttgtacgtacgtccgtaggtccgttcgacccggtcgtccggtcccccttggtaccgggtttccgggaccggggtaacgggaccgtaacggggtacggactaacgtaccgaaacgtacgttcgggtacggccgttcggaccctaacgtccgtttacgtactttccgttacctaccgtttcccggtaccccggttaccctagtttaccgg

SEQ ID NO: 30788 - DNA, 602 bp, Homo sapiens
  misc_feature: GYAE6OF02ILG06.40.67.G01.1.454.CMB.1.raw
  modified_base (204)..(204): a, c, t, g, unknown or other
  misc_feature (204)..(204): n is a, c, g, or t
  modified_base (366)..(366): a, c, t, g, unknown or other
  misc_feature (366)..(366): n is a, c, g, or t
  modified_base (384)..(384): a, c, t, g, unknown or other
  misc_feature (384)..(384): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcgggccagtcagcatgttggcacctcctagcctgtaccaacaaagcctaggccaggcctcccagacctcctcatctatgatcgcgtcttccgagggccacgtcggccgtcccggcgtacggttcaggtggcaggtggtcgtagggacncgtccttcactctcactntcagcacgccgtaggaccgacccgtaagtacttttggtacggttttactcgtcgtacaggtccaggcgtcgccggtactccggccctcgtccggttccgggcggtaacgggtaccgtaagggtacgacaacgttaaccgaaaccgtacgtgtcggtcgtcgacctaccgtagtccgttacgttccgttccgtacttcccgtcccgtactacgttaccg

SEQ ID NO: 30789 - DNA, 694 bp, Homo sapiens
  misc_feature: GYAE6OF02IVSBT.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagacgcctccctctcctgcggggccagtcagcatgtgcacctccttgcctggtaccaacaaagcctggccaggcctccagacctcctcatctatgactgcgttcgtaccagggccacgtcggccgtcccggcgaggtttccaggtcggctaggtcgggttacgtcggggacctacggtccctttcgaaccgttccctcctaacccgaccttacgacggcctaacggcccgttagggaccggtaccccggtaaagtttcgtttttcgggttacggtttttataccgttacggtcacggtcgaacgggtccgttcggacccggttacgtcccgggtacccccttgtaaccccgggttcggggccggggaaacgggtacccggtaagggtcgggaaccaagtaccgaaaacggtcgtcggtacggacgtccggacctaacggtcttacgtcgtttaccctactaccgttcccccttacccggtcttaccgttacgg

SEQ ID NO: 30790 - DNA, 714 bp, Homo sapiens
  misc_feature: GYAE6OF02HB13J.40.67.G01.1.454.CMB.1.raw
  modified_base (250)..(250): a, c, t, g, unknown or other
  misc_feature (250)..(250): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggtattggtacgaaaccgttcggggaccctgtccctcaattgctttgtctctggaacttctatacgaagggtanctagtccttccgacgtggggcctagggactcccggaccacggccccccgaagggaaacggggcctaccaagtcggaccggttaggacatcgtactaattcgttagtgggcctccgtaccctactacgacgtcgccggccctcgagacggtccgaacgtccctacactactacctagtacgacctacccgtaccgtaaaccgtaacctttaccgtttttcccgacgtaccgtctacggtaccgttcgtacggtcgaccccgccggaccaaccggtaccgtaccggtcgttacgttaccttagttactttcggacgtaccgtacgtaccttacgtccgttgttacgggttaaggttcggggttacttcggaacccggtacccggtataccgttaccgtaccgtaccggtttcgtacgttcggaactcggtacggtccgggggtaccggtcggggtaccttcccggg

SEQ ID NO: 30791 - DNA, 588 bp, Homo sapiens
  misc_feature: GYAE6OF02GQH2Y.40.67.G01.1.454.CMB.1.raw
  modified_base (286)..(286): a, c, t, g, unknown or other
  misc_feature (286)..(286): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgtggcacctccttagcctgtaccaacaaaagcctgccaggctccagactccncatctatgatcgcgtcttccgagggccactggccgtcccggcctaggttcaggtcgcgaggtcggtctgggacagtcctttcacgtctcacctatcagccagcctgggacgcccgaagtattttggcggtttatactgtcagtcagccgtgcccgtacgtcggcccctgtaccggttccgggacgggacgggaccgtaagggtgaaccagtaccgaaacgtacgtagtcgggactcggacctaaccgtgttaccgttcggttccttacgtaccgttcccgttccccggtcctaacgttccgg

SEQ ID NO: 30792 - DNA, 668 bp, Homo sapiens
  misc_feature: GYAE6OF02IPZFP.40.67.G01.1.454.CMB.1.raw
  modified_base (262)..(262): a, c, t, g, unknown or other
  misc_feature (262)..(262): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaanaaaagcctaggccaggctcccagactcctcatctatgatgcgtcttccgaggccacgtcggcgtcccgcaggttccaggtggcgaggttcggtcgtgggacacggtcctttcgacttccgtcaccactcacgtcgacggtccttacgggacgtacccggtaaaggttacgtttttacggtacgggtttttaactttaccgttaggttacctacggccttacgggtaccgttccggtacccggtaaccgttccgggaccccccgttcggtaacccgggtttccggggaccgggtaaggggacccggtaaagggttcggaacgtaacgtacgaaacgtacgttggtacggtccgtacggctaccgtacttccgttgtccttacgtaccttccgttacccgctactccg

SEQ ID NO: 30793 - DNA, 762 bp, Homo sapiens
  misc_feature: GYAE6OF02ILJN5.40.67.G01.1.454.CMB.1.raw
  modified_base (215)..(215): a, c, t, g, unknown or other
  misc_feature (215)..(215): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (345)..(345): a, c, t, g, unknown or other
  misc_feature (345)..(345): n is a, c, g, or t
tcagtctagcgactcacgaccggtgctcgatttagagtatacatattgggtttgggggaggaactgctcagttaggacccagagggaaccatggaagccacagcccagcttctcttcctcctgctactctggctcccagcagccaccggagaagttgtcctgacacagtctccagccaccctgtccttgtctccgagggcaaagacgccctcctntcctgcggggccagtcagcagtgttgcacctctagcctgaccaanaanctggccaggcaccagcctcctcattctagtgatcgtctcctcgacggcctacgtggccgcccggactaggttccgagtcggntacggtcgggtcgtacggggacctacggtcccgtttacaacctttccgacctaacctacgtaccgtaacggaccgaaccgggtccgttacgggaacccggtaacccggtaaacggtttacggtttttaccgggtttaccgggtttttaacgttaaccggttacgttacccggtaaggtaccggtttaaaccgggtcccggtttaaccggggtacccgttaacccggtccgggggtccccccttacccggggttaacccgggtttttaccgggggaccggggtaaacgggtaacccggaacggggttacggaacccgtaaccgtaacgtaaaccgtacgtcgggttacggccgttgacccgtaacctcgttacgttcgttaccttcggtaacccgtttcgttaccccggacttaacgg

SEQ ID NO: 30794 - DNA, 694 bp, Homo sapiens
  misc_feature: GYAE6OF02JQ5UW.40.67.G01.1.454.CMB.1.raw
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (337)..(337): a, c, t, g, unknown or other
  misc_feature (337)..(337): n is a, c, g, or t
  modified_base (367)..(367): a, c, t, g, unknown or other
  misc_feature (367)..(367): n is a, c, g, or t
  modified_base (418)..(418): a, c, t, g, unknown or other
  misc_feature (418)..(418): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctccagcagccaccggagaagttgtcctgacacagtctccagccaccctgtccttgtacctccgagggcaaaggngcccttcctcgtccncggccgggcagtccagccagtcgttcgcctaccgttccgttaacgccgttacggtaaccaaacgtaaacgccgtcggaccaggtcctcccgagaccttccctacgaactcgtacngactcgcgttccgtcgacgggtcctacggnggtccgtccggacgtagttcaggtcggacgtgtcggtacgtcggtaaccgngtcctttcgaaccgttcgacctaaccgtgtccgaaccggcgaacgtcccgtacgggaccgtacccgtaagttacggttttacggtccggtttaaagtcccgttggtaccacgtcggaagtccggttacgacccgtagtcccggtcccgttcgtaacccggttcgggaacggtacgggtaccgtaagggtacggactaacgcgtaaacgcgttagacgcgtacgtacgtactacttcgtgtttaccgtcctaccgtcctcccgtacgtacttaccgg

SEQ ID NO: 30795 - DNA, 570 bp, Homo sapiens
  misc_feature: GYAE6OF02GLM2R.40.67.G01.1.454.CMB.1.raw
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcgggccagtcagcatgtggcacctcttagcctggtaccaacaaaagcctggccaggctcccagactcatcatctatgatgcgtcttccgagggccacgtcggccgtccccggcctagggttcagtggcaggtgggtctgggacagtccttcactctcaccatcagcacgccgtggacgccgaagtacttttggcggttttatacgtgtcagcagtcgtcgccgactcggcccctgtaccggttcggcggacgggacctagggtcggactagtaccgaaacgtacgttggtcggcttacggacctaccgtagttccgttacgttcttccgacttcccgttccccgaccttaccg

SEQ ID NO: 30796 - DNA, 702 bp, Homo sapiens
  misc_feature: GYAE6OF02H6RKE.40.67.G01.1.454.CMB.1.raw
  modified_base (259)..(259): a, c, t, g, unknown or other
  misc_feature (259)..(259): n is a, c, g, or t
  modified_base (296)..(296): a, c, t, g, unknown or other
  misc_feature (296)..(296): n is a, c, g, or t
  modified_base (311)..(311): a, c, t, g, unknown or other
  misc_feature (311)..(311): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagcgcctccctctcctgcggggccagtcagcatgtgcacctcttagcctggtaccaanaaagtcctggccaggctaccagactcctcatctatgntgtcgttcttaccgngggtcctacgtcggaccgtcccggcctaggttcaggtcggctagggtcgggtcgttggggactacgtcctttcacctctacccgactatccgtacgctacgtccgtacgggaccgtacccgtaagtttagttttcggtacgtttttaactacgtacgttacgaggtccgacggtccggtcggtaccgtaccgttcccggacccctttcgggtacccggggttccgggacggggtaaccggggtaaccgtaaggggtccgaaacgtaacgtaaacccgaaaacggtacggtttccgggcgtaccggtaacgacccgtaaccgtagtttcccgttacggtttccctttacggaccgtttttacccccggtaccggtacccttagttacccggg

SEQ ID NO: 30797 - DNA, 562 bp, Homo sapiens
  misc_feature: GYAE6OF02HZEA1.40.67.G01.1.454.CMB.1.raw
  modified_base (203)..(203): a, c, t, g, unknown or other
  misc_feature (203)..(203): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (517)..(517): a, c, t, g, unknown or other
  misc_feature (517)..(517): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcgggccagtcagcatgtgcactctagctgacaacaagcctgcagctccagacncctnatctatgattcgtcttccgagggccacgtcggccgtcccggctacggttcagtcggctaggtcgggtcgtgggactagtccttcactcacacctatcgacgtcacgtcctaggacgcccgtaagtcgttttcgacggttttatacgtgtacagtcacgtcgtcgccgtacgtcggccctcgacgtcggcggaacggcgtaaggtgaactagtacgaaacgtcgtgtacgctagcctaaccgtntccgttcgtaccttacacttcccgtacccgacttacgtcgtaacg

SEQ ID NO: 30798 - DNA, 593 bp, Homo sapiens
  misc_feature: GYAE6OF02GC8EA.40.67.G01.1.454.CMB.1.raw
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccgagggccactggccgtcccggccagggttccaggtggcgtagtgggtctggggacaggcctttcacctctccaccatccagccagcctggacgaccccgtaagtacgttttcggtacggttttaattacgttgtccacgtacagtcgtcgtcccgacgttccggcccctcgaccggtttcggcgggtacggaccggtaaggtcggacgactacgaaacgactggtacggacgtcggccaaccagttcctaggttacttcgtacgttacccttcccgcctattccg

SEQ ID NO: 30799 - DNA, 625 bp, Homo sapiens
  misc_feature: GYAE6OF02G9KO0.40.67.G01.1.454.CMB.1.raw
  modified_base (204)..(204): a, c, t, g, unknown or other
  misc_feature (204)..(204): n is a, c, g, or t
  modified_base (255)..(255): a, c, t, g, unknown or other
  misc_feature (255)..(255): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcgggccagtcagcatgtgcactctagcctgtaccaanaaagcctgcagctccagctctcatctatgatcgcgttccttccgagggccacgtggccgtcccggctaggttcaggtcggctaggtcggtcgtggggacacggtcctttcactcctcacctatccaagccacgtcccgtaggaccgtacccggaaagttacgttttggtacggttttaatacgtgtacagtcagtcgtcgccgtacgtccggtccctacgaccgggttaccgggacgggacgggtacccgaagggtcgaacgtaacgtaaccgaaacggtacgttcggacggtccgtacggaccgtaacctagttccgttacgttcctttaccacccgtttacccgtacccccggtacgtacgttaccgg

SEQ ID NO: 30800 - DNA, 685 bp, Homo sapiens
  misc_feature: GYAE6OF02HCJVR.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccgttcggggaccctgtccctcaattgctttgtctctggaacttctatcgaagggtagcagtccttccgacgtggggctggactcccgccacgacccccgaagggaaacggggcctaccgaagtcggcgttaggacagtcgtactaattcttagtcgggcctccgtcccactacgagtcgccggccctacgagacgtcgacgccctcatactaccatacgacctaccgaccaaacgtaaccctacgttttcccgagtaccgtcgttacgacgttcgtcggtaccgtacccgccgacaacggaccacggtcttcgttacgttattagtcgtacggacgtaagtaccgtacgttccgttacgttaggttacgggttcggggttactcgggaaccgtaacccgggtattacccgttaaccgtcccgttaaccggttcggtacgttacggacctacggttcccggtacgggggtcccggtacgggtcccggtttacccggg

SEQ ID NO: 30801 - DNA, 730 bp, Homo sapiens
  misc_feature: GYAE6OF02JF6N9.40.67.G01.1.454.CMB.1.raw
  modified_base (204)..(204): a, c, t, g, unknown or other
  misc_feature (204)..(204): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccgagggcaaagngcctccctctcctggcgggccagtcagcagtgttcggcacctccttagcctggtaaccaacaaaagcctggccaggcctaccccagacctccctacactcctagtcgattcgccgttccttaccgacgggtacccacggtcgggtacccgttccccgggaccttagggttccgaggttcggacgtagggtcgggttcgaggggaccacgtaccctttcgacctcctacaacccgtataccgagaccgacgtcccgtagggacccggtaacccgttaaggtttacggttttacggttaccggtttttacttaccgttcggtaccgaacgtccggttaacggtccgtaccgggaccccggtacgttccccgggtcccttaccgttacgggttcccggggacggaacgggtaactacgggtacggactaaacggtacgaaacgtcgttggcgtacgtcggacccttaacgtacgttccttcggttaccttaccgtacctttcccccgttaccggtactacgttacccgg

SEQ ID NO: 30802 - DNA, 636 bp, Homo sapiens
  misc_feature: GYAE6OF02GBBSR.40.67.G01.1.454.CMB.1.raw
  modified_base (255)..(255): a, c, t, g, unknown or other
  misc_feature (255)..(255): n is a, c, g, or t
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (371)..(371): a, c, t, g, unknown or other
  misc_feature (371)..(371): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccgagggcaaagagcctccctctcctgcgggccagtcagcatgtgcactctagcctgaccaanaaagctggccaggctccagactcctcatctatgatgcgtcttccgaggcccagtcggccgtccggcaggttcaggtcgcnggtcggtntcgggacacgtccttcactctacacctntcagcagtccgtggacgcccgtaagtctttaggtacggttttatcgttgactaggtcgaggtccggtacgacccgtaccgttccgttaccccctacggttaccggttccgggtaccgggaacgggtacccggtaaacggggtcggtaaaccgtacgtaaaccgtaaaccggaacgttcgggtacggtctacgggaccctaacctacgtttccgtagtttcccttacgttaccgtttaccccgttccccgtacttacggttaccgg

SEQ ID NO: 30803 - DNA, 567 bp, Homo sapiens
  misc_feature: GYAE6OF02JIPQ6.40.67.G01.1.454.CMB.1.raw
  modified_base (433)..(433): a, c, t, g, unknown or other
  misc_feature (433)..(433): n is a, c, g, or t
  modified_base (512)..(512): a, c, t, g, unknown or other
  misc_feature (512)..(512): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccacgcccccgagggaaacggggctccaatgcgttggacatgtcaattctatgggcgctcccactacagtgccggtccctcgagacgtcgacgccctcatactccatagacacgtaccaaacgtacctacgttttccctcgacgctgtacgtctgtcgaccgccncacgacgacgtctcgtctatttacttgtgcgatacgtacgtccttacgtgttaggtcgggttactcgtaccgaccggtntactctcccgtactcggtcttaggactcgtcgtcggggccggacgggtcctcggg

SEQ ID NO: 30804 - DNA, 543 bp, Homo sapiens
  misc_feature: GYAE6OF02G2RR7.40.67.G01.1.454.CMB.1.raw
  modified_base (214)..(214): a, c, t, g, unknown or other
  misc_feature (214)..(214): n is a, c, g, or t
  modified_base (339)..(339): a, c, t, g, unknown or other
  misc_feature (339)..(339): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (484)..(484): a, c, t, g, unknown or other
  misc_feature (484)..(484): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctcncctgcgggccagtcagcatgtggcacctccttagcctggtaccaacaaaagcctggcaggctcccagactcctcatctatgatgtcgtcttccgaggccacgtggccgtccgcaggttcagtcgnaggtggtcgtgggacagccttcactctcacctatcacgtnacgcctgganacccgaatatttggagtttatacgtgtcagcagcgtnccgcncggccctgacgttcggaggacggacgaggtacgactacgtacgaaacgtacgngtacgctggcctaacctatcgtcgttacttccaccgttcctaccccggactacttaccg

SEQ ID NO: 30805 - DNA, 647 bp, Homo sapiens
  misc_feature: GYAE6OF02JEZ35.40.67.G01.1.454.CMB.1.raw
  modified_base (240)..(240): a, c, t, g, unknown or other
  misc_feature (240)..(240): n is a, c, g, or t
  modified_base (273)..(273): a, c, t, g, unknown or other
  misc_feature (273)..(273): n is a, c, g, or t
  modified_base (284)..(284): a, c, t, g, unknown or other
  misc_feature (284)..(284): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagacgcctccctctcctgccgggccagtcagcatgtgcncctctgcctgtaccaacaaagcctggcaggccnccagacctccnatcatgatcgcgttcctaccgacggtcccagtcgggccgtaccccggcgtacggtttcgacggttggctaggttcggggtctacggggacacggttcccgttcgtaccgtcctaccgaacctactcgacgccgacgtcccgtacggggacctaccccggtaaagtttcggtttttcgggacggtttttaacgttaccgtggtaccacgtacgaggtcgtcgtacccgtcgtccgcccctgtaccgggttccgggaccggaacgggtaccgtagggtcgaacacgtaccgaaacgtaccgtggtaccgtcgtaacgcctaaccgtcgtccgttagtccttactcgttccctcccgtgacttcgg

SEQ ID NO: 30806 - DNA, 565 bp, Homo sapiens
  misc_feature: GYAE6OF02GMF84.40.67.G01.1.454.CMB.1.raw
  modified_base (260)..(260): a, c, t, g, unknown or other
  misc_feature (260)..(260): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctcctctcctgcggggccagtcagcatgtggcacctccttagcctggtaccaanaaaagcctggccaggctcccagacctcctcatctatgatgcgtcttccaggccacgtcggccgtcccggcacggttcaggtggcaggtgggtctggggacagccttcgactctcacatcagcagcctggacgcccgaagtctttgcggtttatacgtgtcagcagcgtcgccgtacgtcggccctcgtaccggttcgggcgggaacggaccgtaaggtcggaacacgtacgaaacgtacgtggtaggacctgacctacctagttcgtacgttcttaccgtactttcccgtcccgaccttacgtcg

SEQ ID NO: 30807 - DNA, 647 bp, Homo sapiens
  misc_feature: GYAE6OF02GA7DM.40.67.G01.1.454.CMB.1.raw
tcagtctagcgactcacgaccggtgctcgatttagagtatacatagttgggtttgggggaggaacgtgctcagttaggacccgagaggggaaccatgggaagcccccagccccagcttcctcttcctccgtcgctacgtctcggctcccagcagcccaccgggagaacgttgtccctgacacagtctccagccaccctgtcccttggtcctccagggcaaagagcctccctctcctgcggggccagtcagcatgttggcacctccttagcctggtaccaacaaaacgcctggccaggctcccagactcctcatctatgatcgcgtcttccgagggccacgtcggccgtcccggccagggtttccaggttcggctaggtcgggtctgggggacaggtccttcgactctccgacctatccagccagcccgtaggacgcccgaagtacttttggacgttttatactgtacagctagcgtcgcccgcgtccggccccctagtccgggttccgggcgggaacggggaccgtaaggggtcggaacctacgtaacgaaaaccggtaccttgggtcggtccgttcggacccaccgtaagttccgttacgttccgtttacctaccgtttcccgttccccggacctagtttacccgg

SEQ ID NO: 30808 - DNA, 574 bp, Homo sapiens
  misc_feature: GYAE6OF02GCTSY.40.67.G01.1.454.CMB.1.raw
  modified_base (357)..(357): a, c, t, g, unknown or other
  misc_feature (357)..(357): n is a, c, g, or t
  modified_base (398)..(398): a, c, t, g, unknown or other
  misc_feature (398)..(398): n is a, c, g, or t
  modified_base (430)..(430): a, c, t, g, unknown or other
  misc_feature (430)..(430): n is a, c, g, or t
  modified_base (544)..(544): a, c, t, g, unknown or other
  misc_feature (544)..(544): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtcttgtctccagggcaaagagcctcctctcctgcgggccagtcagcatgtgcacctctagcctgtaccaacaaagcctgccaggctccccgagacctcctcatcctatgatgccgtcttccgagggccacgtggccgtccccggctacggttccaggtcggctaggtggtccgngggacagtccgtcactctccacatcacgcacgccgtggacnccgtaagtctttcggcgtttattcgtcgtacngcgtacgcgcgtccgacgtcgccctgtaccgtcgggacggacggaccgagggtcgaccacgtacgaacgtacggtgtcggacgtcggcctacctacgtcgttacgtctttaccncgtttaccccgtcccgtaccgtacgttccg

SEQ ID NO: 30809 - DNA, 921 bp, Homo sapiens
  misc_feature: GYAE6OF02IOS0S.40.67.G01.1.454.CMB.1.raw
  modified_base (250)..(250): a, c, t, g, unknown or other
  misc_feature (250)..(250): n is a, c, g, or t
tcagtctagcgactcacgaccggtgctcgatttagagtatacatattgggtttgggggctttctgagagtcatggatctcatgtgcaaagaaagtgaagcacctgtggttcttcctcctgctggtggcggctcccagatgggtcctgtccctgatgcaggtgcggggagtcgggcccaggattggtagaaaccgttcggggaccctgtccctcaattgctttgtctctggtaacttctatcgaagggtancacgtcttccgacgtgggctggactcccgccacgcccccgaagggaaacggggtcctaccgaagtcgtacggttcggaacgtagtcggtactaagtttccttaaggtcgggtcgtcccttacccccgacgttaaccgacgggttcggtaccccggtccccgttaccgaacggtaccggtaccggtaacccggttaccccctaacgtaaccgtttacctaaccgtaaagttaaacccggtaaccctaaacccgggtttaaaccccgaaaaacggttaaaccccgttttaacccggtttttaaccccggtacgtaaaccccgggttccttacccgggttaccgtttacccggtttacgggtaccggtaccccggtacccggtacccgaaacggaacccggtacgggtcctttacgggttaacctttaacgttttcggtacgttacgggaccgttaaacggtacccgtttaccggtccttttacgggttagggtttaccgggttcgggggtttaaccgttaccgggaccccgggttaaacccggttacttaaacccgttacccggtttacccgttaacccggtttccggggtaccgttttaacggggaacccgttcggttaccccggggaacggggggtccccggggtaaccgggggtcccccgttttccgggg

SEQ ID NO: 30810 - DNA, 658 bp, Homo sapiens
  misc_feature: GYAE6OF02GM8KO.40.67.G01.1.454.CMB.1.raw
  modified_base (211)..(211): a, c, t, g, unknown or other
  misc_feature (211)..(211): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaacccgttcggggaccctgtccctnaattgctttgtctctggtaacttctatcgaagggtagcagtccttccacgtggggctggactcccgccacgcccccgaagggaacgggctaccgaatggcgttggacagtgtactaatttcgttagtcgggccgtcctaccctactactaggttcgcccggtcccctaccgaggacgtccgacgtccccttcaatactcatacgaaccaccgtaccaacgtaaccttacgtttcccagtacgctcgacgtctcgtcgccgccgacgacgaccgacggtcttcgtcttaatttagttgtcgacgggtactacgtacgttccttcgttggttagggttcgggttacttcggacccgtaccgggtacttaccgttactacccgtaccgttccggtacgttacggtacgtcggttccgggtcggggtcccggtacggggtcccgttccggg

SEQ ID NO: 30811 - DNA, 787 bp, Homo sapiens
  misc_feature: GYAE6OF02GQFBY.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggtaacttctatcaagggtagcagcttccacgtggggctggactcccgccacgacccccgaagggaaacggggcctacccgaagtcggccggttacggaactagtcggtctaaactttcgttaagtcgggcctcctacccactaacgagtcgccggtccctcgacgtacgtcgacgccctcacgtactccgatacgacctaccgtaccaaacgtaacccttacgttttacccgacggtaaccgtcttacggaaccgttcgtcggtaccgacccggcccgaccgacggtaacccgacgggtcccttacgttccgttaaatttacgtttcggacggtaccggaacgttaacctttaccggtccttttacgggttaacggttacggggtttacgggggttaaacctttccgggaaccccgggttaaaccccggggttaacgttaaccccgttaaccccggttaccccggttaacccggttttacccgggtaccttttaacgggaacctttacgggttccgggtaccggggggtaccccggtacgggggttcccgtttccccggggg

SEQ ID NO: 30812 - DNA, 614 bp, Homo sapiens
  misc_feature: GYAE6OF02FRMKS.40.67.G01.1.454.CMB.1.raw
  modified_base (350)..(350): a, c, t, g, unknown or other
  misc_feature (350)..(350): n is a, c, g, or t
  modified_base (414)..(414): a, c, t, g, unknown or other
  misc_feature (414)..(414): n is a, c, g, or t
  modified_base (443)..(443): a, c, t, g, unknown or other
  misc_feature (443)..(443): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgctccagggcaaagacgcctccctctcctgccggggccagtcagcatgtggcacctcttagcctgtaccaacaaagcctggccaggcctacccagactcctcatctagtgatgcgttctccgagggcctacgtgggcctcccggcctagggttcaggttgcnggtcggcgtgggactcggccttcactctacacctatccagcagccgtaggacgacccgtaagtntttttacggacggttttaatacttgtacnggtcaggccgtgcccgagttccggccccgttgtccgggttacgggaccgggaaggggacccgtaagggtacgacgtaccgtaacgaaacgtaacgtggtacggtacgtcggacctaccgtaagttccgtacgttccttacgtaccgttccctcccggtactacgttaccgg

SEQ ID NO: 30813 - DNA, 672 bp, Homo sapiens
  misc_feature: GYAE6OF02HSI1R.40.67.G01.1.454.CMB.1.raw
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
tcagtctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagcccaccctgtccttgtcctccgagggcaaagcgccctccctctcctggccgggcagtcagcatgtggcncctctgctgacaanaacgctggccngctccanacctcnctatctatgactcgtccgttctccgaggtccctacgtcgggcccgtcccggacgtacggttcacggtggcgtagggttcggtcgtagggacctacggtcctttacgaccgttcgtacctacctagtccgacgtccgtacgtccgtacgggtaccggacccgttaagtttcgttttcggtacgttttaacttcgtcgtacgacggtacgtacggtaccggtcgtacccgtacggtacccgtccccgttaggttcccgggtacgggaccggggtaacggaccggtaacggttacgaaccgttagaaaccgtaacggtacgttggtcggtacgtaacccgcgttaactcgttaccgtcttacgttccgacctttccccgtcgaccttacgtcgg

SEQ ID NO: 30814 - DNA, 739 bp, Homo sapiens
  misc_feature: GYAE6OF02IIXOM.40.67.G01.1.454.CMB.1.raw
  modified_base (214)..(214): a, c, t, g, unknown or other
  misc_feature (214)..(214): n is a, c, g, or t
  modified_base (277)..(277): a, c, t, g, unknown or other
  misc_feature (277)..(277): n is a, c, g, or t
  modified_base (322)..(322): a, c, t, g, unknown or other
  misc_feature (322)..(322): n is a, c, g, or t
  modified_base (440)..(440): a, c, t, g, unknown or other
  misc_feature (440)..(440): n is a, c, g, or t
  modified_base (677)..(677): a, c, t, g, unknown or other
  misc_feature (677)..(677): n is a, c, g, or t
  modified_base (726)..(726): a, c, t, g, unknown or other
  misc_feature (726)..(726): n is a, c, g, or t
tcagtctagcgactcacgaccggtgctcgatttagagtatacatattgggtttggggaggaactgctcagttaggacccagagggaaccatggaagcccagcccagcttctcttcctctgctactctggctccagcagccaccggagaagttgcctgaccacagtctccagccaccctgtccttgtctccgagggacaaaagcgtccctccctntccgtggaccgggccaagtcagctagtcgtcggacctaccgttcctagccgtaggaaccaaanaaacgtccgtaggaccaggcctacccgagtacctctcgatcgtangtatgtccttaccgtacgacggacctaccggtggtcccgtacccgggacctaggttaccgcggtggacctggtacggtcgtacggtacgaccgtccttaacgcctactacaccttaanccaagtccaacggtcgtaggacgcccgtaaagttagttttcggtacggtttaattaacgtcgtaacgtacgacgacggttacgccgaacccggacgttccggtaccccgttaggttacccggggttacggaacggggtaaccggaaccggttaaggcggttaaaccgtaaaccgttaacggaaaaaccggttacgttccgggtaacgggtaccctaacgggtaccttaaacccggtntttaccgggtttactacccggttttaccacgtttacccccggtttaccnccgttaacgtccg

SEQ ID NO: 30815 - DNA, 590 bp, Homo sapiens
  misc_feature: GYAE6OF02GUN0O.40.67.G01.1.454.CMB.1.raw
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (429)..(429): a, c, t, g, unknown or other
  misc_feature (429)..(429): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccacgtgggctggatccgccacgcccccgaaggaaacgggctccgaagtcgcgttggacatgtcaattcttagtcgggcgcctccactacagtcgcgccctcagacgtcgacgcctcgatactccatagacacgtaccaaagacctagtttcccngacnctagacgtctgtcgaccgcncagacgacgctgtactagttattgagtcgacgtacgtacgtccttcgtagttaggtcgggttacttcgaccgtaccggtactacgtacctaccgtaccgtttcggacgtttacgacgttacggttccgtcgggggtaccggtacggggtcccgtttacggg

SEQ ID NO: 30816 - DNA, 735 bp, Homo sapiens
  misc_feature: GYAE6OF02G1D8X.40.67.G01.1.454.CMB.1.raw
tcagtctagcgactcacgaccggtgctcgatttagagtatacatattgggtttgggggctttctgagagtcatggatctcatgtgcaagaaagtgaagcacctgtgttcttcctcctgctggtggcggctcccagatgggtcctgtccctgatgcaggtgcgggagtcgggcccaggattggtgaaaccttcggggaccctgtccctcaattgctttgtctctaggtaacttctatcgaagggtagcagtccttccgacgtggggctggactccgccgacgaccccgaagggaaacgggctaccgaagtgtacggttaggacagtcgtacaatttcgttagtcgggccgtcctcccgtactacgacggtcgaccggtccctaccgacgtacgtccgaacgtcccctactaacgtactacccaataacgtaacccaaccgttaacccgaaacggttaaacctacccgtttttacccgacggtaccgtcgtacggtacgttctacggtcgtacccggccgtaccgacgaccgaccgtctcgtacttagtttacttcggtcgaccgtacgtaccgtttacgtccgtttcgttacggttacgggtacgggttaccgttcgaacccggttaccgggtacttaacccgtaacccgttaccccgttaccggttccgtacgtttacggtaccgtacggttccgggtcgggggtaccccggtacggggttacccggttccgggg

SEQ ID NO: 30817 - DNA, 671 bp, Homo sapiens
  misc_feature: GYAE6OF02FM4I9.40.67.G01.1.454.CMB.1.raw
  modified_base (258)..(258): a, c, t, g, unknown or other
  misc_feature (258)..(258): n is a, c, g, or t
  modified_base (290)..(290): a, c, t, g, unknown or other
  misc_feature (290)..(290): n is a, c, g, or t
tcagtctagcgactcacgaccggtgctcgatttagagtatacatattgggtttggggaggaactgctcagttaggacccagagggaaccatggaagccccagccccagcttctcttcctcctgctactctggctcccagcagccaccggagaagttgtcctgacacagtctccagccaccctgtccttgtctccagggcaaagcgcctccctctcctggcgggccagtcagcatgtggcacctctagcctgtaccaanaaacgcctggccaggcctcccagacctccctnatctatgatcgtctctccgaggccacgtggccgtccgactacggtcgagtcggcgtaggtcgggtcgtacggggacaccggtcctttcacttcctccaccgacttccagccacgtccggtaggaccgtacccggtaagttcgtttttcgggtaccggttttaacttacgtcggtaccaggtccgtaaggtccgttacggcccggtaccgtcccggtacccctcggttaccgggttccgggaccggggtaacggggtaaccgtacggggtacgtaaccacggtaaccgaaacgttcggtacgtacggtccgtacggaccctacgtacgttccgtttacgttacctttaccgtaccctttccgttaccccggacttacgtcgg

SEQ ID NO: 30818 - DNA, 889 bp, Homo sapiens
  misc_feature: GYAE6OF02GMBIW.40.67.G01.1.454.CMB.1.raw
  modified_base (209)..(209): a, c, t, g, unknown or other
  misc_feature (209)..(209): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcggcccaggattggtagaaaccttcggggaccctgtccctnaattgctttgtctctggaacttctatcaagggtgctactcttccgacgtggggctggacgtccgacctacgacccccgtaagggaaacggggtcctaccgtaagttcgcggttaggacctagtcgttacgtaaattttcgttagtacggggccgtacctaccctacgtaccgtaggtcggtcccggccccttaccggacggtaacggttccggaccgtaccccgttcctaaacgtttaacccttaccgtaaacgttaaccggtaaacccgttaaccggttaaccctaaaacggttaaaccccgtttaaccgggtttttacccccgaacggtaaaccgggttcccgttaacggttaaccgggtttcccgttacggggttacccgggtaaaccccggtcccgggtaacccggtaaccggtaaccgggtaacccggtccggtttacggttaaccttaacgttttacggttcggtacgggtaccgtaaacggttaacccgtttcgttaccccgttttgggttaaccgtttaacggggttacgggggtttaaccttcggtaacccggtaacccgggttagttaacccgttaaccgtacccgttacccggtttaaccggtccgtttaacggaccgttacggtccggttacccggggtacgggtacccggggtcgtttaccccgggg

SEQ ID NO: 30819 - DNA, 588 bp, Homo sapiens
  misc_feature: GYAE6OF02FRII0.40.67.G01.1.454.CMB.1.raw
tcagtctagcgactcacgaccggtgctcgatttagagtatacatattgggtttgggggaggaactgctcagttaggacccagagggaaccatggaagccccagccccagcttctcttcctcctgctactctggctcccagcagccaccggagaagttgtcctgacacagtctccagccaccctgtccttgtctccagggcaaagagcctccctctcctgcgggccagtcagcatgtggcacctccttagcctggtaccaacaaaagcctggccaggctcccagactcctcatctatgatgcgtcttccgaggtccacgtggccgtcccgggcctagggttccaggtcggcaggtcggtcgtggggacacgtccgttcacttcacaccatcagcagcctggacgcccgaagtgttttgcggtttatacgtgtcgagcgaacgtcgtacgccgtacgtcggccccttagaccggttccgggacggaacgggtacctaagggttcgacctagtaaccaacggtacgtggtcggctcgacctaccgtgttccgtggttcccttactcttccgttccccgtacacgtttaccg

SEQ ID NO: 30820 - DNA, 695 bp, Homo sapiens
  misc_feature: GYAE6OF02FMVVI.40.67.G01.1.454.CMB.1.raw
  modified_base (140)..(140): a, c, t, g, unknown or other
  misc_feature (140)..(140): n is a, c, g, or t
  modified_base (202)..(202): a, c, t, g, unknown or other
  misc_feature (202)..(202): n is a, c, g, or t
  modified_base (280)..(280): a, c, t, g, unknown or other
  misc_feature (280)..(280): n is a, c, g, or t
  modified_base (356)..(356): a, c, t, g, unknown or other
  misc_feature (356)..(356): n is a, c, g, or t
  modified_base (643)..(643): a, c, t, g, unknown or other
  misc_feature (643)..(643): n is a, c, g, or t
tcagtctagcgactcacgaccggtgctcgatttagagtatacatattgggtttggggggaggaactgctcagttaggacccagagggaaccatggaagccccagcccagcttctcttcctcctcgctactctggctccancagccaccgagaagttgtacctgacacagtctccagccacctgtccttgctcagggcaaagngcctcctctcctcggcgggcaggtcagcatgtgcactcttagcctgtacaacaaagcagcacggtctccagacctccncattccatgatcgcgtcttaccaggtccagtcgccgtccggacgtacggttcacggtcgagtacggtcgggttacncggggactaaccggttcctttaccgaaccttctaccaaccctagtaccgagacctaacgcccttagggaccgtaaccggattaacgtttttcgaccgggtttttaattacccggttatccgtaagaccgtagtaccggttcggtaccccgtaactttcccgggaccccttgggttaacccggttggggttacccgggaagggttaacccgtaaggggttaccggtaacaaacggttaaccgaaaacgggtaaccctgggttaacgtccggtaacgtaccaaccggtnttaccgttaagttctaactaccgtttacccggttacccaccgtaagtttccg

SEQ ID NO: 30821 - DNA, 614 bp, Homo sapiens
  misc_feature: GYAE6OF02HTTHT.40.67.G01.1.454.CMB.1.raw
  modified_base (259)..(259): a, c, t, g, unknown or other
  misc_feature (259)..(259): n is a, c, g, or t
  modified_base (424)..(424): a, c, t, g, unknown or other
  misc_feature (424)..(424): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctgctcccagcagccaccggagaagttgtcctgacacagtctccagccaccctgtccttgtctccagggcaaagagcctcctctcctgcgggccagtcagcatgtgcacctcttagcctgtaccaacaaancctggccaggcctaccagcctcctcatctatgatgcgttcttccgaggtcccactcgggccgtccccgggacctgggttcaggtcggcctaggtgggtccgttggggaccaggccctttcacttccgtcacccatccagtcacgtccgtggacgcccgaaagttntttacggtcgtttattacgtgtcagtcaggtctcgccgtacgtcggtccccctgtaccggttccgggaccgggtaacgggacctaaggggtcgaaccgtataacgtaaacgtacgttaggtacggtccgagtcctaccgtagttccgttaggttaccttacgtaccgttcccttccccggccttactacg

SEQ ID NO: 30822 - DNA, 636 bp, Homo sapiens
  misc_feature: GYAE6OF02GB2TG.40.67.G01.1.454.CMB.1.raw
  modified_base (202)..(202): a, c, t, g, unknown or other
  misc_feature (202)..(202): n is a, c, g, or t
  modified_base (386)..(386): a, c, t, g, unknown or other
  misc_feature (386)..(386): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccacctgtccttgtctcagggcaaagngcctcctctccgtggcgggccagtcagcatgttggcctacctccttagcctggtaaccaaacaaaagcctggccaggcctcccagactccctcatctatgatgccgtcttccgagggccagtcggccgtccggcctaggttcacggtcggctaggttgggtctggggacaggtccttcacttcncgacctagtccgagctacgccgtagggacgtccgtaaagtgttttacggacggttttaattcgtgtaccgagtccgtaggtccggtcgccgtacgtcccggtcccgttacgtccggggtttcgggaccgggtacggggtaacccgaagggttccggaacctacgtaccgaaacgtaccgtggtcggctacggacctacctacgtcgttacgttccttacgtaccttccgtacccggtacctgttacccgg

SEQ ID NO: 30823 - DNA, 723 bp, Homo sapiens
  misc_feature: GYAE6OF02FNRBS.40.67.G01.1.454.CMB.1.raw
  modified_base (434)..(434): a, c, t, g, unknown or other
  misc_feature (434)..(434): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccacctgtccttgtcctccgagggcaaagacgccctccctctccgtggccggggccagtcagcattggtggcaccttctagccttacgaccaaacaaagcctggaccaggcctcccgagaccttcctcgattcgtatcgatcgcgttccttaccgacgggcctacgtcgggcccgtccccggaccgtacggttcaggttcggcgtaggtcgggtcgtggggactcggtccttacgacttccgaccaccattcagtaccncgtacccggtcgggaaccgtacccggtaagtttcgttttcgggtacgttttaacgttacgtaggtacacgtcgtacgggtcttccggacccgacgttcccgggtcccctacggttacccgggttcggacccgggggtaacggtaacccggtaaacgggggtcaaacccgtaacgtaacccgaaaacggtcgttacggggtcggtacccgtaggcccaaccttacgtacccggtttcgtttacccgttccgtaacccgtttccccgtaccccgaccgtagtttaacccgg

SEQ ID NO: 30824 - DNA, 699 bp, Homo sapiens
  misc_feature: GYAE6OF02HS0TR.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagacgcctccctctcctgcggggccagtcacgcatgttggcacctccttagcctggtaaccaaacaaagcctggccaggcctcccagacctcctcatctatgatcgcgttcttccgagggccctacggtcgggaccgtccccggccgtaggttccgaggtcggcgtaggttcgggtcgtggggacctcggtcctttacacttcctaccgaaccctagtccacggccacggtcccgtagggaacccgtacccggtaaaggtttacgtttttcggtacggtttttaacttaccgttggttaccgaagtccgtaaggtccgtacgcccgtacgtccggccccgttagtccgggttaccgggacggggaccgggtaaccgtaagggtcggaactaacggtaaccaaaacggtcgttgggtcggtaccgtacggaccctaaccgtcgtttcctcggtttacctttccgtaccgttttccccgttaccccgacttacttaccgg

SEQ ID NO: 30825 - DNA, 933 bp, Homo sapiens
  misc_feature: GYAE6OF02GGN2Q.40.67.G01.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcgggaccctgtccctnaattgctttgtctcgtagaacttctatcgaagggtancagtcttaccgacgtcggggtcttgggaacttcccgaccaaccggaccccccgaaggggtaaaacgggggccttaccgtaaacgttccggtacggtttacgggaacctaagttcggttactaaaacgttttccgtttaagtcggggtccgtccttacccaaccgttaacgaggtaccgtccgggtacccctccgtaaggtaccgttccgggaacgtccccgttacgtaacgtaaccttcccggtaaacgtaacgtaacccgtaaccggtttaaccccgaaaacggttaaaaccctttaccggtttttaccccttaacccgggaaacgtttccccgttcgggtaaacccgtttccgggtccggttaccggttaacccggccccggtacgaacccggtaaccgtaacccgggtaccttacggtttaaccttacgttttaagtttccgggtacggttaacggaaccgttaacccggtaccggtttaccccgttttagggttaccggtttaaggggttccggggtttaaacctttaccggaaccccggggtttaaacccggggtactttaaacccggtttaccccctaaccggtttccccggtttaacggtcccggtttttaggacccggtttaacggtccgggttaacccggggggacccggttaccggggggttacccccgtttccgggg

SEQ ID NO: 30826 - DNA, 683 bp, Homo sapiens
  misc_feature: GYAE6OF02FSMOV.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagccctccctctcctgccggggccagtcagcatgtgcacctccttagcctggtaccaaacaaaagcctggaccaggcctcccagtacctcctacatctatgatgccgtcttccgaggcccacgtcggccgcccgctaggttcacggtgcgtaggtcggcgtcgggacacggtcccttacgacctcgtaccaccgtactcacggtcaacgtccgtggaacggacccgtaaagttacgttttgggtaccggtttttaagtaccgttacggtacccgagtcggtaacggtccgggtcgacccgggtacgttcccgggaccccttcgttaaccgggttccggggaccgggaacggggtaacccgaagggtaccggaacacggtaaccgaaacgtaacgtgggtcggtacctcgggaacctacccgtaacgttccgttcggtttaccttacggtacctttcccgtaccccgtccttacgttaccg

SEQ ID NO: 30827 - DNA, 702 bp, Homo sapiens
  misc_feature: GYAE6OF02JM0QO.40.67.G01.1.454.CMB.1.raw
  modified_base (651)..(651): a, c, t, g, unknown or other
  misc_feature (651)..(651): n is a, c, g, or t
  modified_base (692)..(692): a, c, t, g, unknown or other
  misc_feature (692)..(692): n is a, c, g, or t
tcagtctagcgactcacgaccggtgctcgatttagagtatacatattgggtttgggggaggaactgctcagttaggacccagagggaaccagtggaagccccagcccagcttctcttcctcctgctactctggctcccagcagccaccggagaagttgtcctagacacagtcctcacgccctaccctgttccttgtcctccgagggcaaaggacgcctccctcctccgtggccgggccagtcagcatgttgcacctccttagcctggtaccaaacgtaaagccgtaggccgaggacctcccgaacgacctcccttcacgtcctatcgaatcgtaccgtccttaccgacgggtccaccgttccgggcccgttcccgggtacccgtacggtttccgaacggttccggggacctacgggttcgggtcggtacggggtactacggtccctttacgacgttcgtaccgaaccttcgttaccaggtccgacgtcccggttagggaccgtaacccggtaagttctttcggttaccggtttaaatttcgtcggtaccgtgtaccgtagtccggtcggcctacggtccggcccttcgacggtttcggccggaccgggtacacgggtcgactacggtaacaacgaactggtacgaccggtntacctacgtgttacgtctactttccgacttccggtaccccntgtttaaccg

SEQ ID NO: 30828 - DNA, 697 bp, Homo sapiens
  misc_feature: GYAE6OF02J0OGM.40.67.G01.1.454.CMB.1.raw
  modified_base (497)..(497): a, c, t, g, unknown or other
  misc_feature (497)..(497): n is a, c, g, or t
  modified_base (510)..(510): a, c, t, g, unknown or other
  misc_feature (510)..(510): n is a, c, g, or t
tcagtctagcgactcacgaccggtgctcgatttagagtatacatattgggtttgggggaggaactgctcagttaggacccagagggaaccatggaagccacagcccagcttctcttcctcctgctactctggctcccagcagccaccggagaagttgtcctgacacagtctccagccacctgtccttgtcctccagggcaaagcgcctcctctccgtgaccgggccacgtccagctagtgttcggcaccgttcgttacgccgtcggttaacccaacgtaaaacgcccgtcggaccacgggtacctccgaacgtacctccttcgatcctaatcgtagtcgtcgtccttccgacgggcctacgtcggaccgtccgcgtacggtcgacggtcgcgtacggtggcgtacgggactacggtccctgtacctcgtacaccttacgagtgccgacgtcgtcggaccggtacgtaacgttacggttcgttacggttatttacggngttacgtcgtacnggtacgtcggcccgtaccggtaccgtcccgttcgtccgggttccgggtaaccgggacggtaaccggtacggttaaccggtacgtaacccgtaacgtaaaccgtacggttacgtgggtaacccgttccgacgtccgttaaccgttcggttcctacggttacctccggtttacccttccgtaggttacc

SEQ ID NO: 30829 - DNA, 689 bp, Homo sapiens
  misc_feature: GYAE6OF02HFRET.40.67.G01.1.454.CMB.1.raw
  modified_base (149)..(149): a, c, t, g, unknown or other
  misc_feature (149)..(149): n is a, c, g, or t
tcagtctagcgactcacgaccggtgctcgatttagagtatacatattgggtttggggaggaactgctcagttaggacccagaggaaccatggaagccccagcccagcttctcttcctcctgctactctggctcccagcagccaccgganaagttgtcctgacacagtctccagccacctgtccttgtctccagggcaaagcgcctcctctactggcgggccagtcagcatgttgcacctcttagcctgtaccaacaaagcctggaccaggctaccagacctctcatctatcgatcgacgttcgttaccagggccacgtcggccgtcccggctggttcagtggactaggtcggtcgtagggactacggtccttcgacttcgtaccgaaccgtattccgaacgtcgtacgtacccgtacggaccgacccggttaaagttacgtttttacggacggtttttaactaccgttcgtacgacgtcgaacggttccgtaggaccccgtaacgttccggacccccgttgacccgggtttccgggaccgggtaacgggtacccgtaagggttcgaaaccgtagtaaaccgaaacgtaccgtcggtggtaccgtcggtaacccttacgtaaacccgtttccgtacgttttacccgtaccttaccgttacccccgtttacccggacttacggttaaccgg

SEQ ID NO: 30830 - DNA, 655 bp, Homo sapiens
  misc_feature: GYAE6OF02G2VZ3.40.67.G01.1.454.CMB.1.raw
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (468)..(468): a, c, t, g, unknown or other
  misc_feature (468)..(468): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagcgccctccctctccgtcggcgggccagtcacgcagtgtgccacctctagccgtgtaaccaacaaacgccgtacggccaggcctaccganctcctnatctatgatcgtcgtcctccgacggccacgtcgggcccggtcccgaccgtaggtcgaggtcggcgtagggtcggtcgagggacctcgtccttcaccttcacctacactcgagccacgccgtaggaccgaccgttaagttcgtttcggtacggttttattaccgtgtacgngtacgacggtccgccggccgtaccgtcccgtacccgtacggtacccgggttaccgggccggggtaaccgaaccgggtaacggtcgaacgtacgtaaaccgaacggtacgtacgggaccgtacgtcggaacctccgttattaccgtacgttcgttaccctcgttccccgtacccgtcgtaccgtacgg

SEQ ID NO: 30831 - DNA, 819 bp, Homo sapiens
  misc_feature: GYAE6OF02I79UN.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccgtttcggggaccctgtccctcaattgctttgtctcgtaggtaacttctagtcgaagggtagcgagcttccgacgtcggggctggactccgccacgccccgaaggaaacgggcctaccgaagtcggcgttacggactagtcgttactaagtttcgttaacggtcggggccgtcccgtacccctaaccgttaaccgaggttccggtcccgggtacccccttaccgaacggtaccggtaccggtaacccggtcccccttactaaccttaacgttaccctaaagttaaacgtaacccgaacccgttaaccccgtaaaaacggttaacccttaaccgggtttttttaccccaacggtaacccgtacccgttaacggtaacccggttcgttcgggtaccggaaccccggtacccgacgaaacccggaaccgtacggtccgttcggttaactttaactttacgttacggtggtacgtacgtaccgttaacggttccgtttacgttagggttacggtcggggtttaacttcggaacccgtaccgggtaacttaccgttaaccctccgtaacccgttcggacgtttaccggacgtacgttaccgggttaggggtccgtaccggggtccgttacccggg

SEQ ID NO: 30832 - DNA, 643 bp, Homo sapiens
  misc_feature: GYAE6OF02FX9DJ.40.67.G01.1.454.CMB.1.raw
  modified_base (202)..(202): a, c, t, g, unknown or other
  misc_feature (202)..(202): n is a, c, g, or t
  modified_base (586)..(586): a, c, t, g, unknown or other
  misc_feature (586)..(586): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccacggagaagttgtcctgacacagtctccagccacctgtccttgtctccagggcaaagngcctcctctctgcggggccagtcagcatgtggcacctccttagcctggtaccaacaaaaggcctaggccaggcctaccccagacctccgtcatctatcgatgcgttcttccgagggccacgtggcgtcccggcaggttcagtgcaggtggtcgtgggacaggtcctttcgaccgtctaccaccgtataccgagtccgaaccggccttagggaccggtccccgaaaggtacgtttttcgggtacggtttttaactttacgtcggtttacgaggtccgtaaggtccgttacggcccgtaacgtccgggtaccccctaggtacggtttccgggacgggtacggaccggtagggttacggactaagtaccaaacgtacgtgtacggtnttcggccaacagtttccgtagttccttaccgtacttccgttccccgtatagtttccg

SEQ ID NO: 30833 - DNA, 657 bp, Homo sapiens
  misc_feature: GYAE6OF02JGSDG.40.67.G01.1.454.CMB.1.raw
  modified_base (204)..(204): a, c, t, g, unknown or other
  misc_feature (204)..(204): n is a, c, g, or t
  modified_base (259)..(259): a, c, t, g, unknown or other
  misc_feature (259)..(259): n is a, c, g, or t
  modified_base (284)..(284): a, c, t, g, unknown or other
  misc_feature (284)..(284): n is a, c, g, or t
  modified_base (375)..(375): a, c, t, g, unknown or other
  misc_feature (375)..(375): n is a, c, g, or t
  modified_base (645)..(645): a, c, t, g, unknown or other
  misc_feature (645)..(645): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtcctccagccaccctgtccttgtctccaggcaaagngcctccctctcctgcgggccagtcagcatgtgcactctagcctgtaccaacaaancctgccaggcctcccagacctcctnactctatgatcgccgttcttcccgacgggcctacgtcgggtccgccccggtcgtaggttccaggtggactagggtcggtcgtacggggacnccggtcctttccgacctctaccaacctatccgagccgacggtcctacggggaccacccggtaagttcgtttttagggtacgtttaattcctagtccaacggtctgcgttcgacccgttcgccggtcccctaggtaccggttcccgggcgggtaacgggaacccgtaagggtccggaacttaaaccgtacccgaaacggttaccgtggtacggcgtaccggaccttaaccgtatccgttacgttacctaccgtacccttccgtaccccgtnttacgttaccgg

SEQ ID NO: 30834 - DNA, 833 bp, Homo sapiens
  misc_feature: GYAE6OF02HN079.40.67.G01.1.454.CMB.1.raw
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (253)..(253): a, c, t, g, unknown or other
  misc_feature (253)..(253): n is a, c, g, or t
tcagtctagcgactcacgaccggtgctcgatttagagtatacatattgggtttgggggcgtttctgagagtcatggatctcatgtgcaagaaagtgaagcacctgtggttcttcctcctgctggtggcggctcccagatgggtcctgtccctgatgcgaggtggcgggagtcgggcccaggtattggagtaaaccgttcggggaccctgtccctcattgctttgtactcgtaggtacttntatanaaagggtnctagcttcacgtgggctggatccgcgaccgaccccgaaggaacgggctaccgaagtcggtcgttaggaacctagtacgttactacgttaccttaaggtcgggccgtaccgttaccccgaacgtaccggaacgttccgggacccccggtccccgttaccggaaacggtaaccggtccggtaaaccggacccccttacgtaaccgttaacgtacccgaaacggtttaacccgaaccgttaaacccgtaacccggtaaaccggtaaaccccgtttaccgttttaccccgtacgtaaccggtccgtaaccggttaaccgtcgttccgggttaaccggacccgacccgtagaacccgttaaccggaccgttacgtaccgttactttacgtttacgtacggtttacgacccggttaactacggtaccgttacgtttaccgtttaaggttaccggggttagggttaacccgttacggtacccggaacccgggttcgttaaaccgttacgttaccccgtacgttcccggggttactacggttaccgcgttccgggtcccggggtaacgggtccggtacccggttcggg

SEQ ID NO: 30835 - DNA, 657 bp, Homo sapiens
  misc_feature: GYAE6OF02HLWBP.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacacgtccccagcccaccctgtccttgtctccagggacaaagcgcctccctctcctggcgggccagtcagcatgtgcacctctagcctaggtaccaacaaacgcctggccaggcctccagcctcctcatctatgactcgccgttcttaccgacgggcccacgtcggccgtccccggcgtacggttcaggtcggctagggttcgggtcgtaggggacctacgtccctttacgaccgtctaccgaactacgtccgaacgtcctaacgtcccggtagggaccgtacccgtaaagttacgtttttggcggttttaactacgtcgtacgacgtcgacgtccgtcgacccggtactccggtcccctaggtacggttccggggacggtaccgggaacagggtcgaacccaattaaccggaaacgtcgtggtcgccgtacgacctactacgttccgttctaccgttacactttccccttacccggactacggtttcgacgg

SEQ ID NO: 30836 - DNA, 708 bp, Homo sapiens
  misc_feature: GYAE6OF02FVISD.40.67.G01.1.454.CMB.1.raw
  modified_base (295)..(295): a, c, t, g, unknown or other
  misc_feature (295)..(295): n is a, c, g, or t
  modified_base (408)..(408): a, c, t, g, unknown or other
  misc_feature (408)..(408): n is a, c, g, or t
tcagtctagcgactcacgaccggtgctcgatttagagtatacatattggggtttgggggaggaactgctcagttaggacccagagggaaccatggaagccccagccccagcttctcttcctcctgctactctggctcccagcagccaccggagaagttgtcctgacacagtctccagccaccctgtccttgtctccagggcaagcgcctcctctcctgccggggccagtcagcatgttggctacctccttagccgtggtaccaacaaagcctggccaggctccccagacctccgnacttctatgatcgtcgttccttccgaggtcccacgttcgggcccggttcccgggcgtacgggtttcaggtcggcgtacggttcgggtccgtggggaactcggtaccctttccncttacgtcccgaacctactacgtacgtccgacgtccgtgggaaccggacccggtaaagtttacgttttcgggttacggttttaattacgttcggtacgtacggtcgtaggtccggttcgacccggtacgtcccggtccccgtacgttaccgggttcgggaccggtacggggaaccgtaaggtaccggtacgtaacgttaaccgaaacggttacgtcggtacgaccgttacggacctaccgttacgttccgttcgttacgttacccttacgttcccccgtacccgtcccgtagttacccgg

SEQ ID NO: 30837 - DNA, 690 bp, Homo sapiens
  misc_feature: GYAE6OF02H50NB.40.67.G01.1.454.CMB.1.raw
  modified_base (176)..(176): a, c, t, g, unknown or other
  misc_feature (176)..(176): n is a, c, g, or t
  modified_base (574)..(574): a, c, t, g, unknown or other
  misc_feature (574)..(574): n is a, c, g, or t
  modified_base (584)..(584): a, c, t, g, unknown or other
  misc_feature (584)..(584): n is a, c, g, or t
  modified_base (636)..(636): a, c, t, g, unknown or other
  misc_feature (636)..(636): n is a, c, g, or t
  modified_base (652)..(652): a, c, t, g, unknown or other
  misc_feature (652)..(652): n is a, c, g, or t
  modified_base (655)..(655): a, c, t, g, unknown or other
  misc_feature (655)..(655): n is a, c, g, or t
  modified_base (669)..(669): a, c, t, g, unknown or other
  misc_feature (669)..(669): n is a, c, g, or t
  modified_base (682)..(682): a, c, t, g, unknown or other
  misc_feature (682)..(682): n is a, c, g, or t
  modified_base (687)..(687): a, c, t, g, unknown or other
  misc_feature (687)..(687): n is a, c, g, or t
tcagtctagcgactcacgaccggtgctcgatttagagtatacatattgggtttgggggaggaactgctcagttaggacccagagggaaccatgggaagccccagcccagcttctcttcctcctgctactctggctcccagcagccgaccggagtaagttgtcctgacacagttccnccacgcccaccctgttccttagtctcccgagggacaaacgacgtcccttccctactccgtgggcggggtaccaggtccagccttagtggttacgccacccgtctttacgacccgttaggtaacccaaaacgaaacgtcccgtcggaccgaccggcctaccgataccctccgtacctattacgtactagcgttacgtaccgttccgttaccggaccgggccctaacggtccgggtacccgtccccgggtccgttaacgggttactacgggtccggtaggtacgggttacgggtcggtaacgggtcttacggtcccttaaacgccgtaccttacgaccgaacgtcgaacgtcgaaccggtcgtacgaaaccgtcgtaattacggtttcgttacggttaancgtctacgancgagtccgcgacgtccacgtccctagggccgttaggcgacgacgtgacgtanaccagaacgtgcgtcngcnccatcagtctctanccgttcccgactntaacncgg

SEQ ID NO: 30838 - DNA, 971 bp, Homo sapiens
  misc_feature: GYAE6OF02I1ZSX.40.67.G01.1.454.CMB.1.raw
  modified_base (160)..(160): a, c, t, g, unknown or other
  misc_feature (160)..(160): n is a, c, g, or t
tcagtctagcgactcacgaccggtgctcgatttagagtatacatattggggtttgggggctttctgagagtcatggatctcatgtgcaagaaagtgaagcacctgtggttcttcctcctgctggtcgcggctccagatcgggtcctgtccgtgatgacgngggtggcggggacggtccgggaccctagggtagttcgggtacgtaaacccggttccggggtacccttcgttaccctacgtaagtttcggtccgttttacgtccgttcggttacggttaaacctttcgtaacgtcggtaaacggggtcgtactacggttccttaccgtacgggtcgggtaccgttcggaccgtccccggacccgaccggacccccggtaaaggggtaacgggtacctaaccggtaacggttcgggtaccggtttacggaaccttaacggttcgttaaaccgttaacgtttccggttaaggtccgggtcctaacccgttacccgtaaacgttacggaccgtccgggtaccccggtcccgttacgaacgggtaacgtcccggtaccgttaccctactaaccgtttacgtacccgtaagttaacccgtaccgtaaacccggtaacctaaacccggtacccgttttaccgtttcccgacggtacgtaccggtcggttaaccggttcgtcggttaacccggacccggtaccgtaaccggacggttaccgtacgggttaccgttacgtaaccgttttagttcggttacgggaccgttaacgaaccgttccgtttaaccggttacccgtttcggggtttaagggtacggggttccggtttaacgtaacccgggtaaccgggttaaccggttcctttaacccggttccgtacccggttaaccggtttcggtaccccggtttaggaacccgttttccggggtaccggggttacccggggggtaccgttacccggggttccggtttcccggg

SEQ ID NO: 30839 - DNA, 740 bp, Homo sapiens
  misc_feature: GYAE6OF02I7HNJ.40.67.G01.1.454.CMB.1.raw
  modified_base (214)..(214): a, c, t, g, unknown or other
  misc_feature (214)..(214): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtccgggcccaggtattggtacgaaaccgttcggggaccctgtccctntaattgctttgtctctggtaacttctatcgaagggtacgcacgtccttaccgacggtcggggctggactccggccaccgcccccgaagggaaacgggcctaccgaagtcggtcggttacggacattcggtactaactttcgttaggtcgggtcctaccgttacccaacgttacgacggttcggcccggtaccccttacgacggtaggtcccgacgtcccctatactactaccagttacgaaccacgtaaccaaacgtacccttacgttttcccacgtaaccgtcctacggtacgttcgtacgtaccgacccgtccgacgacgacgtccggtcttagttcttaagtttagttcggacgtacgaacgttaccgttacgttaccgttcgttagggttaagggttcggggttacttacgggaacccgaaccgggttacttacccgtaaccgttcccttaacggttcgggtccttaacgggacttaccggttcggtccgggggacccggtaccggggttccgttcccgggg

SEQ ID NO: 30840 - DNA, 731 bp, Homo sapiens
  misc_feature: GYAE6OF02IWICY.40.67.G01.1.454.CMB.1.raw
  modified_base (160)..(160): a, c, t, g, unknown or other
  misc_feature (160)..(160): n is a, c, g, or t
  modified_base (200)..(200): a, c, t, g, unknown or other
  misc_feature (200)..(200): n is a, c, g, or t
  modified_base (686)..(686): a, c, t, g, unknown or other
  misc_feature (686)..(686): n is a, c, g, or t
  modified_base (695)..(695): a, c, t, g, unknown or other
  misc_feature (695)..(695): n is a, c, g, or t
tcagtctagcgactcacgaccggtgctcgatttagagtatacatattgggtttgggggaggaactgctcagttaggacccagagggaaccatggaagccccagcccagcttctcttctcctgctactctggctccagcagccacggagagttgtcctganacagtctccagccaccctgtccttgtctccagggcaaagngcctccctctccgtggcgggccagtcgagcagtgttggcctacttccgttagcctggtaaccaaacgaaaacggtcctaggccagggaccctacccgaagacccttccctcgtacttcgtatcgagttggtcccgttccgtttccgacgggtccctaaccggtccgggtccggtcccccgggaccgttagggtttaccgaggtcggtcgtacggggttcgggttccgaggggtaaccaccgttcgtttacccaactttccgtacgaacccttaagtccgtaaggcccgtaacggccggttcggaaccgttacccggtaagttacggttttcggtaccggttttaataccgttgtacgaagttccaaggtccgttccggaccgtccgtcccggacccgttgtaaccgggttccgggacgggtaaacgggaccgtaacgggtcgaactaactaaccggaaacttcgcggtcacggtccaacctaccgntttaccgtntttcgtccgttacttcccgtacccttacacttacgg

SEQ ID NO: 30841 - DNA, 676 bp, Homo sapiens
  misc_feature: GYAE6OF02JHBHZ.40.67.G01.1.454.CMB.1.raw
  modified_base (209)..(209): a, c, t, g, unknown or other
  misc_feature (209)..(209): n is a, c, g, or t
  modified_base (227)..(228): a, c, t, g, unknown or other
  misc_feature (227)..(228): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (350)..(350): a, c, t, g, unknown or other
  misc_feature (350)..(350): n is a, c, g, or t
  modified_base (382)..(382): a, c, t, g, unknown or other
  misc_feature (382)..(382): n is a, c, g, or t
  modified_base (499)..(499): a, c, t, g, unknown or other
  misc_feature (499)..(499): n is a, c, g, or t
  modified_base (526)..(526): a, c, t, g, unknown or other
  misc_feature (526)..(526): n is a, c, g, or t
  modified_base (537)..(537): a, c, t, g, unknown or other
  misc_feature (537)..(537): n is a, c, g, or t
  modified_base (626)..(626): a, c, t, g, unknown or other
  misc_feature (626)..(626): n is a, c, g, or t
  modified_base (638)..(638): a, c, t, g, unknown or other
  misc_feature (638)..(638): n is a, c, g, or t
tcagtctagcgactcacgaccggtgctcgatttagagtatacatattgggtttgggggaggaactgctcagttaggacccagagggaaccatggaagccccagcccagcttctcttcctcctgctactcgtggcctccagccagcctacggagagttcgcctgacacagtctccagccacctgtcctgctcagggcaaagcgcctcccntccgtggcggcctagcannatgttgccncgtactggcctagtaaccaanaaacgccgtacggacctaaggtccctacccacggaaccttcccgacgtaatacccgtattcgaagtccgtcggtaccgtccgcgggtaaccncgtccgggcccgtacccggtacgtaacgggtntacggtcggcgtaacggggtcggtacttaccgggggaacgttcctcccggtttactaaaccgtccgttaaactccacggttacccgaagtacctacgacgtacgggacctaacccgngttttatttacccgggtatttctttancggtaccgtanacggtctcggccctacggacctccgaccttcggacggttccgggcgtaagggacgacgtacgacaactccgtaaagccgtgtaccggtnccggcaacgttnaaccgtcgacttaccgttgccccttaagcgtaacttgg

SEQ ID NO: 30842 - DNA, 705 bp, Homo sapiens
  misc_feature: GYAE6OF02FTDUB.40.67.G01.1.454.CMB.1.raw
  modified_base (535)..(535): a, c, t, g, unknown or other
  misc_feature (535)..(535): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtagaaaccgttcggggaccctcgtccctctaattgctttgtctcttaggaacttctatacaagggtgcagccttccacgtgggctggactccgccacgcccccgaggtaaacggggcctaccgaagtcggtcggttaggactacgtgtactaatttcttaacgtgggcctcctcccgactaccgagtcgccggccctccgaacggtacggtacgacgtccccgtacaacttacgtccgtaactaacgtaaccgtaaccgtaccgaaacgtaacccgtacggttttacccctacggaaccgtctaacgtaacgttctaggtaccgacccggtccacgaacggtacacccggtntacgttaccgttagttcgttgtacgacggtaataccgtaccgttccgttacgtacgttaggttccgggtagtaccgtacggtaacccgggtataacgttacccgcctaaccggttcgtagttacggtaactacggtccggtcggggacccgtaggggtcccgttaccggg

SEQ ID NO: 30843 - DNA, 754 bp, Homo sapiens
  misc_feature: GYAE6OF02JJXWT.40.67.G01.1.454.CMB.1.raw
  modified_base (205)..(205): a, c, t, g, unknown or other
  misc_feature (205)..(205): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccgagggcaaagngcctccctctcctggcggggccagtcagcagtggttcggcacctccttagcctaggtaaccaacaaaacgcctggccaggcctaccagacctccctcatctatgagtgccgttcgtaccgagggccctacgtcggacccgtccccggaccgtagggttaccacggttcggacgtacggggttcgggtaccgtagggggtaacacggtccctttaccgacgttcctaccacctactacgacgtccgacgtccgtacgggacgacccccgtaaaggttacgttttacggttaccggttttaagttaccgtgtaccgacggtacgtacggttccggtacggtacccggtaccgtacccggtccccgttaccggtaccgggttaccggggaccggggtaaaccgggtaaccgggtaacgggtcgggtaacctaaacggtaaccgaaacgtacgttcgggtacggccgttaacgggtaacctaaccgtacgttaccgttaccgttaccttacggtaccctttacccggttaccccgtaccgttaacgtacccgg

SEQ ID NO: 30844 - DNA, 656 bp, Homo sapiens
  misc_feature: GYAE6OF02GRYKH.40.67.G01.1.454.CMB.1.raw
  modified_base (244)..(244): a, c, t, g, unknown or other
  misc_feature (244)..(244): n is a, c, g, or t
  modified_base (420)..(420): a, c, t, g, unknown or other
  misc_feature (420)..(420): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccgttcggggaccctgtccctcaattgctttgtctctggacttctatcaagggtancagtctccacgtgggctggactccgccacgcccccgagggaaaggggctccaatgcgttaggactagtgtacaattcttagtgggccgcctcccactacgtagtcgccgccctccgagacgtcgacgccctcactatccatacgacacgtaccaacgtaaccctacgttttcccgngaccgctacggtacgtcgtggtccgacccggtccgaccgacgaccgaccggtcttacgttaccttaagtttactttggtacggcgtacggaccgttacgttccgtttaccgttgggttaacgggttggggttaacccttggacccgtacccgggtacttaaccgtaccttaccctacccgttcggtcttcggaacgtcggttaccggcggggtcccgtcggggttaccttcccggg

SEQ ID NO: 30845 - DNA, 700 bp, Homo sapiens
  misc_feature: GYAE6OF02G5N7D.40.67.G01.1.454.CMB.1.raw
  modified_base (479)..(479): a, c, t, g, unknown or other
  misc_feature (479)..(479): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtcctccagggcaaagacgccctcctctcctggccggggccagtcagcatgtgcaccttcctagcctggtaaccaaacaaacgcctggaccacggcctaccccagtcctcctcatctatgactcggccttcctccgagggccctacggtcggcccggtcccggtctacgggttcacggtggcgtaggtcggtcgtacgggactcgtccctttcaccgttctaccgacctcgtacacgcctacgccgtagggaacccgtccggtaaagtttacgttttcgtaacgggttttntaaccggtgtacgacggtcgaacggtccgttcgcccgttaacgtcccggtaccctggtaccgggttacccggaccgggtaacggtaacccgggtaagggtcgaaacgtaaccgtaacccgaaacggttcctcgggtaccgacttaacgggaccctaaccggtactttcgttaccggtttcttaccttccggttacccccgttcccggattaccgtaacggg

SEQ ID NO: 30846 - DNA, 700 bp, Homo sapiens
  misc_feature: GYAE6OF02H3KGO.40.67.G01.1.454.CMB.1.raw
  modified_base (201)..(201): a, c, t, g, unknown or other
  misc_feature (201)..(201): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (376)..(376): a, c, t, g, unknown or other
  misc_feature (376)..(376): n is a, c, g, or t
tcagtctagcgactcacgaccggtgctcgatttagagtatacatattgggttggggaggaactgctcagttaggacccagagggaaccatggaagccccagcccagcttctcttcctcctgctactctggcctccagcagccaccggagtaagttgtcctgacacgagtctcagccacctgtccttgtctcaggcaaagcncctcctctcctggcgggccagtcagcatgtcgcacctctagctgaccaanaanctgcagcnccanctctnactnatgatgcgtctacgacggctacgtcggccgtccgcgtaggtcacggtcgcgtaggtcggtacgtgggacctacggtcctttacacgttcctaccgtaaccncgttacacgccgtaacgtccggtacggtaccgtaccccgtaagttacgttttacggtaccgttttacgttaccgttacgttacctacggtaccgttacggtacccggtcggtacccggtaaccgttcccggtaccccgttcggtaacccgggtttccggggaccgggtaacggggaacggttaaccgggtagaaacccgtagttaaaccgaacggttacggtcgtttaccgggaaccgttcgaacccgtaccgttaaccgttccgttaccggtttacctttaccggtacctttaccccggtttcccgaccttaccttaaccggg

SEQ ID NO: 30847 - DNA, 961 bp, Homo sapiens
  misc_feature: GYAE6OF02F6QQ9.40.67.G01.1.454.CMB.1.raw
tcagtctagcgactcacgaccggtgctcgatttagagtatacatattgggtttgggggctttctgagagtcatggatctcatgtgcaagaaagtgaagcacctggtggttcttcctcctgctggtggcggctcccgagatgggtcctgtccctgactgcaggtgcgggaggtcgggccccgagggactttggggtacggtaaaacccgttccggggggtaaccccttcggttcccccttacgtaaacgtttcggttaccgtttttggtacccttccggttacgggttaaaccttttacttaacgttacgttaaaacgggggttaagcccgttagttaacccgtttccccgaacggttcggggggtccgttacggggtacgttacccccggcccggaacccgtaccccccccgggaagggggtaaaaaccggggggtccccggttaaccccgtaaagttacggggtacccggttttacgggggaaacctcggtttaacgggttaccttaaaaacggttttaccggtttaaggttaccggggtaccggtacccggtttaaccccaaccgtttaccggtaacgtccggtacccggggtaccccttaccgaacgggtaccggtaccgtaccggtcccctacgtacgttactaccgtaactacgtaaacctaccgtaaaccgtaacggtaacccttaaccgtttttacccacggtaaccctccgttagaaccgttcgttacgtccggaaccgtccgacctaacgaccgtcggcgttaactccgttaatttagtcgacgtacgacgtactaacggtccttaacgtcggttacggtacggtttaccgttacgaccggttaaccggaccttaacggttaccctacccggttacccgttaccgggttaccgtacggtaacccttggtacccgggtcgggtacccggggtacgggttacccggttcccggg

SEQ ID NO: 30848 - DNA, 643 bp, Homo sapiens
  misc_feature: GYAE6OF02FWIBY.40.67.G01.1.454.CMB.1.raw
  modified_base (204)..(204): a, c, t, g, unknown or other
  misc_feature (204)..(204): n is a, c, g, or t
  modified_base (258)..(258): a, c, t, g, unknown or other
  misc_feature (258)..(258): n is a, c, g, or t
  modified_base (306)..(306): a, c, t, g, unknown or other
  misc_feature (306)..(306): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctcctgcggggccagtcagcatgtgcacctcttagcctgtaccaanaaagcctggccaggctcccagacctcctcatctatgatgcgtcttccnggccacgtcggcgtcccggctaggttcagtggacaggtcggtctggggacaggtccttcgactctacacgactcagcacggcctagggacgacccggtaagtacgtttttaggtaccggttttattaccttggtacctaagtccgtacggtacggttcggcccgtacgttccggtcccccttacggtaccggtttccggggaccggggtaacgggaaccgaacgggttcggaactaccggttaacgaaaccgttaccgtgggttccggacgttcggaccctacgtacgttccgtttgttcccgttactccttccgttaccccgtacctagttacccg

SEQ ID NO: 30849 - DNA, 748 bp, Homo sapiens
  misc_feature: GYAE6OF02F56IT.40.67.G01.1.454.CMB.1.raw
  modified_base (215)..(215): a, c, t, g, unknown or other
  misc_feature (215)..(215): n is a, c, g, or t
  modified_base (257)..(257): a, c, t, g, unknown or other
  misc_feature (257)..(257): n is a, c, g, or t
  modified_base (435)..(435): a, c, t, g, unknown or other
  misc_feature (435)..(435): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcgaggtgcgggagtccgggcccaggattggtacgaaaccgttccggggaccctgtccctntaattcgctttgtctcgtggtaacttctagtcgaagggtacnctagtctccgacgtggggctggactccgccgaccgccccgaagggaacggcaccgtaatcggcgttaggactacgttgtacctaatttcgttaagtcgggtaccgtccgtacccctaacgtacgtacggttaccggcccggtacccctccggacggtcgttacggacccgtcccctanaacgtacctactaactacgaaccgtaccgtaaccaaacgtaccgtacgttttcccgaggtacccgtacgtacggtacgttacgtcgtaccgacccggtccgtacaccggaccgtaacggtcttacggttacttagtacgttggacgtcggtacgtactaccgttccgtttacgtcgggtacggtttagggttacccgttagaccccggtaccggtacttaaccgttacccgtacccgttaccggttacgtcccgttaaggtacttccgggttaccgggcggggtaccggtaccgggttacccgtttcccgggg

SEQ ID NO: 30850 - DNA, 796 bp, Homo sapiens
  misc_feature: GYAE6OF02JLQSW.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgcctgacacagtctccagccacctgtcctgtctccagggcaaacgcgcctcctctcctcggcgggccaggtcagcatggtcgacctaccttctacgccgtacggtaaccaaacaaacgccgtacgaccgacggtcctaccgacgacctcctctacgtctagtcgactcgcgttctccgacgcctacgtccgtccgtccgcgtacgtcgtacggtcggcgtacggtcggtcggtacgggtacgtaccgtacccgttcgaccgttcctaaccgtacccgtacgttcccgaacggtaccgaccgttacccggtaacgggaccggtaacccgggtaacgttttacggttttaccgggttaaccggttttacgtaaccgttcggtacgtacgacgggttacgttccggtaccggtacccggtaccgtcccggtacccggttaccgggtaccggggttcccggggtaccgggaaccggggttaaccggtaaccggggttaacggtacccgtaaacggttaaacccggaaacgttaccggtacgggttccgtaccggtccggtacccgtaccgttaccttaccggttaccgtttaccggttacccgttacccgttccccgttaccgtacccgttacggttaacccgg

SEQ ID NO: 30851 - DNA, 784 bp, Homo sapiens
  misc_feature: GYAE6OF02F5B5S.40.67.G01.1.454.CMB.1.raw
  modified_base (747)..(747): a, c, t, g, unknown or other
  misc_feature (747)..(747): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtgcggctcccgagatgggtcctcggtccctgatcgctaggtcgcgggacgtccggggcccgtaaggacgttgggtacgtaaaccgttccgggggtaccctgttccccctacgtaagtttcgcgttttcgtccgtccgtggtaaacctttctaacgttcgtaaacgggtagtcacgtccgtttaccacgtcgggggtaccgtggtacgttacccgaccgtaccgccccccgaaagggtaaaaccgggggtcctaacccggtaaattcgggaccggtttaacgggacctaaacgtcggttaccgtaaacgttttccttaacgttccgggaccggtcccttacccggaacgttaacgtacgttccgggaaccgtcccgtcgtaaacgtcggtaaccgccgtcccgtacaactacgtccaactacggacctaccgtacaacgtactaacgtttccacgacgtactcgaccttcgacgtcgtaccgccggtacacggacctaccgacgttacgtaaccgttacttaacgtcgtaggttccgaacgtaccgtacgtcctccgttagtacggtcgggttactaggccgaaccggtactaccgtaccgtaacctcccgtacgtcgttaacgngtaccgtcgtaccgggtcggtacccggtaggtcccgg

SEQ ID NO: 30852 - DNA, 747 bp, Homo sapiens
  misc_feature: GYAE6OF02HRNAK.40.67.G01.1.454.CMB.1.raw
  modified_base (349)..(349): a, c, t, g, unknown or other
  misc_feature (349)..(349): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtgcggctcccagatgggtcctgtccctgatgcaggtgcgggagtcgggcccaggattggtgaaaccttcggggaccctgtccctcaattgctttgtctctggaacttctatcaagggtagcagcttcacgtggggctggactcgccacgccccaggaacgggctcaatgcgtggacatgtcaattcttagtggcgctccactacagtgccgcctcagacgtcgacnccgtctactagtaccaagtacgaacgtacccgtaccaaacgtaaccgtacgtttttacccgacgtaccgtaccgttcggtaaccgttcgttacggttaccggacccgtacccggtaccgaaacggtaaaccgaccgggtaccttacggtttaaccttaaagttttacgttaccggttcggtaaccggtaaccggttaaccgttaaccgggttccctttaccggttacggtttaacgggttacgggggtttaccgttaccgtaacccgggtaaaccccgggttaacgtttaacccgttaaccgttaccccgttaacccgttcccggttaccgtttacgggactacggttacccggtttacgggggacccggtacccgggggttaccctttccccggggg

SEQ ID NO: 30853 - DNA, 743 bp, Homo sapiens
  misc_feature: GYAE6OF02FQKHQ.40.67.G01.1.454.CMB.1.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctcctctcctgcggggccagtcagcatgttggcacctccttagcctggtaccaanaaacgcctggccaggctcccagacctcctcatctatgatcgcgtcttccgacgggccacgtcggccgtcccggactaggttcagtcggcgtacggttggtctaggggactaggtccctttacgacttcgtaccaacctagtcacgtccacggtacctcgggaaccggtcccggtaaaggttcgtttttagggtacccggtttttaatttaccgttcggtacctaggtaccgtaggtccgttacggtcccggtaaccgttccgggtaccccccttacggtcccgggtttaccggggaacccgggggtaacgggtaaacccgggtaaggggttaccgggaaacctaaccggttaacccggaaaaaaccgtttcccgggtttagggacgggtacccgttaaggtaccccgttaaccgtaacgtttcccgtcggttttacctttccaaccgggttttcccttcccccggtaccgtacttacccggg

SEQ ID NO: 30854 - DNA, 911 bp, Homo sapiens
  misc_feature: GYAE6OF02FIV85.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagcgcctccctctcctggccgggccacgtcagctatggttgccacctccttagcctacggtaccaaacgaaacgcctacggccacggtcctccgacgtacctccgtacatctatgtatcgccttcgtccgacggccacgtcggccgtcccggcgtaggttcaggtcggcgaggtcggtcgtggacacgtcttcactctctaccactacgagccgtacgccgtacgggaccgtacccggtaaagttacggtttttacgggtaccggtttttaacgttaccgttcgggtacccgtacgtaaccggttcgggtaccggtttacccggaccccggttaacgggttccccgggttaccccccgtttacggggttaacccccggggtttacccggggggaacccggggtaaaccgggggttaaaccccgggtaacgggggtttaacccgggtaaacccggtttaaaaacccgggtaaaccccgggtaaaaaccggggtttaaccccggttttacgggggtaacccgggggttacccgttaaacccggggttcccccgttaaaaaccccggtttaccggtttttaaccccgggtttaaccgggttttttaccccggtttttaaaacccccggtttaaccccgggttttttacccccccgggttttaaacccccccgggttaccccgtttttaaccccggtttttaaaccccgggggg

SEQ ID NO: 30855 - DNA, 631 bp, Homo sapiens
  misc_feature: GYAE6OF02JAG8G.40.67.G01.1.454.CMB.1.raw
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtagaaaccgttcggggaccctgtccctcaattgctttgtctctggaacttctatcaagggtgcagcttaccacgttgggctggactccgccacgacccccgaagggaacggggcctaccaagtcgcggttacggactacgtgtactaacttcgttagccggtcgcctcccactacgagtcgccgccctacgagacgtccgacgtccctacatactacacgtacgtaccgacgtaccgaaactaccctacgtttacccagtaccgctacgtcgtctacgtcgaccgcgcacgaccgacgtctcgttacttgttactgcgtcgacgtactacgtccttgtacggtcgggttacggtactacggaccgaccggtacttaccgtccgttaccctaccggtttacgcgttacggactacggtcgtccggggccgtacggggtccgttcccggg

SEQ ID NO: 30856 - DNA, 598 bp, Homo sapiens
  misc_feature: GYAE6OF02GGZXC.40.67.G01.1.454.CMB.1.raw
  modified_base (204)..(204): a, c, t, g, unknown or other
  misc_feature (204)..(204): n is a, c, g, or t
  modified_base (255)..(255): a, c, t, g, unknown or other
  misc_feature (255)..(255): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctccctctccgtgcggggccagtcagcatgtgcactctagctgaccaanaaagctgcagctccagctcctcatctatgatgccgtccttaccacgggcctacgtcgggtccgtcccgggcctacggttcaaggtcggcgtaggttcgggtacgtggggactacggtcctttacactctaccaccatccagccagccgtggacgacccgtaagtcttttggacgtttactacgtgtacgagcgaagtccgtgcccgtactccggtccctacgtcggtcggacggacggaacgaaggtcgactagtaacgaacggtactacgtggcctcggcctaccgtatacgttccgtactttacggtaccttccccgtttcccggaccttacgttacccgg

SEQ ID NO: 30857 - DNA, 884 bp, Homo sapiens
  misc_feature: GYAE6OF02JX3HZ.40.67.G01.1.454.CMB.1.raw
  modified_base (279)..(279): a, c, t, g, unknown or other
  misc_feature (279)..(279): n is a, c, g, or t
  modified_base (606)..(606): a, c, t, g, unknown or other
  misc_feature (606)..(606): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcgctcccagatcgggtcctgtccctgatgcgaggtgcgggagtccgggcccaggtattcggtacgtaaaccgttccggggacccttttttcgccctactaatttcggtctttcgtctcgtaggtaacctttctaacgtcgaaacggggttacnccgtaacgttccgttccgacggttcgggggccttaccgggtaacttccccggacccgaaccgggacccccccggtaaaggggtaaaccggggccctttacccggaaacggttcggtaccgggtttacgaaccgttagtacggttacttaaaacgtttccgttaaggtccgggtaccgtaccctacccttaacgtaccgtggtcccggtcccgacccttacgaacggtacgttaccggaccttcccctataaccgttacctaaccgtacgttaacgaacccgtaaccgttaacccgaaacgttaacccgtttacgttttaacccccgngtaaccgtcccgttaggttacccgttcgtcggtaccaacccgccgtacaacgtaccgtacgggtcttacggttaacctttacgttgtccggttacgacgttaacgtaccgtcgttaccgttcggttaacgggttacggttaccgggttactaccggacccggttaaccggtacttacccgtacccggttacccttaaccggttcccgggttaagtttccgggaacttaccgggtaccggtaaccgggggtcccgggtaccgggttcccgtttccgggg

SEQ ID NO: 30858 - DNA, 659 bp, Homo sapiens
  misc_feature: GYAE6OF02FJ6KA.40.67.G01.1.454.CMB.1.raw
  modified_base (385)..(385): a, c, t, g, unknown or other
  misc_feature (385)..(385): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaaagcgcctcctctcctgcggggccagtcagcatgttggcacctcttgcctggtaccaaacaaacgcctggccaggctcccagctctcatctatgatcgtcgtcttccgagggtccacgttcggccgtcccggcgtacggttccaggttggccagggttcgggtactgggggacacggtcccttnacctcgtaccaccgtatccaggtcaacgcccgttaggacgcccggtaaagtacgtttttggacggtttttaacttacgttacgtcaacggtctaagccggttacggcccgtactccgggcccctttacggaccggtttccggggacgggtaaccggggtacccgtaagggttcgaactacgtaaccgtaaaccgacgttggtcggacttacggaccgtaccctagttcccgtgttaccgtttaccgaccgttcccgttccccgtactagttccg

SEQ ID NO: 30859 - DNA, 787 bp, Homo sapiens
  misc_feature: GYAE6OF02FRV2U.40.67.G01.1.454.CMB.1.raw
  modified_base (307)..(307): a, c, t, g, unknown or other
  misc_feature (307)..(307): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagtaagttgtcctgacacagtctccagccaccctgttccttgtctccgaggcaacgagtccctcctctccgtcggcgggccagtccagcagtgttgctaccgtccttacgcctcgtaaccaaacgaaagccgtgaccacggccttccgagtcctcctnacttctatcgattcgtcgtcttaccgaggtcctacgtcggcccgtacccggcgtacgttcgacggtcggactagggttcggtacggtgggaactacgggttccctttacgacgttccgtactaacccgtacttaccgacgaccacgggtccgtaccggaccgtacccggttaacgttacggtttttacggttacccggtttttaacgtttacccgttcggttaccgttacgtcgttacggtcgttaaaccggtcccgtaacccgggttcccgttaccccggttaccgtaacccggggttccgggtaccggggtaaaccgggaccggtaaacggttacggaaccgttaaacgaaaccgtaaaccgggtaccggttacggtcgaccggttccgaacccggtttaaccgtgttttaaccgtttacggtttaccttacccgttaacccgtttcccggttccccgtaacttacccgtttaaccgg

SEQ ID NO: 30860 - DNA, 800 bp, Homo sapiens
  misc_feature: GYAE6OF02I6N8E.40.67.G01.1.454.CMB.1.raw
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtcctccgagggacaaaggacgccctccctctccgtggccggggccagtcagcagtgtggcctacctccgttacgccgtacggtaaccaaacaaacgccgtacggcccacggcctacccgacgaccttcccgtactatcctatggtactgtccgttccgtccgacgggtccacgtccggcccgtccccggtctacgggttcaggttcggcgtagggtcgggtcgtaggggtaccacggttccctttacgtaccgttaccgtacccaaccttacgacgacgtacccacggtacccgtaggggaaccctaccgggttaaagttggttttaccggtacggtttttaatccgtacgtaacgtacggtccgtacggtaccggttaccggacccgttaccgtcccgggtaccccccgttaggtacccggggttaccggggtacccggggaacgggtaacccgggtacgggttaccggaacctaacggtaaacccgtaaagggttacccttaggggtacccggtacggtaccggacccgttaacccgttacttccggtttacgtaccccgtttaccgttcccgtttccccggtttaaccccgacctttgttaccccggg

SEQ ID NO: 30861 - DNA, 1038 bp, Homo sapiens
  misc_feature: GYAE6OF02G13QE.40.67.G01.1.454.CMB.1.raw
tcagtctagcgactcacgaccggtgctcgatttagagtatacatattgggtttgggggctttctgagagtcatggatctcatgtgcaagaaagtgaagcacctgtgttcttcctctgctggtggcgctccagagtggtcctgtccctgatgcgaggtcggcgggtacgtccggaccgaggtagttggtacgtaaaccggttccgggaccctcgttaccctacgtagttcgtcgtttcgtacttcgtacgtaacttactacgtacgaaaggttacgcgtacgtaccgttccgacggtcgggccgtaggtaccgtacccgcccgaaccggacccccggaagggtaaccggggtacctacccgaaagttcggtacggtacggtaactaggttacgttaccttaggttttaccgttacgggtccgggtcccgtcctaccccgtaacgttaccggtaacgtccgggtaccccgtacccccgtacggtacggttaaccgtcccggtaccgttaccccgttacgtaaacgtttacccgtaaccgtaaacgttaaccggtaaccctaaacccgttaacccgtaaacccgtttaaaccccgttttaccggttttaaccccgtacgtaaaccccggttcccgtcgggttttaaaccccggtcggttacccggttacccggacccccggttaccggtacccgaaaccgggtcccgaaccgggttttcccgtaccgttttaacgttacgtttacggtttaccggtcgggtaaccgtttaacccggtacgtttcccgtacccgggtttttaggtttcccggggtttaaaccgggggggttacgtttaacccggggttaaccgggtaaacccccgggtttaaccccgggttaaaccgttttaaccccgtttaaccccgggtttaacccccgtttacccgggtttaacccgggtttaccgtttaaccccggggttaacggttaccccgggttccggggaacccggggggttttccccgggtacggggttccccccggttttttaacccggggg

SEQ ID NO: 30862 - DNA, 748 bp, Homo sapiens
  misc_feature: GYAE6OF02GK9JU.40.67.G01.1.454.CMB.1.raw
  modified_base (699)..(699): a, c, t, g, unknown or other
  misc_feature (699)..(699): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctgctcccagcagccaccggagaagttgtcctgacacagtctccagccaccctgtccttgtctccgaggcaaagcgcctcctctctgaccgggccagtcacgcattcgttggcctaccttccttaggcccttagggaaccaaacgaaaacgtcctacggaccgacggccttaccccgagtacctcctctaatccgtatacgactcggtaccgttcttcccgacggtcctaacgtcgggtcccgtcccggtaccgtacgggtttcaacggttcggccgtaagggttcgggtaccgtagggaaccgtacgttcctaacctcggtttcctacctaaccgtacgtcgaacgtccgtaacgcccgttagggacccgtacccggtaaagtttcgtttttacgggttacgtttttaacgtaacgttcgttaccgtaacgtcgtaggtcccggttacgcccggttaccgtccggtaccccggttaccgtaccgggttaccgggaccgggtaccggtaaccggtaacgggttacgaaccgtaacgtaccggtaaactaccgtcgggtacgcgtacgaccnccgtactacgttcttactacgtccttaccgttcccgtactattacccgg

SEQ ID NO: 30863 - DNA, 791 bp, Homo sapiens
  misc_feature: GYAE6OF02GFMOZ.40.67.G01.1.454.CMB.1.raw
  modified_base (210)..(210): a, c, t, g, unknown or other
  misc_feature (210)..(210): n is a, c, g, or t
tcagtctagcgactcacgaccggtgctcgatttagagtatacatattgggtttgggggctttctgagagtcatggatctcatgtgcaagaaagtgaagcacctgtgttcttcctcctgctggtgcggctcccagatgggtcctgtccctgatgcaggtgcgggagtccgggcccaggattggtagaaacccgttcgggaccctgtccctntaattgtctttgtcttctggtaacttctagtacgaagggtagcctagtccttccgacggtcggggcttggacctccgaccgaccgacccccgaagggaacggggtcctaccgagtcggtcgttcgggaactagtcgtactaacgtttcttaggtcgggtacctacgtacccgaactacgacggtcggcccggtccctaccgaggtaccgtccgaccgtccctacacgtactctaatacgactaccgtaccaaacgtacccttacgtttcccgtagtacccgtcgtacgtacgtcgttcggtaccgacccggccgaccgtaacggaccgtaccgggtaccttacgtttaccttaacggtttagtttacggtacgaccggtaacgttacgttaaccgtttcccgttacggtttcggggtaacggggtttcgggtaacgttacccgggtaccggttaaccccggtacgttaacccgttacccgttaccgttaaccccggtttccggtacgtttaccggtaaccgttacgggttcccggggtacggggtacccggggttaccggggttcccggtttaacccgggg

SEQ ID NO: 30864 - DNA, 826 bp, Homo sapiens
  misc_feature: GYAE6OF02JEA8I.40.67.G01.1.454.CMB.1.raw
  modified_base (204)..(204): a, c, t, g, unknown or other
  misc_feature (204)..(204): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccacctgttccttgtctccagggcaaagngcctccctctcctggccgggccagtcagcatgtcgcctaccttcctagcctgtaaccaaacgaaacgtccgtcggccaggtccctacccagaccttccctactagttacctagtcgtagtacgtccgtttccgttaccggacggggtccctacggtcgggtcccggtccccggtacgtacgggtttccagggttcgccgtagggttcggtacgtacggggtactccggtccctttacgaccttcctaccgaacccttacgtaccgacggtaccgtacggtacccggtacgggtaacccgtaaccccggttaaggtttttaaccgtttttacggttacccggtttttaaacttttccggtacgttaaccggtaaccgtcgttaccgggtaccggttaccgtccccgggtaccgttacccgggtccccgtttacgggtaacccgggttccggggaaccgggtacgggggttaaccgtaacggggtccgtaaacgtaaccgtaaaccggtaaaccggttacgttcgggttaccgggactacgggtaccctaacttacccggttcgtttaccgttacccgttaccgttacccgtttccccgtaacccgttacccgttcgtaaccgg

SEQ ID NO: 30865 - DNA, 865 bp, Homo sapiens
  misc_feature: GYAE6OF02J1AXM.40.67.G01.1.454.CMB.1.raw
tcagtctagcgactcacgaccggtgctcgatttagagtatacatatttggggtttgggggaggaactgctcagttaggacccagagggaaccatggaacgccccagcccagcttctcttcctcctgcttacctcgtggcctcccagcaggcccaaccggagtaagtttcgttccgtaggaccacgtacgttccgtccgacgccctacccgtgtcccttgtccctcgagggtacaaacggcgtccctaccctccgtcctgggcccggggacctagttcgacggactacggttacgttacggacccttaccgttaccgttacgtcccggttaacggtaaccctaaaacgtaaacggccgttaccgggaccgttaacggccctaccgaaccgtaccgttaccccgtagtaactttaccgtacgttacgaccgtgggttaacccttccctccgggtaaaccggccccgtttaacggttccccggggtccggttccccggtaaggttaaccggtcggttaacgggtccggtaacggttacggggttaccgggtgggtaccggtaaccgttccggtaaccggttttacacgttaccctaaccgaccgttaacacccggtaggtaccctacggtaccggtacggtaccggtaccgttaggttaacgttcggttacgtttaacgtcgttacgtcgtacgtacgtcgtacgtcgtacgtcgtacctccgtagttacccgggtgtaccgggacgtacgtaacgtcggaacgtacggtaaacgtaccgtggtacgtcgttacggtaccgtagtaccgtagttaccggttacttccggttaacgttcccggtcgtaacctcgggttaccttaacggg

SEQ ID NO: 30866 - DNA, 635 bp, Homo sapiens
  misc_feature: GYAE6OF02IY2GV.40.67.G01.1.454.CMB.1.raw
  modified_base (142)..(142): a, c, t, g, unknown or other
  misc_feature (142)..(142): n is a, c, g, or t
  modified_base (436)..(436): a, c, t, g, unknown or other
  misc_feature (436)..(436): n is a, c, g, or t
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
  modified_base (492)..(492): a, c, t, g, unknown or other
  misc_feature (492)..(492): n is a, c, g, or t
tcagtctagcgactcacgaccggtgctcgatttagagtatacatattgggtttgggggaggaactgctcagttaggacccagagggaaccatggaagccccagccccagcttctcttcctcctgctactctggctcccagcngccgacggagaagttgtcctgacacagtctccagccacctgtccttgtctccagggcaaagcgcctccctctccgtggccgggccagtcagcatggttcggcctaccgttccgttagccttaggaacccaaaacaaaacgtccgtcggaccgacggtccctacccgagaccttcccctagtacttcgtaagtgacgttgtccgttaccgttccggacgggtcctacggtccgggtccgtccccgggccttagggtcctaggtcggcgtaggtcggtcgtgggactacgtcctcnctctacacgtatcagcngtcngcgtacgagttcgtttgtagtttatgtgtcgacgngtcgcgtcgccgtactccggacctcggtcgtcggcggacgtacggagtacgaacgtactaaccgaacgtacgtggtacgtcgtacgaccacttacgtcttcgttacttacttacccgttacccgtcccgtacgtcgttaccgg

SEQ ID NO: 30867 - DNA, 850 bp, Homo sapiens
  misc_feature: GYAE6OF02GQ1MT.40.67.G01.1.454.CMB.1.raw
  modified_base (253)..(253): a, c, t, g, unknown or other
  misc_feature (253)..(253): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggtattggtagaaaccgttcggggaccctgtccctctaattcgtctttgtctctaggtaacttctatcgaagggtancagcttccgagtgggctggactccgcacgccccgaaggaacggctacatgcgttggactagtgtactacgttcgttagtcgggtccgtcctacccgtacgtaaccgtacggttccggacccggtcccccttaccggtaaccggtaacggttacccggaaccgtacccccgttacgtaaccggtttaacccttaaccccgtaaacgttaaaccggtaaccccgtaaccggtttaaaccccgaaaacggttaaacccccgttttaaccggttttaccccgtaaccggtaacccggtaccgttacggttaaacccgttccgttacgggtaacccggtaccccgggaccgtaccgaaaccggtaccgtaaccggtcgtttacgttaccgtttaagtttacgttacggtacggtacccgtaaggttaccttaccggttcctttcggttaacggggtttaacgggttcggggttaaccttacgggtacccgtaaccgggttacttaaccgttaacccgtacccgttaacccggttcggttaccgttacggacgttcggttccggtacgggggtaccccgttacgggggtcccctttaccgggg

SEQ ID NO: 30868 - DNA, 766 bp, Homo sapiens
  misc_feature: GYAE6OF02JF2IE.40.67.G01.1.454.CMB.1.raw
  modified_base (204)..(204): a, c, t, g, unknown or other
  misc_feature (204)..(204): n is a, c, g, or t
  modified_base (255)..(255): a, c, t, g, unknown or other
  misc_feature (255)..(255): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagngcctcctctcctggcgggccagtcagcatgtgcactctagcctgtaccaanaaagctgccaggctccagactcctcatctatgatcgcgttcttccgagggccctacgtcggccgtcccggccgtacggttccaggtcggacgtacggttcgggtccgtacggggtaacctacggtccctttacgaccgttccgttaccgaaccctacgttaccgaacgtccgaacggtcccgttacgggacccgtacccggtaaagttaccggtttttcggtaccggtttttaaagttacccgttacggttccgaacgttaccggtaccggtacgttcccggacccggtaccgttacccgggccccttaccggttacgggttacccgggaccggggttaaaccgggtaaccggtaacggggttacgtaaccgtaacgttaaacccggaaaaccgttaacggttaccgggtcgggtaaccgttacggaccctaaccgttaacgttacccgttaacgtttacccgtttacgtaacccgtttcccgtttaccccggtacttaaccgtttaccgg

SEQ ID NO: 30869 - DNA, 857 bp, Homo sapiens
  misc_feature: GYAE6OF02FZ3NN.40.67.G01.1.454.CMB.1.raw
  modified_base (820)..(820): a, c, t, g, unknown or other
  misc_feature (820)..(820): n is a, c, g, or t
tcagtctagcgactcacgaccggtgctcgatttagagtatacatattgggtttgggggaggaactgctcagttaggacccagagggaaccatggaagccccagcccagcttctcttcctcctgctactctggctcccagcagccacggagaattgtctgacacagtctcagccacctgtccttgtctaccgagggacaaagacgtccctaccttctcccgtaggccggggaccagtccagcattggttacggcctacctccgttagcccgttaggtaaccaaactaaaagccttagggcccaaggggtacctaccccgaaaggtaacccttaccctacgaaacgtttctaactaggtaactcggtacgttcccgttacccggacggggtacccctaaggttaccggggacccggtttaccccggggaccttagggtttaccgaaggggttcgggaccgtaggggtttcggttaaccgggtaggggtaacctaaccggtcccgttttaaccgaaccgttaccgtaaccctaacccgtaagttcccgaaacggtcctaacgggacccgtttacgggaaaccggtaaccccggttaaaggtttacggtttttaccggtaaccgggtttttaaagtaccggttaacgggttccggaacggtaacggttccgtaccgggtacccgtaaaccgttccgtcccgtacgggtacgtttaccggggaacggtaacgggacggtaaagggttcgtaacgtactaaccggaaacgtacgtcgggtatccgttacgaaccgtaacctcgttaccgttacgttacgttacccnccggttttaacctccggtaaccgttctacggtaaccg

SEQ ID NO: 30870 - DNA, 773 bp, Homo sapiens
  misc_feature: GYAE6OF02JTDPI.40.67.G01.1.454.CMB.1.raw
  modified_base (681)..(681): a, c, t, g, unknown or other
  misc_feature (681)..(681): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggacttggtagaaaccgttcggggaccctgtccctcattcgctttgtctctggtaacttctatcgaaggtacgcagtcttccgacgtgggcttggactcccggaccaccggcccccgaagggaacggggtcctacccgaagtcggtccgttagggctacgttggtaccttaactttcgttaggtcggggtacctaccgtcccgtaaccgtccgtacggtcggtccccgtcccgtccgtacgtaccggtccgtaccggtccctactacgtttaaccgtcctaacgtaacgtacccgtaaccgtaacccgtaaccggtaacccgttccgttttaacccgcgtaccgttactcgaccggttactacgtccgaccgcgtacccgacgtaccgacgtcgtacgtacgttaacttcgtagtcggtcgaaccgttcgtacgtaccttcgttacgggtacggtttcgggtaccttaccgggtacccgttaccgggtacttcccggtttaaccncccggtttaacccgtccgggttacgttaccggtaacccgtttcggttaccggggttccgggaccccgggttaggttccccgggttcccgggg

SEQ ID NO: 30871 - DNA, 841 bp, Homo sapiens
  misc_feature: GYAE6OF02I2ITU.40.67.G01.1.454.CMB.1.raw
  modified_base (374)..(374): a, c, t, g, unknown or other
  misc_feature (374)..(374): n is a, c, g, or t
  modified_base (592)..(592): a, c, t, g, unknown or other
  misc_feature (592)..(592): n is a, c, g, or t
  modified_base (613)..(613): a, c, t, g, unknown or other
  misc_feature (613)..(613): n is a, c, g, or t
  modified_base (688)..(688): a, c, t, g, unknown or other
  misc_feature (688)..(688): n is a, c, g, or t
tcagtctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgacgggtgtcggcccgaggtgttcggtacgtaaacccgttcggggaccctcggttaccctagtaagttcgtcgtttcggtaccttccgttaaggtaacctttctaagtaccggtaaaggggtcacgtacgtccttaccgtaggtcgggtcttacggactccggcgaccgaccccgaagggtaacggcctaccgaagtcgtacggttacggactntacggtactaagtttcgttaggcggtcgacctccctaactacgtacgtcggcccgtaccgacgtagacgttaccgaaccgtccgtacacgtaccgtacgaactaacgtaccgacccgtaaccgtaaacgttacccgttacgtttccccgacggtacgtcgtaacggtccgtacggtaccggttacgacccggtccgacggaccgtacgtaaccgggtnttaaccgttcttaacggtttnacggtacggtaccgtacggttaccgttaaccgtccgtttacgggttaaccggttacgggtaccgggtttaaaccnccgggtaacccgttacccggtaccttttaaccccggtacccgtttccccggttttaacccggtggtttaacccggtaggttaacccccggttcggttaacccgggggttcccgggggaaacccgggtttccgggtaccccggttttcccgggg

SEQ ID NO: 30872 - DNA, 932 bp, Homo sapiens
  misc_feature: GYAE6OF02F62EP.40.67.G01.1.454.CMB.1.raw
tcagtctagcgactcacgaccggtgctcgatttagagtatacatattgggtttggggaggaactgctcagttaggacccagagggaaccaatggaagccccagcccagcttcctcttcctcctgctactctggctcccagcagccaccggagaagttgtcctgacacagtcctccagcccaccctcgtccttgtctccgagggcaaagcgccctccctctccgtggccgggccacgtccagctagtcgtcggcctaccttccgttacgccgtacggtaacccgaaactaaaacggccgtacggacccgtacggaccttccccgaagtacccgttcccctactaacttccgtaatcgtaacgttccggtccgttaccgttacccggacggggtaccctacggttccgggtaccccggtccccgggtaccgtacgggttaccgaacggggtcggtacggtacggggttcgggttaccggtacgggggtaaccgtaccggttcccgtttacccaaccgtttccgtaaccgtaacccgtacgtaccgacgtaccgtaccggtacccggtagggaacccggtaccggttaaaaggtttcggtttttaccgggttacggttttaaacgttccggtttacggaaccgtacggtacccgttaacggtcccgggttaccgaacccgggttccggtcccgggtacccccggtttacggtcccgggggttaaacccggggccggggtaaaccgggttaaccggtaacgggggttccggtaaacctaaacccgggttaaaccgtaaaaccccgggttaggttccgggttaacgggtacccttaacgggaacccttaacgggtaaccctttcggttaccgtttacccggttaccggttaaaccccgttttccccgaccccggtttaaccggtaacgttccccggg

SEQ ID NO: 30873 - DNA, 716 bp, Homo sapiens
  misc_feature: GYAE6OF02JD1QN.40.67.G01.1.454.CMB.1.raw
  modified_base (469)..(469): a, c, t, g, unknown or other
  misc_feature (469)..(469): n is a, c, g, or t
tcagtctagcgactcacgaccggtgctcgatttagagtatacatattggggtttgggggctttctgagagtcatggatctcatgtgcaagaaagtgaagcacctgtggttcttcctcctgctggtggcggctcccagatgggtcctgtccctgatgcaggtgcggggagtccgggcccaggattggtagtaaaccgttcggggaccctgtccctcaattgctttgtctctggtaacttctatcgaagggtcgcagtcttccacgtggggctggactcccgcacggcccccgaagggaacgggctaccgaagtcggtacggttcgactagtacgtctaagtttcttagtcggggctccctacccgtaacgtacgtacgtcggaccgtcccgtaccgaacggacgtccggaccgtccctacgatactacccgtaatacgacctaccgtaccaaacgtaccctacgtttccncgtacggtctcggtaacctccgtcgtaccggacccgtaccggcgaaacggaccgtaccggtcttacgtaccgttatttacgtcgtacggtacgtaacggttcctcggttacccgtttcggtaggttacggggtcgggttaacttcgggaccccggtaacggtactaacccgttacctacccgtacggttccggtacgttaccgcgttacggtccgggtacgggaccggttaccgggccgttcccggg

SEQ ID NO: 30874 - DNA, 656 bp, Homo sapiens
  misc_feature: GYAE6OF01DB2DQ.38.75.G09.1.454.CMB.1.raw
  modified_base (464)..(464): a, c, t, g, unknown or other
  misc_feature (464)..(464): n is a, c, g, or t
tcagtcgatcacgtcacgaccggtgctcgatttagtatagacatcaacacacgaaaaggggggggtctcaggaggcagcgctctcaggacatctccaccatggcctgggctctgctgctcctcacctcctcactcagggcacagggtcctgggcccagtctgccctgactcagcctgcctccgtgtctgggtctccgtggacagtggatcaccatcctcctgcacgtggaaccagcagtgacgttggtgttatgactatgtctcgtgtaccaacaccaccccgacaaccgccccaaatcatgtattagtggagtactagtaacgtccggtccgttcggggttactacgtcggttctacgttcggccttacgtaacgtcgtacggtaccaaccgtaccggtccctcccgtacgaccctacttccgtcgtcgggccttccgacgtccgtaggacggtacgacggtntacgtattacgtactgactacggtctacgtacttaacgtacgtagcgtaacgcttaactccggttacggttcggggttacggtacccggggggtaacgggggaaccctaacggtccgttaaccggtacccggtttaccgtacgggtaccgaccggtacccgtaggtcccttacccgggtcccccgttaccgg

SEQ ID NO: 30875 - DNA, 676 bp, Homo sapiens
  misc_feature: GYAE6OF01EFWFC.38.75.G09.1.454.CMB.1.raw
  modified_base (232)..(232): a, c, t, g, unknown or other
  misc_feature (232)..(232): n is a, c, g, or t
  modified_base (332)..(332): a, c, t, g, unknown or other
  misc_feature (332)..(332): n is a, c, g, or t
  modified_base (428)..(428): a, c, t, g, unknown or other
  misc_feature (428)..(428): n is a, c, g, or t
tcagtcgatcacgtcacgaccggtgctcgatttagtatagacatcaaacatacaaaagggggggggtctcaggaggcagcgctctcaggacatctccaccatggcctgggctctgctgctcctcaccctcctcactcagggcacagggtcctgggcccagtctgccctgactcagcctgcctcgtgtctcggtctcgtggacagtgatcactatctcctgcacgtggaaccngcagtgtacggttggtggttatgtacttatcgtctccgtacggtaaccaaaccaacccacccccgaccaaaccgacccccaaactctagtgtaatttagngtacggtactaacgtaacgtccggtcccgttcggggtttactacgttcggttctcgtcgcttacgagtccgtcgacaccgccgtcctcctgacctntcgtcgtcggcctccgacgtccgtaggacggacggtacggtcttagttacttacgtacgtcgacgtatacctagtaataccgtacgtacgacgtacgtacgtacgttacggtacggttggggtaccggggttccgggggaaccgggggtacctaacgggtccggttacccggtacccgggtcccgttaacggacccgtaacccggacccggtaacccggtcccgttccccggtcccccggttacccgg

SEQ ID NO: 30876 - DNA, 668 bp, Homo sapiens
  misc_feature: GYAE6OF01C0954.38.75.G09.1.454.CMB.1.raw
  modified_base (495)..(495): a, c, t, g, unknown or other
  misc_feature (495)..(495): n is a, c, g, or t
tcagtcgatcacgtcacgaccggtgctcgatttagtatagacatcaacacacgaaaggggggggtctcaggaggcagcgctctcaggacatctccaccatggcctgggctctgctgctcctcaccctcctcactcagggcacagggtcctgggcccagtctgccctgactcagcctgcctcgtgtcgtgggtctccgtggacagtggatcacctatcctcctgcacgtggaaccagcagtgacgttggtggttatgactatgtctcctggtaaccaacaaccaccccgacaaaccgaccccaaactcatacgtaatttagtagtacggtactaagtaacgtccggtacccggttacggggtttactaacgttcggttcgtcgtcgcctacgaagttcgtcggtacacgtaccggccttccgtacgacctatccgtcgtcgggtcctcgacgtccgtaggaacggacggaggtcctaggttactttaacgttacgngtactacgttactactaacttactaacgtagacagtactacttcgtacgggtttcgggtcgggttaccgggggaccggggaacctacgggtcgttacgggtacccggttaccggttaacggaccgtaaccggtacccggtaacggtcccgtcccggttcccccggttaaccgg

SEQ ID NO: 30877 - DNA, 812 bp, Homo sapiens
  misc_feature: GYAE6OF01BT68L.38.75.G09.1.454.CMB.1.raw
  modified_base (247)..(247): a, c, t, g, unknown or other
  misc_feature (247)..(247): n is a, c, g, or t
tcagtcgatcacgtcacgaccggtgctcgatttagtatagacatcaacacgacaaagggggggtctcaggaggcagcgctctcaggacatctccaccatggcctgggctctgctgctcctcacctcctcactcagggcacaggtcctgggcccagtctgccctgactcagcctgacctccgtgtcgtgggtctccgtggacctaggtggactcgacctattcctcctggacctaacgtcgggaaccngcctaaggtcgtacggttggtagttatacgtacttagtcgtaccgtccgtcggtaaccacaacccgtacccgaccaaacgcccctaaaacgtctaacgtcgtaacttacgtaggtacggtactaacggttaacgtccggtaccgttcggggttactaacgttcggttacgtccgtacggtacctaccgtaagtccgtaggaccctaacgtacccggtccctcccgtacgtacctacgttccgtcggtaccggtacctccgtacggtacccgtaggtaccggtaccggtacggttaccgtacggtaacgttttaaccgttaaccggtcggttaccggtaacgttaccgttaaccgtaaacgtttaccgttaacggtacggtaccgtaaccggttaccgtaacgttaccgttaaccgggttttcggggtaccgggttacccggggaccggggtaaaccgttacggtacccggttaacggttaccccgggttaccggttaacccgggtacgtaaccccgggacccgtttaagggtcccccgttccccgggtacccccggtttaacggg

SEQ ID NO: 30878 - DNA, 727 bp, Homo sapiens
  misc_feature: GYAE6OF01B8HHV.38.75.G09.1.454.CMB.1.raw
tcagtcgatcacgtcacgaccggtgctcgatttagtatagacatcaacacacgaaagggggggggtctcaggaggcagcgctctcaggacatctccaccatggcctgggctctgctgctcctcaccctcctcactcagggcacgagggtcctgggcccaggtctcgccctgactcagcctgcctcgtgtcgtcgggtctccgtaggacaggtcggactccaacctattcctctcgcctacgtacggaacctaggctaaggtcggtacggttagggttgttatagtacttagtcgttctaccgtacggtaaccaaaccgtaacccgaacccccgacccaaaccgacccctaaactcactacgtattagtagtacggtactacgtaacgtccggtccggttacggggtttactacgttcggttccgtcgtcggtacgtaccgtacgtacgtacggtaccgaccgaccggtccctcccgtacgaccttaccgtcgtccgtacgggtcctacggacctccggtaggacggacgacggtacgttactaacttagtaccgtacgtactacgtctaactaacgtactacgtagactaacgtactacgttacgttacgggttcgggtacggggttaccggggaccggggtaaccgtacggtcccggtaccggtaccggttcggtaaaccggtccgtacggaccccgtaagggccccgttcccggtcccggtcccg

SEQ ID NO: 30879 - DNA, 767 bp, Homo sapiens
  misc_feature: GYAE6OF01EWIIX.38.75.G09.1.454.CMB.1.raw
  modified_base (172)..(172): a, c, t, g, unknown or other
  misc_feature (172)..(172): n is a, c, g, or t
  modified_base (216)..(216): a, c, t, g, unknown or other
  misc_feature (216)..(216): n is a, c, g, or t
  modified_base (251)..(251): a, c, t, g, unknown or other
  misc_feature (251)..(251): n is a, c, g, or t
  modified_base (361)..(361): a, c, t, g, unknown or other
  misc_feature (361)..(361): n is a, c, g, or t
  modified_base (429)..(429): a, c, t, g, unknown or other
  misc_feature (429)..(429): n is a, c, g, or t
tcagtcgatcacgtcacgaccggtgctcgatttagtatagacatcaacacgacaaaggggggggtctcaggaggcagcgctctcaggacatctccaccatggcctggctctgctgctctccaccctcctcactcgacggcacgacgggtcctggggccccagtctcgccctnacgtccacgcctcgtcctccgtgttcgtcggtcctccgtggacngtgacttccacctatcctcctgccacgtacgaacngactagtggtacggtttggtgttactagacgttattcgtcctccgtacgaacccaaccgacccgacccccgaaccaaccgaccccctaatcgacttagttaacgttttancggtaacggttactaaggttaacccggtccgggttaccggtttacggggtttacctacgttcggttcncgttacgtccagtacgtcgttacggaactacccgtccggtccccgtacgtacctaacgtccgttacgtccggttccggtcccctaccgtaccgtaccggtacggacgggaacggtaccggtacgtttaacggttaacgtttaaaccgtttcgtaccggtacgttaccgtacttaccgtaatttaaccgacgttaaacgccgtaactacggttacgttcccggttaaggtttccggggttaggggttccgggggaaccgggtacgtaccggtaccgtacggtccgttacggaccgtacgtacccgtacggacccgtccgtacccggtcccgttacccgg

SEQ ID NO: 30880 - DNA, 663 bp, Homo sapiens
  misc_feature: GYAE6OF01B941N.38.75.G09.1.454.CMB.1.raw
  modified_base (205)..(205): a, c, t, g, unknown or other
  misc_feature (205)..(205): n is a, c, g, or t
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
  modified_base (262)..(262): a, c, t, g, unknown or other
  misc_feature (262)..(262): n is a, c, g, or t
  modified_base (468)..(468): a, c, t, g, unknown or other
  misc_feature (468)..(468): n is a, c, g, or t
  modified_base (483)..(483): a, c, t, g, unknown or other
  misc_feature (483)..(483): n is a, c, g, or t
tcagtcgatcacgtcacgaccggtgctcgatttagtatagacatcaacacacgaaaagggggggggtctcaggaggcagcgctctcaggacatctccaccatggcctgggctctgctgctcctcaccctccctcactcagggcacgagggtcctgggcccagtctgccctgactcagcctgcctcgtgtcgtggtctcgtggacngtgatcacctatcctcctgcacgtacgaacngcagtggagttggtagttangtactntcgttctcgtacgaaccaaccacccctaaccccgacaaacccgtacccccaaagtccagtacgtaatttcgtaggtagtacgaaggttacgtccggggtacccgttaggggttttacttaccggttcgttacttcggtacgtaccgtactaggttcgtcgaacgaccgaccggtcctaccgcgtactcgtacctcggtcgcctcgntaccgtgaggtacgngtatagtagttacttgacagtactacgtgtaacttacgtaaccgacgtacgataccgttagtcgttacggttcggggtcggtaccggggacgggaaccttgggtaccgtcccggtaccgttaccgggtaggtacccaacccgggtacccgacgggccccgttcccgtccccggttacccg

SEQ ID NO: 30881 - DNA, 629 bp, Homo sapiens
  misc_feature: GYAE6OF01BRJC5.38.75.G09.1.454.CMB.1.raw
  modified_base (203)..(203): a, c, t, g, unknown or other
  misc_feature (203)..(203): n is a, c, g, or t
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
  modified_base (315)..(315): a, c, t, g, unknown or other
  misc_feature (315)..(315): n is a, c, g, or t
tcagtcgatcacgtcacgaccggtgctcgatttagtatagacatcaacacacgaaagggggggggtctcaggaggcagcgctctcaggacatctccaccatggcctgggctctgctgctcctcaccctcctcactcgagggcacagggtcctgggcccagtctcgccctgactcagcctgcctcgtgtcgtggtctcgtgacngtgatcaccatctccngcacgtgaccngcagtgtacggttggtgttatgactntcgtctcgtacgtaccaaccaaccaccccgaccaaccacccccaatcagtagtattagnggtacgtactactacgtccgaccttcggtacggttactagtcgtcttctcgtcgcctacgtacgtcgtcgacctaccgacccgtcccttccgtacgaccctactccgtcggtcgggtcctacggacggtccgtagggaacggaccggtaggtccgtagttaacgtttacgtcgtacggacctacgttccttaacgttaagaaggtaagtaagtactaccgttagttcggttgggtacggtacgggacgggtacgacgtagtcgtaccggtaaccctcggtacgacgacccgacgacggtcccgtcccgtccccg

SEQ ID NO: 30882 - DNA, 882 bp, Homo sapiens
  misc_feature: GYAE6OF01CZ9XV.38.75.G09.1.454.CMB.1.raw
  modified_base (193)..(193): a, c, t, g, unknown or other
  misc_feature (193)..(193): n is a, c, g, or t
  modified_base (242)..(242): a, c, t, g, unknown or other
  misc_feature (242)..(242): n is a, c, g, or t
tcagtcgatcacgtcacgaccggtgctcgatttagtatagacatcaacacacgaaaggggggggtctcaggaggcagcgctctcgaggacatcctaccaccagtcggccgtgggctctgtctgctcctccaccctcctcacgtcgacgggcacgacgggtccgcggacccgagtccgtcgcccgtgaccgtcncgccgtcgccgtcggtgtcgtcggtccgtacgtggacgacggtagaccncctaacctcttcctccgtcgtaaccgtacggacgaaacgcggaccggttaggtacgggttagtttaggtacgttggtaacgttacgttcgtgttacccgttaccggtaaccgaaaccctaacccaaccccggtaacccccgaaacccgtaacccccgtaacccttaaaactcctttagtaccggttacttttaacggaggttaacccgagtttaaacgggtaccggggtttccccgtttaacgggggtttaccggttaactttaacgttccggtactcggttaacggacctcggtaacgtaccgaggaacccctacgtaccccggccgttaccggtaactcccgttgttaccggtccgtaccggtcccgtaccgtacgggtacccggacgggtaacggtaaccggtcgggtaacctttagttaacgtttacggtaccgtggttaacacgtaacgttaactaaccgttaagtacccgtaacgggtacacgttaccgtcggtttacgggtacggggttaccgggtaccgggggttacccgggtacgggaaccgggtccgtaccggtacccggtccgttacggtaacccgaccggtacccggtaacccggtagggcccccgtacggttacccccggttcccgg

SEQ ID NO: 30883 - DNA, 704 bp, Homo sapiens
  misc_feature: GYAE6OF01EMC98.38.75.G09.1.454.CMB.1.raw
  modified_base (121)..(121): a, c, t, g, unknown or other
  misc_feature (121)..(121): n is a, c, g, or t
  modified_base (360)..(360): a, c, t, g, unknown or other
  misc_feature (360)..(360): n is a, c, g, or t
  modified_base (576)..(576): a, c, t, g, unknown or other
  misc_feature (576)..(576): n is a, c, g, or t
tcagtcgatcacgtcacgaccggtgctcgatttagtatagacatcgaacacgacaaagggggggtctcaggaggcagcgctctcaggacatctccaccatggcctgggctctgctgctccncaccctcctcacttcgaggcacaggttcctgggccctagtctgccctgactcagcctgcctcgtgtcgtggtctcgtgacagtggatcaccatctcctgacctagtcggaaccagtccaggtacggtaccgttggttggttatgtacctagtcgttccttacctcggtaaacccaaccgaacccgaaccccccgaaccgaaaaccgaccccccgtaaactccgattagttagtttacgngtacgtacgtagttaacggtccggtacccgtttggggtttaacctaacgttcggttcttacgtacggtaccgtaaccagttcgtacgactacccgtcggtcccgtaccacgtacacttcgtccggtacgctaccgacctcgtacggaacgcgagtcctagttaacttagtacctgactacgtactacgtaataaccggtagttaccgactaaccgnttacgttaccgtacgggttagggttaccgggtacggggaccggaacgtaaccggtccgtacggttacccggtcgtaacgttccgtaaccgggaccgaacccggttccggtacccgtcccgttacccgg

SEQ ID NO: 30884 - DNA, 529 bp, Homo sapiens
  misc_feature: GYAE6OF02IILX5.38.75.G09.1.454.CMB.1.raw
tcagtcgatcacgtcacgaccggtgctcgatttagtatagacatcaacacacgaaagggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtggatcaccatctcctgcactggaaccagcagtgacgttggtggttatgactatgtctcctggtaccaacaacaccccgccaaacgccccccaaactcatgactttatgaggtcagtaatcggccctcggggtttctaagtcggttctctggctcaagtctggcaacacggcctccctgaccatctctgggctcagctgaggacgaggctgatttattactgcagctacatatactagacagcatcacgttgggtgttcgggcgggggaccaaggctcggaccgttcgtacggtccgacgacccgaaggccgttccgccccttccggg

SEQ ID NO: 30885 - DNA, 293 bp, Homo sapiens
  misc_feature: GYAE6OF01BBWFS.35.74.G08.1.454.CMB.1.raw
  modified_base (288)..(293): a, c, t, g, unknown or other
  misc_feature (288)..(293): n is a, c, g, or t
tcagtacagatcgtcacgaccggtgctcgatttagtagctctatcagggccacttctttcccacccaggttcagtggcggtgggtctgggacagagttcactctcaccatcagccagcctgcagtctgaggatgtggcggtttattactgtcagcaatattccagtattccgtggacgttcggccaagggaccaaggtggagatcaaacgaactgtggctgcaccatctgtcttcatcttcccgccatctgaacgatctgtactgagcgggctggcaaggcgcatagnnnnnn

SEQ ID NO: 30886 - DNA, 287 bp, Homo sapiens
  misc_feature: GYAE6OF01D94WX.35.74.G08.1.454.CMB.1.raw
  modified_base (287)..(287): a, c, t, g, unknown or other
  misc_feature (287)..(287): n is a, c, g, or t
tcagtacagatcgtcacgaccggtgctcgatttagtagctctatcagggccacttctttcccacccaggttcagtggcggtgggtctgggacagagttcactctcaccatcagcagcctgcagtctgaagattttgctgtttattactgtcagcagtattatgcctggccgtacacttttggccaggggaccgaactggagatcagacgaactgtggctgcaccatctgtcttcatcttcccgccatctgaacgatctgtactgagcgggctggcaaggcgcatagn

SEQ ID NO: 30887 - DNA, 287 bp, Homo sapiens
  misc_feature: GYAE6OF01DBJAN.35.74.G08.1.454.CMB.1.raw
  modified_base (253)..(253): a, c, t, g, unknown or other
  misc_feature (253)..(253): n is a, c, g, or t
  modified_base (282)..(287): a, c, t, g, unknown or other
  misc_feature (282)..(287): n is a, c, g, or t
tcagtacagatcgtcacgaccggtgctcgatttagtagctctatcagggccacttctttcccacccaggttcagtggcggtgggtctgggacagagttcactctcaccatcagcagcctgcagtctgaagattttgctgtttattactgtctagcagtattatgcctggccgtacacttttggccaggggaccgaactggagatcagacgaactgtggctgcaccatctgtctcatctccgcatctgaacgtnctgtactgagcggctggcaggcgcatagnnnnnn

SEQ ID NO: 30888 - DNA, 299 bp, Homo sapiens
  misc_feature: GYAE6OF01ARISU.35.74.G08.1.454.CMB.1.raw
  modified_base (288)..(299): a, c, t, g, unknown or other
  misc_feature (288)..(299): n is a, c, g, or t
tcagtacagatcgtcacgaccggtgctcgatttagtagctctatcagggccacttctttcccacccaggttcagtggcggtgggtctgggacagagttcactctcaccatcagcagcctgcagtctgaagattttgctgtttattactgtcagcagtattatgcctggccgtacacttttggccaggggaccgactggagatcagacgaactgtggctgcaccatctgtcttcactctccgcatctgaaccgatctgtactgagcgggctggacaaggcgacatagcnnnnnnnnnnnn

SEQ ID NO: 30889 - DNA, 312 bp, Homo sapiens
  misc_feature: GYAE6OF01EHH05.35.74.G08.1.454.CMB.1.raw
  modified_base (294)..(312): a, c, t, g, unknown or other
  misc_feature (294)..(312): n is a, c, g, or t
tcagtacagatcgtcacgaccggtgctcgatttagtagctctatcagggccacttctttcccacccaggttcagtggcggtgggtctgggacagagttcactctcaccatcagcagcctgcagtctgaagattttgctgtttattactgtcagcagtattatgcctggccgtactacttttggccgaggggaccgaactggagatcagacgaactgtggctgcaccatctgtctcatccttcccgcatctgaacgatctgtactgagcgggtcgtggcaacggtcgctagtagnnnnnnnnnnnnnnnnnnn

SEQ ID NO: 30890 - DNA, 292 bp, Homo sapiens
  misc_feature: GYAE6OF02HEQI6.35.74.G08.1.454.CMB.1.raw
  modified_base (288)..(292): a, c, t, g, unknown or other
  misc_feature (288)..(292): n is a, c, g, or t
tcagtacagatcgtcacgaccggtgctcgatttagtagctctatcagggccacttctttcccacccaggttcagtggcggtgggtctgggacagagttcactctcaccatcagcagcctgcagtctgaagattttgctgtttattactgtcagcagtattatgcctggccgtacacttttggccaggggaccgaactggagatcagacgaactgtggctgcaccatctgtcttcatccttcccgccatctgaacgatctgtactgagcgggctggcaaggcgcatagnnnnn

SEQ ID NO: 30891 - DNA, 289 bp, Homo sapiens
  misc_feature: GYAE6OF02JDMES.35.74.G08.1.454.CMB.1.raw
  modified_base (286)..(289): a, c, t, g, unknown or other
  misc_feature (286)..(289): n is a, c, g, or t
tcagtacagatcgtcacgaccggtgctcgatttagtagctctatcagggccacttctttcccacccaggttcagtggcggtgggtctgggacagagttcactctcaccatcagcagcctgcagtctgaagattttgctgtttattactgtcagcagtattatgcctggccgtacacttttggccaggggaccgaactggagatcagacgaactgtggctgcaccatctgtcttcatcttccgccatctgaacgatctgtactgagcgggctggcaaggcgcatagnnnn

SEQ ID NO: 30892 - DNA, 291 bp, Homo sapiens
  misc_feature: GYAE6OF02GA67S.35.74.G08.1.454.CMB.1.raw
  modified_base (286)..(291): a, c, t, g, unknown or other
  misc_feature (286)..(291): n is a, c, g, or t
tcagtacagatcgtcacgaccggtgctcgatttagtagctctatcagggccacttctttcccacccaggttcagtggcggtgggtctgggacagagttcactctcaccatcagcagcctgcagtctgaagattttgctgtttattactgtcagcagtattatgcctggccgtacacttttggccaggggaccgaactggagatcagacgaactgtggctgcaccatctgtcttcatcttcccgcatctgaacgatctgtactgagcgggctggcaaggcgcatagnnnnnn

SEQ ID NO: 30893 - DNA, 306 bp, Homo sapiens
  misc_feature: GYAE6OF02HG2OM.35.74.G08.1.454.CMB.1.raw
  modified_base (285)..(285): a, c, t, g, unknown or other
  misc_feature (285)..(285): n is a, c, g, or t
  modified_base (291)..(292): a, c, t, g, unknown or other
  misc_feature (291)..(292): n is a, c, g, or t
  modified_base (294)..(306): a, c, t, g, unknown or other
  misc_feature (294)..(306): n is a, c, g, or t
tcagtacagatcgtcacgaccggtgctcgatttagtagctctatcagggccacttctttcccacccaggttcagtggcggtgggtctgggacagagttcactctcaccatcagcagcctgcagtctgaagattttgctgtttattactgtcagcagtattatgcctggccgtacacttttggccagggggaccgaactgggagatcgagacgaactgtggctggcaccatctgtcttcatcttcccgccatctgaacgatctgtactgagcgggctggcaaggcncatagnngnnnnnnnnnnnnn

SEQ ID NO: 30894 - DNA, 290 bp, Homo sapiens
  misc_feature: GYAE6OF02IK14R.35.74.G08.1.454.CMB.1.raw
  modified_base (288)..(290): a, c, t, g, unknown or other
  misc_feature (288)..(290): n is a, c, g, or t
tcagtacagatcgtcacgaccggtgctcgatttagtagctctatcagggccacttctttcccacccaggttcagtggcggtgggtctgggacagagttcactctcaccatcagcagcctgcagtctgaagattttgctgtttattactgtcagcagtattatgcctggccgtacacttttggccaggggaccgaactggagatcagacgaactgtggctgcaccatctgtcttcatcttcccgccatctgaacgatctgtactgagcgggctggcaaggcgcaatagnnn

SEQ ID NO: 30895 - DNA, 294 bp, Homo sapiens
  misc_feature: GYAE6OF02H7F0Y.35.74.G08.1.454.CMB.1.raw
  modified_base (286)..(294): a, c, t, g, unknown or other
  misc_feature (286)..(294): n is a, c, g, or t
tcagtacagatcgtcacgaccggtgctcgatttagtagctctatcagggccacttctttcccacccaggttcagtggcggtgggtctgggacagagttcactctcaccatcagcagcctgcagtctgaagattttgctgtttattactgtcagcagtattatgcctggccgtacacttttggccaggggaccgaactggagatcagacgaactgtggctgcaccatctgtcttcatcttcccgcatctgaacgatctgtactgagcgggctggcaaggcgcatagnnnnnnnnn

SEQ ID NO: 30896 - DNA, 296 bp, Homo sapiens
  misc_feature: GYAE6OF02IENCJ.35.74.G08.1.454.CMB.1.raw
  modified_base (258)..(258): a, c, t, g, unknown or other
  misc_feature (258)..(258): n is a, c, g, or t
  modified_base (293)..(296): a, c, t, g, unknown or other
  misc_feature (293)..(296): n is a, c, g, or t
tcagtacagatcgtcacgaccggtgctcgatttagtagctctatcagggccgacttctttcccacccaggttcagtggcggtgggtctgggacagagttcactctcaccatcagcagcctgcagtctgaagattttgctgtttattactgtcagtcagtattatgcctggccgtacacttttggccaggggaccgaactggagatcagacgaactgtggctgcaccatctgtcttcattcttcccgccatctgaacgntctgtactgaggcgggctaggcaaggcgacatagnnnn

SEQ ID NO: 30897 - DNA, 328 bp, Homo sapiens
  misc_feature: GYAE6OF02HCQ6P.35.74.G08.1.454.CMB.1.raw
  modified_base (256)..(256): a, c, t, g, unknown or other
  misc_feature (256)..(256): n is a, c, g, or t
  modified_base (293)..(294): a, c, t, g, unknown or other
  misc_feature (293)..(294): n is a, c, g, or t
  modified_base (296)..(328): a, c, t, g, unknown or other
  misc_feature (296)..(328): n is a, c, g, or t
tcagtacagatcgtcacgaccggtgctcgatttagtagctctatcagggccacttctttcccacccaggttcagtggcggtgggtctgggacagagttcactctcaccatcagcagcctgcagtctgaagattttgctgtttattactgtcagcagtattatgcctggccgtacactttttggccaggggaccgaactggagatcagacgaactgtggctgcaccatctgtcttcatcttccgccatcgtgaacgntctgtactgagcgggactggcaaggcgacataggcgnngnnnnnnnnnnnnnnnnnnnnnnnnnnnnnnnnn

SEQ ID NO: 30898 - DNA, 464 bp, Homo sapiens
  misc_feature: GYAE6OF02GUV5V.35.74.G08.1.454.CMB.1.raw
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (415)..(464): a, c, t, g, unknown or other
  misc_feature (415)..(464): n is a, c, g, or t
tcagtacagatcgtcacgaccggtgctcgatttagtagctctatcagggccacttctttcccacccaggttcagtggcggtgggtctgggacagagttcactctcaccatcagcagccctgcgtactcgaagaattttgtctgttttatttacttgtcgagacagtagttaattgcctaggcccgttacgtaaccgttttcggttcccggacggggtaacccgggaaaccgttagggaggtaacgtacgaacgtaaaccggtaaaccgtagttagggtccgttcggccgtacccaactcctggttcctttacctacttcccttccccggtccccacttcctagaacggtacgtactccggttaagttccgaggaccgggccgggtggtacgacggtacgccgtanagatnctcannnnnnnnnnnnnnnnnnnnnnnnnnnnnnnnnnnnnnnnnnnnnnnnnn

SEQ ID NO: 30899 - DNA, 368 bp, Homo sapiens
  misc_feature: GYAE6OF02GYWKB.35.74.G08.1.454.CMB.1.raw
  modified_base (239)..(239): a, c, t, g, unknown or other
  misc_feature (239)..(239): n is a, c, g, or t
  modified_base (304)..(304): a, c, t, g, unknown or other
  misc_feature (304)..(304): n is a, c, g, or t
  modified_base (313)..(318): a, c, t, g, unknown or other
  misc_feature (313)..(318): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (324)..(368): a, c, t, g, unknown or other
  misc_feature (324)..(368): n is a, c, g, or t
tcagtacagatcgtcacgaccggtgctcgatttagtagctctatcagggccacttctttcccacccaggttcagtggcggtgggtctgggacagagttcactctcaccatcagcagcctgcagtctgaagattttgctgtttattactgtcagcagtattatgcctggccgtactactttttcggccagggggaccgaacgttggagactcagacgaacgtgtggctgccaccatcgtntcttcatcctcccgcatcgtacgacgattcgtgtactggagccgggacgtcggacgaacggtcgngtacgtagnnnnnngngncnnnnnnnnnnnnnnnnnnnnnnnnnnnnnnnnnnnnnnnnnnnnn

SEQ ID NO: 30900 - DNA, 208 bp, Homo sapiens
  misc_feature: GYAE6OF01BN1EM.52.4.A04.1.454.CMB.1.raw
  modified_base (206)..(208): a, c, t, g, unknown or other
  misc_feature (206)..(208): n is a, c, g, or t
tcagcgcagtacgacacgaccggtgctcgatttagagtagtgatcagggagagctgctcagttaggacccagagggaaccatggaacccagcgcagcttctcttcctcctgctactctggctcccaggaactgtggctgcaccatctgtcttcatcttcccgccatctgatatacgatcgctgagcgggctggcaaggcgcatagnnn

SEQ ID NO: 30901 - DNA, 213 bp, Homo sapiens
  misc_feature: GYAE6OF01CYVZA.52.4.A04.1.454.CMB.1.raw
  modified_base (206)..(213): a, c, t, g, unknown or other
  misc_feature (206)..(213): n is a, c, g, or t
tcagcgcagtacgacacgaccggtgctcgatttagagtagtgatcaggggagagctgctcagttaggacccagagggaaccatggaaacccagcgcagcttctcttcctcctgctactctggctccaggaactgtggctgcaccatctgtcttcatcttcccgcatctgatatacgatcgctgagcgggctggcaaggcgcatagnnnnnnnn

SEQ ID NO: 30902 - DNA, 208 bp, Homo sapiens
  misc_feature: GYAE6OF01DJQSE.52.4.A04.1.454.CMB.1.raw
  modified_base (207)..(208): a, c, t, g, unknown or other
  misc_feature (207)..(208): n is a, c, g, or t
tcagcgcagtacgacacgaccggtgctcgatttagagtagtgatcagggagagctgctcagttaggacccagagggaaccatggaaacccagcgcagcttctcttcctcctgctactctggctcccaggaactgtggctgcaccatctgtcttcatcttcccgccatctgatatacgatcgctgagcgggctggcaaggcgcatagnn

SEQ ID NO: 30903 - DNA, 207 bp, Homo sapiens
  misc_feature: GYAE6OF01AJT9N.52.4.A04.1.454.CMB.1.raw
  modified_base (206)..(207): a, c, t, g, unknown or other
  misc_feature (206)..(207): n is a, c, g, or t
tcagcgcagtacgacacgaccggtgctcgatttagagtagtgatcagggagagctgctcagttaggacccagagggaaccatggaaacccagcgcagcttctcttcctcctgctactctggctcccaggaactgtggctgcaccatctgtcttcatcttccgccatctgatatacgatcgctgagcgggctggcaaggcgcatagnn

SEQ ID NO: 30904 - DNA, 209 bp, Homo sapiens
  misc_feature: GYAE6OF01B05HF.52.4.A04.1.454.CMB.1.raw
  modified_base (207)..(209): a, c, t, g, unknown or other
  misc_feature (207)..(209): n is a, c, g, or t
tcagcgcagtacgacacgaccggtgctcgatttagagtagtgatcagggagagctgctcagttaggacccagagggaaccatggaaacccagcgcagcttctcttcctcctgctactctggctcccaggaactgtggctgcaccatctgtcttcatcttcccgccatctgatatacgatcgctgagcgggctggcaaggcgcatagnnn

SEQ ID NO: 30905 - DNA, 211 bp, Homo sapiens
  misc_feature: GYAE6OF01BWYN8.52.4.A04.1.454.CMB.1.raw
  modified_base (209)..(211): a, c, t, g, unknown or other
  misc_feature (209)..(211): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctcccaggaactgtggctgcaccatctgtcttcatcttcccgccatctgatatacgatcgctgagcgggctggcaaggcgcatagnnn

SEQ ID NO: 30906 - DNA, 209 bp, Homo sapiens
  misc_feature: GYAE6OF01EUSCF.52.4.A04.1.454.CMB.1.raw
  modified_base (208)..(209): a, c, t, g, unknown or other
  misc_feature (208)..(209): n is a, c, g, or t
tcagcgcagtacgacacgaccggtgctcgatttagagtagtgatcagggagagctgctcagttaggacccagagggaaccatggaaaccccagcgcagcttctcttcctcctgctactctggctcccaggaactgtggctgcaccatctgtcttcatcttcccgccatctgatatacgatcgctgagcgggctggcaaggcgcatagnn

SEQ ID NO: 30907 - DNA, 209 bp, Homo sapiens; identical to SEQ ID NO: 30904
  misc_feature: GYAE6OF01BXS8O.52.4.A04.1.454.CMB.1.raw
  modified_base (207)..(209): a, c, t, g, unknown or other
  misc_feature (207)..(209): n is a, c, g, or t

SEQ ID NO: 30908 - DNA, 210 bp, Homo sapiens
  misc_feature: GYAE6OF01BE4VZ.52.4.A04.1.454.CMB.1.raw
  modified_base (209)..(210): a, c, t, g, unknown or other
  misc_feature (209)..(210): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctcccaggaactgtggctgcaccatctgtcttcatcttcccgccatctgatatacgatcgctgagcgggctggcaaggcgcatagnn

SEQ ID NO: 30909 - DNA, 224 bp, Homo sapiens
  misc_feature: GYAE6OF01BZXZR.52.4.A04.1.454.CMB.1.raw
  modified_base (210)..(224): a, c, t, g, unknown or other
  misc_feature (210)..(224): n is a, c, g, or t
tcagcgcagtacgacacgaccggtgctcgatttagagtagtgatcgaggggagagctgctcagttaggacccagaggaaccatggaaaccccagcgcagcttctccttcctcctgctactctggctcccaggactgtggctgcaccatctgtcttcatccttcccgccatctgatatacgatcgctgagcgggctggcaaggcgcatagnnnnnnnnnnnnnnn

SEQ ID NO: 30910 - DNA, 209 bp, Homo sapiens
  misc_feature: GYAE6OF01EDPXP.52.4.A04.1.454.CMB.1.raw
  modified_base (208)..(209): a, c, t, g, unknown or other
  misc_feature (208)..(209): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctcccaggaactgtggctgcaccatctgtcttcatcttcccgccatctgatatacgtcgctgagcgggctggcaaggcgcatagnn

SEQ ID NO: 30911 - DNA, 204 bp, Homo sapiens
  misc_feature: GYAE6OF01DFYO8.52.4.A04.1.454.CMB.1.raw
  modified_base (204)..(204): a, c, t, g, unknown or other
  misc_feature (204)..(204): n is a, c, g, or t
tcagcgcagtacgacacgaccggtgctcgatttagagtagtgatcaggggagatctgctcagttaggacccagagggaaccatggaaacccagcgcagcttctcttcctcctgctactctggctccaggactgtggctgcacatctgtcttcatcttcccgcatctgatatacgatcgctgagcgggctggcaaggcgcatagn

SEQ ID NO: 30912 - DNA, 237 bp, Homo sapiens
  misc_feature: GYAE6OF01EXYA5.52.4.A04.1.454.CMB.1.raw
  modified_base (201)..(201): a, c, t, g, unknown or other
  misc_feature (201)..(201): n is a, c, g, or t
  modified_base (207)..(237): a, c, t, g, unknown or other
  misc_feature (207)..(237): n is a, c, g, or t
tcagcgcagtacgacacgaccggtgctcgatttagagtagtgatcagggggagagctgctcagttaggacccagagggaaccatggaaaccccagcgcagcttctcttcctcctgctactctggctcccaggactgtggctgcacatctgtcttcatcttcccgcatctgatatacgatcgctgagcgggctggcaaggcncatagnnnnnnnnnnnnnnnnnnnnnnnnnnnnnnn

SEQ ID NO: 30913 - DNA, 524 bp, Homo sapiens
  misc_feature: GYAE6OF01DZ3SE.52.4.A04.1.454.CMB.1.raw
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttcngganaataaaagtggaagataaatatgtttcctggtatcgcagaagccaggccagtcgctgtcctggtcatctatcacgataagaagcgccctgagggactcccgtagagcgattctctggctccaactcgtagggaacacacgcccaactctcgacctatcacggccggaacccaggctagtggatgaggctggacttattacttagtacaatcaactagaaccacctaattcgtaacttagtcgtcttacggaactggactaccgtaagtccaccgtcgtacgggtacacgacccgaggcccaaacccg

SEQ ID NO: 30914 - DNA, 214 bp, Homo sapiens
  misc_feature: GYAE6OF01CJ5QQ.52.4.A04.1.454.CMB.1.raw
  modified_base (210)..(214): a, c, t, g, unknown or other
  misc_feature (210)..(214): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctcccaggaactgtggctgcaccatctgtcttcatcttcccgccatctgatatacgatcgctgagcgggctgggcaaggcgcatagnnnnn

SEQ ID NO: 30915 - DNA, 210 bp, Homo sapiens
  misc_feature: GYAE6OF01DEL6Q.52.4.A04.1.454.CMB.1.raw
  modified_base (208)..(210): a, c, t, g, unknown or other
  misc_feature (208)..(210): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctccaggaactgtggctgcaccatctgtcttcatcttcccgccatctgatatacgatcgctgagcgggctggcaaggcgcatagnnn

SEQ ID NO: 30916 - DNA, 215 bp, Homo sapiens
  misc_feature: GYAE6OF01BD6OO.52.4.A04.1.454.CMB.1.raw
  modified_base (209)..(215): a, c, t, g, unknown or other
  misc_feature (209)..(215): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctcccaggaactgtggctgcaccatctgtcttcatcttcccgccatctgatatacgatcgctgagcgggctggcaaggcgcatagnnnnnnn

SEQ ID NO: 30917 - DNA, 214 bp, Homo sapiens
  misc_feature: GYAE6OF01DP83Y.52.4.A04.1.454.CMB.1.raw
  modified_base (210)..(214): a, c, t, g, unknown or other
  misc_feature (210)..(214): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctccaggaactgtggctgcaccatctgtcttcatccttcccgcatctgatatacgatcgctgaggcgggctggacaaggcgcaatgnnnnn

SEQ ID NO: 30918 - DNA, 210 bp, Homo sapiens; identical to SEQ ID NO: 30908
  misc_feature: GYAE6OF01AZDES.52.4.A04.1.454.CMB.1.raw
  modified_base (209)..(210): a, c, t, g, unknown or other
  misc_feature (209)..(210): n is a, c, g, or t

SEQ ID NO: 30919 - DNA, 211 bp, Homo sapiens; identical to SEQ ID NO: 30905
  misc_feature: GYAE6OF01C6BQK.52.4.A04.1.454.CMB.1.raw
  modified_base (209)..(211): a, c, t, g, unknown or other
  misc_feature (209)..(211): n is a, c, g, or t

SEQ ID NO: 30920 - DNA, 676 bp, Homo sapiens
  misc_feature: GYAE6OF01CZUU3.52.4.A04.1.454.CMB.1.raw
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacacgtcagtcgtccgtctccccaggacagacagccagcatcagctgttcngganaataaaagtggagtataaatattgtttacctggtatcgaccaagaacgccaaggccagtcgcctggtcctggtcagtctagtcaagacgtaagaacgccggcccctagaacgggtactcccgtagacgtcgtattccgtcgtcggccctaccgaactcggtacgggaaaccacgtacgccctactctacgaccagtaccgacggaccggacccgacggacgtaggtacggtacgtacggtacggacgtacggtaacttaacgttacgttacggtacgaacgggttacccggtacgggtaaccgaacggtaacgccgttaccggtcggttacggggttacgggtccggggtaacgggacgggtaaccggtacgggtccggtaaccggttacccggtaccgtacgggtacccggtaaccggtaccccggaaacgggtccccgtcccgggttaccccccggg

SEQ ID NO: 30921 - DNA, 207 bp, Homo sapiens
  misc_feature: GYAE6OF01DM8QZ.52.4.A04.1.454.CMB.1.raw
  modified_base (205)..(207): a, c, t, g, unknown or other
  misc_feature (205)..(207): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctccaggactgtggctgcaccatctgtcttcatcttccgcatctgatatacgatcgctgagcgggctggcaaggcgcatagnnn

SEQ ID NO: 30922 - DNA, 625 bp, Homo sapiens
  misc_feature: GYAE6OF01EZD9D.52.4.A04.1.454.CMB.1.raw
  modified_base (218)..(218): a, c, t, g, unknown or other
  misc_feature (218)..(218): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctcccaggacagacagccagcatcagcttgttctggaanaataaaagtggaagtaattaaatatgtttcctggtatcgccaagaacgccaggccagtcgcctgtcctggtcatctatcacgataagacgcgaccctagagggactccgtgacgcgtacttctctcggtcctacctaacgtccggtagggaaacctaacgacgaccctaacctcgtacgaaccctacgtacgaccgggacccgggacccgaggtaccttaggtagggactgggacgtacgtacgtaactttagttacgtcgtcgtacggtccggtagggactagacgactacgttcgtgggttcggttccgggacgggtacgggaccgtacgggtaccgtccggacccgttaccggaccggtacccggtacgaccccggtacggtcccgtcccggtacccccccggg

SEQ ID NO: 30923 - DNA, 214 bp, Homo sapiens
  misc_feature: GYAE6OF01E144T.52.4.A04.1.454.CMB.1.raw
  modified_base (210)..(214): a, c, t, g, unknown or other
  misc_feature (210)..(214): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctcccaggaactgtggctgcaccatctgtcttcatcttctcgccatctgatatacgatcgctgagcgggctgggcaaggcgcatagnnnnn

SEQ ID NO: 30924 - DNA, 210 bp, Homo sapiens; identical to SEQ ID NO: 30908
  misc_feature: GYAE6OF01E36DU.52.4.A04.1.454.CMB.1.raw
  modified_base (209)..(210): a, c, t, g, unknown or other
  misc_feature (209)..(210): n is a, c, g, or t

SEQ ID NO: 30925 - DNA, 312 bp, Homo sapiens
  misc_feature: GYAE6OF01BCHLK.52.4.A04.1.454.CMB.1.raw
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (236)..(312): a, c, t, g, unknown or other
  misc_feature (236)..(312): n is a, c, g, or t
tcagcgcagtacgacacgaccggtgctcgattttagagtagtgatcagggggagaggctgctcagttaggacccagaggggaaccatggaaaaccccagcgcgacgcgttctcttccgtcctgcttactctggctcccagggaactgtggctgcacagtctgtcttcatcttcccgctatctgatatacgatcgctcgagcgggctggactaaagggcgacaatagncgctgngcnnnnnnnnnnnnnnnnnnnnnnnnnnnnnnnnnnnnnnnnnnnnnnnnnnnnnnnnnnnnnnnnnnnnnnnnnnnnn

SEQ ID NO: 30926 - DNA, 716 bp, Homo sapiens
  misc_feature: GYAE6OF01BFI0K.52.4.A04.1.454.CMB.1.raw
  modified_base (216)..(216): a, c, t, g, unknown or other
  misc_feature (216)..(216): n is a, c, g, or t
  modified_base (233)..(233): a, c, t, g, unknown or other
  misc_feature (233)..(233): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgtctgganataaatggagataaatntgttctggtatcgcagagccaggccagtcgcctgtcctggtcatctatcacgataagacgcggccctagagggtactccgtgacgcgtattcgtcgtggtcctaccaacgtcgtacgggaaccaccgacgtccctaacgttcctacgaccctagtaccgacgggtacccgggaaccccgagggtaccttaaggtcgggtaacgttacgggtaacggtccgttacggtaaccttttaacgtttaccgttcggttaacccacggggtccccgggttaggggtaaccgtaacgggtaaacgtcccgtaaccggtttccggttcgggggtttaccgggtttaccgggggaaccgggggttaaccggggaacccggtacggggtacccggttacccgggtaacccccgggttacccggttaacgggtacccgaacccgggtaacccccggtaaacgggtccccggttcccccgggtaccccccccggg

SEQ ID NO: 30927 - DNA, 215 bp, Homo sapiens
  misc_feature: GYAE6OF01DQOED.52.4.A04.1.454.CMB.1.raw
  modified_base (209)..(215): a, c, t, g, unknown or other
  misc_feature (209)..(215): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctcccaggaactgtggctgcaccatctgtcttcatcttcccgcatctgatatacgatcgctggagcgggctggcaaggcgcatagnnnnnnn

SEQ ID NO: 30928 - DNA, 211 bp, Homo sapiens; identical to SEQ ID NO: 30905
  misc_feature: GYAE6OF01CXSC9.52.4.A04.1.454.CMB.1.raw
  modified_base (209)..(211): a, c, t, g, unknown or other
  misc_feature (209)..(211): n is a, c, g, or t

SEQ ID NO: 30929 - DNA, 213 bp, Homo sapiens
  misc_feature: GYAE6OF01BLQE9.52.4.A04.1.454.CMB.1.raw
  modified_base (209)..(213): a, c, t, g, unknown or other
  misc_feature (209)..(213): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctcccaggaactgtggctgcaccatctgtcttcatcttcccgccatctgatatacgatcgctgagcgggctggcaaggcgcatagnnnnn

SEQ ID NO: 30930 - DNA, 605 bp, Homo sapiens
  misc_feature: GYAE6OF01CBSTX.52.4.A04.1.454.CMB.1.raw
  modified_base (198)..(198): a, c, t, g, unknown or other
  misc_feature (198)..(198): n is a, c, g, or t
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatggaggtgactcagacaccgtcagtgtccgtcctccccgaggacagacngccagcatcagctgttcngganaataaagnggagaataatatgttcnggtancgcagacncaggccagtcgctgtcctggcatctataccaagtaataagaacggccgtccctaggacggtctccgtagacgactattccgcgtcggcctacccaattcggaacggaaccacgcgtaccctacgtcacgaaccctagtccgaacgggcccggaaccgtaggtactagtcggatacgggtacgacttaggtacctttaagttaccgtgtaacggacggtaccggtggtaacaaggaccgtctacgtcggttaggttcggtcgggacggacgggtaccgtacggaccgtccggtaccgttaccggacggttccgaaccggtacccaacgggtccgtccccgtaccccgg

SEQ ID NO: 30931 - DNA, 679 bp, Homo sapiens
  misc_feature: GYAE6OF01BLB0R.52.4.A04.1.454.CMB.1.raw
  modified_base (238)..(238): a, c, t, g, unknown or other
  misc_feature (238)..(238): n is a, c, g, or t
  modified_base (296)..(296): a, c, t, g, unknown or other
  misc_feature (296)..(296): n is a, c, g, or t
tcagcgcagtacgacacgaccggtgctcgatttagagtagtgatcaggggctgggcctcaggaagcagcatcggaggtgcctcagccataggcatggatccctctcttcctcggcgtccttgcttactgcacaggatgtgtggcctcctatgaggtgactcagacaccgtcagtgtcccgtctccccaggacagacagccagcatcagctgttctggagataaagtggagataaagtnttgtttcctggtactcgaccagaacgccaggccagtccgcctgtccgtggtcatctancagataagagccggccctagacgggactcccgtagacggctagttcctcgtcggtacctacccgtaaacgttccgtaagggaaccacgacgccctactcgtacgaccctagtaccgacgggtccccgggaaccagggtacctaggtacgggagttcggacggtaccttacggtaacttaacgttaccgttcggtacccgacgggtacccgggtaacgggacctaagggtaaaccgtcctaacggtttacggtcgggttacgggttaccggggaccggggtaacggggacccgtacgggttaccggtcccggtaacccggttacccggtaacggttcccgaacgggtaaccccgaacgggttccccgtcccggttaccccccgg

SEQ ID NO: 30932 - DNA, 711 bp, Homo sapiens
  misc_feature: GYAE6OF01DIJ6P.52.4.A04.1.454.CMB.1.raw
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctccccaggacagacagccagcatcagctgttcngganataaagtgggataatatgttcgtgtgtctcanaancacgcgacgcgtccgtcgtcgtcgtagtactactactacacgaagtaacgtaacggcgacccgtacaggtacgtcctcgacgcgtacttcgtcgtacggtacctacctaaccgtacgtacggtaacgaaccgtacgaccgaccttacgtaccgaacctacgttacgaacccgggaccggggaccccctaggtaacgtatttaggggactaacgtacgggtacgttactaaaccgtttaactttaccggttcgggtcgaaccgggtacccggggtacgggtaaacgaagaccgtaacctcccggttaggtttcgggggttaaaccgtcccgggggacggggtaacccggggtacctaagggcccggtttcggtaaacccccgggtccccgtttaaagggcgggtaaaccccgaacccccgggtaagggccccgtttccccccggcccccggttacccgg

SEQ ID NO: 30933 - DNA, 721 bp, Homo sapiens
  misc_feature: GYAE6OF01BRN7D.52.4.A04.1.454.CMB.1.raw
  modified_base (131)..(131): a, c, t, g, unknown or other
  misc_feature (131)..(131): n is a, c, g, or t
  modified_base (170)..(170): a, c, t, g, unknown or other
  misc_feature (170)..(170): n is a, c, g, or t
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
tcagcgcagtacgacacgaccggtgctcgatttagagtagtgatcaggggctgggcctcaggaagcagcatcggaggtgcctcagccatggcatggacttccctcttcttccgtcggcgtccttgcttacngcagaggatgtgtcgcctctagtgaggtgactcagaccnccgtcagtcgtccgtcctcccgaggacagacacgccagcatcagtcttgttcaggtaanaataaagngggagaattaaattcttcgtttacgtagtactcgacaggaacgccgaggcctagtccgtccgtgttccgtgactactctagtaccgaacgtaagtaacggacgcccggtaccttacggacggtacttcccggagacgtgtactttcacggtccgcctaaccgtaacgttcgacggaaaccnccgtacncccgttaactccgtacaaccgtacggtcgacggggtacccgaaccggtaggaccgttaggtacgggacgttagggacgtcgtaaggtaacctttagttacggtacgtacgtaccgggtaccgggtagggaaccgacgtacggtacccgtttaccgtagggttttccgggaccgggttcccgggggaaccggggtacggacccgggttagggttacccgtccccggtaacccgggttccgacccgttaccggacccgggaccccggtaacggttccccggtaccccccggttcccgg

SEQ ID NO: 30934 - DNA, 591 bp, Homo sapiens
  misc_feature: GYAE6OF01E0J72.52.4.A04.1.454.CMB.1.raw
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
  modified_base (282)..(282): a, c, t, g, unknown or other
  misc_feature (282)..(282): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcaggtgtccgtctccccaggacagacagccagcatcagctgtctgganataaaatggaggaataaatntgtttcctgtatcgcagaancagccagtcgctgtctgtcatctancacgataaagagcggccctgagggactccgtagagtcgtattctcgtgcctaccaactcgtacggaaccactacgcccactctacgaccatcgacggaccggaaccgacgcgtaacgtggtaacgtaggtacgcgtacgtaacgttactttacgtcgaccgtacggaccgggtagggaaccgaaggaacgtaccgtacgttcgtgggttacggttcgggaccgggtacggggaaccgtacgggccgtaccggtacccgtaccgtacggtacccgaacggaccccgacgggtccgtcccgggtacccccg

SEQ ID NO: 30935 - DNA, 800 bp, Homo sapiens
  misc_feature: GYAE6OF01A6SSE.52.4.A04.1.454.CMB.1.raw
  modified_base (79)..(79): a, c, t, g, unknown or other
  misc_feature (79)..(79): n is a, c, g, or t
  modified_base (172)..(172): a, c, t, g, unknown or other
  misc_feature (172)..(172): n is a, c, g, or t
tcagcgcagtacgacacgaccggtgctcgatttagagtagtgatcaggggctgggcctcaggaagcagcatcggaggtncctcagccatggcatggatccctctccttccgtcggcgtccttgacttactgcacaggatgtgtggcctcctagtgagtgactcagcaccgtnagtcgtccgtcctacccgaggcagtcacgccagcatcagtctgttctagaagtaataaagtggaaagtactaaagttgtacgtttccgtagttactcgacctaaggaccgccgacggccgtaggtccgtaccgttggtcccgttagggttacctagttaccgtaactaccgtaacggtaaacgtaaaaccgggtaaaccggtccccgggtacccgttaaccggtacggggtaacccgtttaccccgaacgggtaaccggttaccgttaccgttcccggttaccggttaccggttaccctaacccgtaaccgttaccgggttaacgggaacccaaacggtaccggtaccctaaccgtttcgaaccgggttaaccctaacgttaccggaaccggggacccccgggtaaccacgggtaacgtacggttacgggtaaccggtacggtaaccggttaacgtacgtttaacgtttacccgtttaacggtccgtaaccgggtaccggttaaccgggacgggtaacccgtaggtaacccgcgttaccgtggtaacgggttcggtaccgggtacggacggacgtcgtacgtcccgggtctacggtacgacgtacgacgtacggccctacgtccccgg

SEQ ID NO: 30936 - DNA, 757 bp, Homo sapiens
  misc_feature: GYAE6OF01BU8JL.52.4.A04.1.454.CMB.1.raw
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacgaggatgtgtcggccttcctatgaggtgactcagaccaccgtcagtcgtccgtcctcccgaggacagacagccagcatcgagtctgtcgngganaataaagtggaagtataatagttcgttccgtaggtactcgaccaagaacgccgaggccagtccgcctgtccgtagtcatcttatacgacgtaataacgacggccgaccctacgaacgggtacctccgtaggccgtacgtaacgttccgttcacgggtccctaaccgtaacgttaccggtacgggaaaacctccgaaccggtacccaaccgttccgtaaccgaccctaacgtaccggaccggggacccccgggtaaacccgacgggtaccttacgggtacgggtacgtaacgggaccgtcgtaacggtaaccgtttaacgttaccggtcggttaacggaccggttacccggggttaacgggaacgtaaccggaacggttaccctacggttaccggttgggggttaccggttccggggaccggggtaacgggtacccggtaaggggtcccgttaccgggtacccgttacccgggtacggggtacccgtaacccgggacccgggttaccggtccccgtcccccggtaccccccgg

SEQ ID NO: 30937 - DNA, 778 bp, Homo sapiens
  misc_feature: GYAE6OF01CCVSU.52.4.A04.1.454.CMB.1.raw
  modified_base (170)..(170): a, c, t, g, unknown or other
  misc_feature (170)..(170): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtnagtgtccgtctccccaggacagacagccagcatcagtctgttcgtggagtaataaaagtggagtaaataaattattgtttccgtaggttactccgaccgaagaacgccgaacggccacgtccgccttcgtcccgtgggtaccattaccgtaataccgaacgaagtaaacggaacggcccggtaccccttacggaccggggtacctccccgtaggacgtacgtaacgttccgtcgtcggtaccctaacccgtaacgttacggtacggaaacctaccgaacggaccctaccgttccgtaacccgaccctaacggtacccgaaccgggaccccgggtaacccgaacgggtacttaacgggtgggtaacgtcgggtaaccggtccttaacggtaaccttaacggtttaaccgtcgggtaaccgtaacgggttcccgggtaacgggaaccgtaacggaaacgtccgttaccggttacggttcgggttacgggtaccgggaaccggggtaacgggtcccgtacgggttcccgtaccggacccgggtttacccggtaaccgggttaccgaaccccggttaccccgacgggttaccccgtccccggtaccccccgg

SEQ ID NO: 30938 - DNA, 208 bp, Homo sapiens
  misc_feature: GYAE6OF02JDPRL.52.4.A04.1.454.CMB.1.raw
  modified_base (206)..(208): a, c, t, g, unknown or other
  misc_feature (206)..(208): n is a, c, g, or t
tcagcgcagtacgacacgaccggtgctcgatttagagtagtgatcagggagagctgctcagttaggacccagagggaaccatggaaacccagcgcagcttctcttcctcctgctactctggctcccaggaactgtggctgcaccatctgtcttcatcttcccgccatctatatacgatcgctgagcgggctggcaaggcgcatagnnn

SEQ ID NO: 30939 - DNA, 223 bp, Homo sapiens
  misc_feature: GYAE6OF02FWYSZ.52.4.A04.1.454.CMB.1.raw
  modified_base (208)..(223): a, c, t, g, unknown or other
  misc_feature (208)..(223): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctccaggaactgtggctgcaccatctgtcttcatcttcccgccatctgatatacgatcgctgagcgggctggcaaggcgcatagnnnnnnnnnnnnnnnn

SEQ ID NO: 30940 - DNA, 210 bp, Homo sapiens; identical to SEQ ID NO: 30908
  misc_feature: GYAE6OF02FT4F9.52.4.A04.1.454.CMB.1.raw
  modified_base (209)..(210): a, c, t, g, unknown or other
  misc_feature (209)..(210): n is a, c, g, or t

SEQ ID NO: 30941 - DNA, 209 bp, Homo sapiens; identical to SEQ ID NO: 30906
  misc_feature: GYAE6OF02GJPZY.52.4.A04.1.454.CMB.1.raw
  modified_base (208)..(209): a, c, t, g, unknown or other
  misc_feature (208)..(209): n is a, c, g, or t

SEQ ID NO: 30942 - DNA, 262 bp, Homo sapiens
  misc_feature: GYAE6OF02G6Y85.52.4.A04.1.454.CMB.1.raw
  modified_base (217)..(262): a, c, t, g, unknown or other
  misc_feature (217)..(262): n is a, c, g, or t
tcagcgcagtacgacacgaccggtgctcgatttagagtagtgatcagggggtaggagctgctcacgttaggacccaggagggaaccatggaaaccccaggcgcagcgttcctcttcctcctgctacgtctggctcccaggaactgtggctgcaccatctgtcttcatcttcccgcatctgatatacgatcgctgagcgggctggcaaggcgcatagnnnnnnnnnnnnnnnnnnnnnnnnnnnnnnnnnnnnnnnnnnnnnn

SEQ ID NO: 30943 - DNA, 210 bp, Homo sapiens; identical to SEQ ID NO: 30908
  misc_feature: GYAE6OF02HF5R5.52.4.A04.1.454.CMB.1.raw
  modified_base (209)..(210): a, c, t, g, unknown or other
  misc_feature (209)..(210): n is a, c, g, or t

SEQ ID NO: 30944 - DNA, 243 bp, Homo sapiens
  misc_feature: GYAE6OF02IW8B4.52.4.A04.1.454.CMB.1.raw
  modified_base (218)..(243): a, c, t, g, unknown or other
  misc_feature (218)..(243): n is a, c, g, or t
tcagcgcagtacgacacgaccggtgctcgatttagagtagtgatcagggggtaggagctgcctcagttaggacccagagggaaccatgggaaaccccagcgcgacgcttctcttcctcctggctactctggctcccaggaactgtcggctgcaccatctgtcttcatcttcccgcatctgatactacgatcgctgagcgggctggcaaggcgcatagnnnnnnnnnnnnnnnnnnnnnnnnnn

SEQ ID NO: 30945 - DNA, 219 bp, Homo sapiens
  misc_feature: GYAE6OF02GAWTS.52.4.A04.1.454.CMB.1.raw
  modified_base (210)..(219): a, c, t, g, unknown or other
  misc_feature (210)..(219): n is a, c, g, or t
tcagcgcagtacgacacgaccggtgctcgatttagagtagtgatcagggagagctgctccagttaggacccagagggaaccatggaaaccccagcgcagcttctcttcctcctgctactctggctcccaggaactgtggctgcaccatctgtcttcatcttcccgccatctgatatacgatcgctgagcgggctggcaaggcgcagtagnnnnnnnnnn

SEQ ID NO: 30946 - DNA, 212 bp, Homo sapiens
  misc_feature: GYAE6OF02JFPKY.52.4.A04.1.454.CMB.1.raw
  modified_base (209)..(212): a, c, t, g, unknown or other
  misc_feature (209)..(212): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctcccaggaactgtggctgcaccatctgtcttcatcttcccgccatctgatatacgatcgctgagcgggctggcaaggcgcatagnnnn

SEQ ID NO: 30947 - DNA, 213 bp, Homo sapiens; identical to SEQ ID NO: 30929
  misc_feature: GYAE6OF02IU2VV.52.4.A04.1.454.CMB.1.raw
  modified_base (209)..(213): a, c, t, g, unknown or other
  misc_feature (209)..(213): n is a, c, g, or t

SEQ ID NO: 30948 - DNA, 213 bp, Homo sapiens; identical to SEQ ID NO: 30929
  misc_feature: GYAE6OF02GYEXA.52.4.A04.1.454.CMB.1.raw
  modified_base (209)..(213): a, c, t, g, unknown or other
  misc_feature (209)..(213): n is a, c, g, or t

SEQ ID NO: 30949 - DNA, 209 bp, Homo sapiens
  misc_feature: GYAE6OF02GZI0H.52.4.A04.1.454.CMB.1.raw
  modified_base (209)..(209): a, c, t, g, unknown or other
  misc_feature (209)..(209): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctcccaggaactgtggctgcaccatctgtcttcatcttcccgccatctgatatacgatcgctgagcgggctggcaaggcgcatagn

SEQ ID NO: 30950 - DNA, 212 bp, Homo sapiens; identical to SEQ ID NO: 30946
  misc_feature: GYAE6OF02JBXO8.52.4.A04.1.454.CMB.1.raw
  modified_base (209)..(212): a, c, t, g, unknown or other
  misc_feature (209)..(212): n is a, c, g, or t

SEQ ID NO: 30951 - DNA, 211 bp, Homo sapiens; identical to SEQ ID NO: 30905
  misc_feature: GYAE6OF02HASCL.52.4.A04.1.454.CMB.1.raw
  modified_base (209)..(211): a, c, t, g, unknown or other
  misc_feature (209)..(211): n is a, c, g, or t

SEQ ID NO: 30952 - DNA, 211 bp, Homo sapiens; identical to SEQ ID NO: 30905
  misc_feature: GYAE6OF02GAUW1.52.4.A04.1.454.CMB.1.raw
  modified_base (209)..(211): a, c, t, g, unknown or other
  misc_feature (209)..(211): n is a, c, g, or t

SEQ ID NO: 30953 - DNA, 211 bp, Homo sapiens; identical to SEQ ID NO: 30905
  misc_feature: GYAE6OF02GOLM3.52.4.A04.1.454.CMB.1.raw
  modified_base (209)..(211): a, c, t, g, unknown or other
  misc_feature (209)..(211): n is a, c, g, or t

SEQ ID NO: 30954 - DNA, 211 bp, Homo sapiens; identical to SEQ ID NO: 30905
  misc_feature: GYAE6OF02FX4HU.52.4.A04.1.454.CMB.1.raw
  modified_base (209)..(211): a, c, t, g, unknown or other
  misc_feature (209)..(211): n is a, c, g, or t

SEQ ID NO: 30955 - DNA, 211 bp, Homo sapiens; identical to SEQ ID NO: 30905
  misc_feature: GYAE6OF02HRH14.52.4.A04.1.454.CMB.1.raw
  modified_base (209)..(211): a, c, t, g, unknown or other
  misc_feature (209)..(211): n is a, c, g, or t

SEQ ID NO: 30956 - DNA, 210 bp, Homo sapiens; identical to SEQ ID NO: 30908
  misc_feature: GYAE6OF02HW931.52.4.A04.1.454.CMB.1.raw
  modified_base (209)..(210): a, c, t, g, unknown or other
  misc_feature (209)..(210): n is a, c, g, or t

SEQ ID NO: 30957 - DNA, 494 bp, Homo sapiens
  misc_feature: GYAE6OF02FN71S.52.4.A04.1.454.CMB.1.raw
  modified_base (383)..(383): a, c, t, g, unknown or other
  misc_feature (383)..(383): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctanggatgaggctgactattactgtcagccgtgggacagaagcactcgtggtgttcggcggagggaccaggctaggaccgtcgtaggtccacgcccgaaggtcctcgtcccccg

SEQ ID NO: 30958 - DNA, 213 bp, Homo sapiens; identical to SEQ ID NO: 30929
  misc_feature: GYAE6OF02IEN4X.52.4.A04.1.454.CMB.1.raw
  modified_base (209)..(213): a, c, t, g, unknown or other
  misc_feature (209)..(213): n is a, c, g, or t

SEQ ID NO: 30959 - DNA, 213 bp, Homo sapiens; identical to SEQ ID NO: 30929
  misc_feature: GYAE6OF02IU88B.52.4.A04.1.454.CMB.1.raw
  modified_base (209)..(213): a, c, t, g, unknown or other
  misc_feature (209)..(213): n is a, c, g, or t

SEQ ID NO: 30960 - DNA, 210 bp, Homo sapiens
  misc_feature: GYAE6OF02JF3C7.52.4.A04.1.454.CMB.1.raw
  modified_base (206)..(210): a, c, t, g, unknown or other
  misc_feature (206)..(210): n is a, c, g, or t
tcagcgcagtacgacacgaccggtgctcgatttagagtagtgatcaggggagatctgctcagttaggacccagagggaaccatggaaaccccagcgcagcttctcttcctcctgctactctggctccaggactgtggctgcaccatctgtcttcatcttcccgcatctgatatacgatcgctgagcgggctggcaaggcgcatagnnnnn

SEQ ID NO: 30961 - DNA, 214 bp, Homo sapiens; identical to SEQ ID NO: 30914
  misc_feature: GYAE6OF02GMS0T.52.4.A04.1.454.CMB.1.raw
  modified_base (210)..(214): a, c, t, g, unknown or other
  misc_feature (210)..(214): n is a, c, g, or t

SEQ ID NO: 30962 - DNA, 633 bp, Homo sapiens
  misc_feature: GYAE6OF02GFIKH.52.4.A04.1.454.CMB.1.raw
  modified_base (284)..(284): a, c, t, g, unknown or other
  misc_feature (284)..(284): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggaagaataaaagtgggaaggaataaaattattgtttcctaggtatcgccaagaacgccgaaggccagtcncctgtcctggtcatctatcacgataagagcggacctcgaggactcccgtgacgcgtacttccgtcgtcggcctaccgaactcgtacgggaaccacgacgcccactctacgaccctagtaccgacggccgggacccagggaccttaaggtcggtaagtcggaggtaccgtagtacttaacgttacgtacgtacgtacgtccgggtagggaaccgtaacggaacgaccgtacgttacgttcggggtcggttacggggaccgggaacggggtacccgagggtaccgtaccgtaacccggtacccgttacgggaccgtaaccggacccgaacgggtccctccggtaccccccg

SEQ ID NO: 30963 - DNA, 213 bp, Homo sapiens
  misc_feature: GYAE6OF02IH61Y.52.4.A04.1.454.CMB.1.raw
  modified_base (93)..(93): a, c, t, g, unknown or other
  misc_feature (93)..(93): n is a, c, g, or t
  modified_base (164)..(164): a, c, t, g, unknown or other
  misc_feature (164)..(164): n is a, c, g, or t
  modified_base (201)..(201): a, c, t, g, unknown or other
  misc_feature (201)..(201): n is a, c, g, or t
  modified_base (207)..(213): a, c, t, g, unknown or other
  misc_feature (207)..(213): n is a, c, g, or t
tcagcgcagtacgacacgaccggtgctcgatttagagtagtgatcaggggagagctgctcagttaggacccagagggaaccatggaaaccccngcgcagcttctcttcctcctgctactctggctcccaggaactgtgctgcaccatctgtcttcatcttcccncatctgatatacgatcgctgagcgggctggcaaggcncatagnnnnnnn

SEQ ID NO: 30964 - DNA, 633 bp, Homo sapiens
  misc_feature: GYAE6OF02GJN61.52.4.A04.1.454.CMB.1.raw
  modified_base (220)..(220): a, c, t, g, unknown or other
  misc_feature (220)..(220): n is a, c, g, or t
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
  modified_base (367)..(367): a, c, t, g, unknown or other
  misc_feature (367)..(367): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtcctccccaggacagacacgccagcatcagcttgtctgganaataaaatggaagaataaatattgtttcctggtactcgaccagaacgccaggccagtcgcctgtccgtggtcatctancaacganaagaacgccggcctagaggtctccgtgagctattctcgtgcctcctaacgtcgaggaaaccncgtacgccctactcgtacgaacctactacgaacgggccgggtaacccgagggtccttaacggtcgggaagttccggggaacggtcgttaacggtaactttacgttaccgtcggttaaccgacgggtacccgggtagggaacctaaaggaccgtaccgtacgttcggttcggtacggggtccggacgggacgggtaccgagggtccgtaccggccgttaccgtacgggaccgtaccggacccgtacggtccctaccccggtccccgg

SEQ ID NO: 30965 - DNA, 223 bp, Homo sapiens
  misc_feature: GYAE6OF02I49HM.52.4.A04.1.454.CMB.1.raw
  modified_base (179)..(179): a, c, t, g, unknown or other
  misc_feature (179)..(179): n is a, c, g, or t
  modified_base (208)..(223): a, c, t, g, unknown or other
  misc_feature (208)..(223): n is a, c, g, or t
tcagcgcagtacgacacgaccggtgctcgatttagagtagtgatcagggggagagctgctcagttaggacccagagggaaccatggaaaccccagcgcagcttctcttcctcctgctactctggctcccaggaactgtggctgcaccatctgcttcatcttcccgcatctgatatacgntcgctgagcgggctggcaaggcgcatagnnnnnnnnnnnnnnnn

SEQ ID NO: 30966 - DNA, 562 bp, Homo sapiens
  misc_feature: GYAE6OF02GAML3.52.4.A04.1.454.CMB.1.raw
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (295)..(295): a, c, t, g, unknown or other
  misc_feature (295)..(295): n is a, c, g, or t
  modified_base (322)..(322): a, c, t, g, unknown or other
  misc_feature (322)..(322): n is a, c, g, or t
  modified_base (334)..(334): a, c, t, g, unknown or other
  misc_feature (334)..(334): n is a, c, g, or t
  modified_base (367)..(367): a, c, t, g, unknown or other
  misc_feature (367)..(367): n is a, c, g, or t
  modified_base (403)..(403): a, c, t, g, unknown or other
  misc_feature (403)..(403): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtcccgtctccccaggacagacagccagcatcagctgttcngganataaaatgggaagataaatattgtttcctggtatcgaccagaacgccaggcccagtcgcctgtccgtggtcatctancacgatagaagccgctcgaggctccgngagcgtacttcnctggctaccactcgtaggaaccacacgcctacncgtacgaccagtcgacggaccggtaccaggactagnggaatcggaggtctagaccttagtactagtcaggtacccgtaggaactacgaacgtccaacgttgggtacgttggttaccgggacgggtaacgggaccgtcggtcgtaccggtacccgtcgtacgggcaaccggtcccgaaggtccgttcccgaccccg

SEQ ID NO: 30967 - DNA, 794 bp, Homo sapiens
  misc_feature: GYAE6OF02G61S2.52.4.A04.1.454.CMB.1.raw
tcagcgcagtacgacacgaccggtgctcgatttagagtagtgatcaggggctgggcctcaggaagcagcatcggaggtgcctcagccatggcatggatccctctcttcctcggcgttccttgcttactgcacaggatgtgtgcctcctatgaggtgactcagacaccgtcagtgtccgtcctcccaggacagacagccagcactcagtcttgttcgtaggataataaagtggaagtataaatgttgtttccgaggtactcgaccagtaacgcccgaggccacggtccgccttaggtccccttggtccaattccttaagtaccgaaccgaataaaaccgggacggcccggtaccccgttaggaacgggtacttccccggagacgtaccgtaatttccgtaccgttcgggtccctaacccgtaacgtttccggaaaccgggaaaccctacggtaaccgaccctacgttccgttaaccggaaccctacttacccggacgtacccggggaaccctaagggtcccttaaggccgggtaacggtacgtacggtaccgttaacggttacctttaaaggttccggtacgttaaccgtcgggttaccgggtagaaccggtaacgaaaccggttccgttaacgttaccgggtttagggtacccgggggtttacggaccggggtaaaccggggccctttaacggggacccgggtttaaccggtaccccgggtttaccggttaaccggtcccgggtaacccgtaaccccggggttacgggtacccttccccgggttaccccccggg

SEQ ID NO: 30968 - DNA, 218 bp, Homo sapiens
  misc_feature: GYAE6OF02GCB8W.52.4.A04.1.454.CMB.1.raw
  modified_base (212)..(218): a, c, t, g, unknown or other
  misc_feature (212)..(218): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctcccaggaactggtggctgcaccatctgtcttcatccttcccgccatctgatatacgatcgctgagcgggctgggcaaggcgcatagnnnnnnn

SEQ ID NO: 30969 - DNA, 759 bp, Homo sapiens
  misc_feature: GYAE6OF02JA1PI.52.4.A04.1.454.CMB.1.raw
  modified_base (221)..(221): a, c, t, g, unknown or other
  misc_feature (221)..(221): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagaccaccgtcagtcgtccgtcctcccaggacagacagccagcatcacgtctgttctggaanaagtaaaagtgggaagtaataaaagttnttgttttaccgnggttactccgaccaaggaacgccgaggacctaggtccgccttacggtccgtggtcacttctatccgaacgtaataacggaacgtccggaccctggacgggtactcccgtggacgtcgtacttccgtcgtcggaccttaccgaacgttccggtaacgggaaacctaccgaccgtaccctaccgttacctaaccggaaccctaaggtcccggtaaccgggtacccgggtaaccccgacggtaccttaacgggtacgtaacggtagggtacggttcccgttaaagtacccgtttaacgtttacgttccggtacgaccgggttaccgggtacgggaacgtaacggtaccgtaccttacccggttaggtttcgggttaccgggttaccgggacggggtaaccgggtacccgggtaccgttaccgggtaaccgttacccgggttaccgaacggttcccggaaacccgtaccgggcccggtacccggttaccccggtcccccggg

SEQ ID NO: 30970 - DNA, 229 bp, Homo sapiens
  misc_feature: GYAE6OF02HMFH8.52.4.A04.1.454.CMB.1.raw
  modified_base (204)..(204): a, c, t, g, unknown or other
  misc_feature (204)..(204): n is a, c, g, or t
  modified_base (210)..(229): a, c, t, g, unknown or other
  misc_feature (210)..(229): n is a, c, g, or t
tcagcgcagtacgacacgaccggtgctcgatttagagtagtgatcaggggagagctgctcagttaggaccagagggaaccatggaaaccccagcgcagcttctcttcctcctgctactctggctcccaggaactgtggctgcaccatctgtcttcatcttcccgctatctagatatacgatcgctgagcgggctggccaaggcncatagnnnnnnnnnnnnnnnnnnnn

SEQ ID NO: 30971 - DNA, 208 bp, Homo sapiens
  misc_feature: GYAE6OF02I1HD4.52.4.A04.1.454.CMB.1.raw
  modified_base (198)..(198): a, c, t, g, unknown or other
  misc_feature (198)..(198): n is a, c, g, or t
  modified_base (203)..(208): a, c, t, g, unknown or other
  misc_feature (203)..(208): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctcccaggactgtgctgcacatctgtcttcatcctcccgcatctgatatacgatcgctgagcggctggcaaggcncatgnnnnnn

SEQ ID NO: 30972 - DNA, 239 bp, Homo sapiens
  misc_feature: GYAE6OF02FQJF2.52.4.A04.1.454.CMB.1.raw
  modified_base (214)..(239): a, c, t, g, unknown or other
  misc_feature (214)..(239): n is a, c, g, or t
tcagcgcagtacgacacgaccggtgctcgatttagagtagtgatcagggggagagctgctcagttaggacccagagggaaccatgggaaaccccagcgcagcttctcttcctcctgctactctggcctcccaggaactgtggctgcaccatctgtcttcattcttcccgccatctgatatacgatcgctgagcgggctgggcaaggcgcatagnnnnnnnnnnnnnnnnnnnnnnnnnn

SEQ ID NO: 30973 - DNA, 700 bp, Homo sapiens
  misc_feature: GYAE6OF02HW3X2.52.4.A04.1.454.CMB.1.raw
  modified_base (175)..(175): a, c, t, g, unknown or other
  misc_feature (175)..(175): n is a, c, g, or t
  modified_base (279)..(279): a, c, t, g, unknown or other
  misc_feature (279)..(279): n is a, c, g, or t
  modified_base (396)..(396): a, c, t, g, unknown or other
  misc_feature (396)..(396): n is a, c, g, or t
  modified_base (632)..(632): a, c, t, g, unknown or other
  misc_feature (632)..(632): n is a, c, g, or t
tcagcgcagtacgacacgaccggtgctcgatttagagtagtgatcaggggctgggcctcaggaagcagcatcggaggtgcctcagccatggcagtggatccctctccttcctcggcgtccttgcttactgcacaggatgtgtggccttcctatggaggtcgactcagacaccgtnagtcgtccgtcacccgagacagacacgccagcatccgagcttagttcgtaggacgtaaattaaagtcggggaaggtaataaattagtttcgtttccgtagtacnccgaactaacggaacgccgaaggccgacgtaccgccttcgtcgtaggttaccagtttcctaactccggtaagaaacgtaacggaacgggcccggttcccctaaggtaacgggtaccncccgtaaggtaccgacgtttaccgttctacgttcggacccttaccgaacgttccgggtaaggaaaccctcgtacccgaccttacgtcctacgtaactcgacggtacgggaccggtacccgaggtacctaggtggtacgagacgtacgtacgtacgttatcggtgaccgtgggtaccgtagggaccaaggtactaccgagtacggttcggtacggggtcccggaggaccggggaacncgggtccgtaccgttaccgggttacccgtggtaccgaccgtacccggtacggccctccggtaccccgg

SEQ ID NO: 30974 - DNA, 211 bp, Homo sapiens
  misc_feature: GYAE6OF02F2XEC.52.4.A04.1.454.CMB.1.raw
  modified_base (202)..(202): a, c, t, g, unknown or other
  misc_feature (202)..(202): n is a, c, g, or t
  modified_base (206)..(211): a, c, t, g, unknown or other
  misc_feature (206)..(211): n is a, c, g, or t
tcagcgcagtacgacacgaccggtgctcgatttagagtagtgatcaggggagagctgctcagttaggacccagagggaaccatggaaaccccagcgcagcttctcttcctcctgctactctggctcccaggaactgtggctgcaccatctgtcttcatcttcccgcatcgtgatatacgatcgctgagcggctggcaaggcnatgnnnnnn

SEQ ID NO: 30975 - DNA, 256 bp, Homo sapiens
  misc_feature: GYAE6OF01EGY87.23.66.F11.1.454.CMB.1.raw
  modified_base (255)..(256): a, c, t, g, unknown or other
  misc_feature (255)..(256): n is a, c, g, or t
tcagacgcgagtatcacgaccggtgctcgatttagtcacgcgagaaggggtagtgaggtttcgattatgggcgatccgtttgactactggggacagggaaccctggtcaccgtctcctcagcctccaccaagggcccatcggtcttcccctggcgccctgctccaggagcacctccgagagcacagcggccctgggctgcctggtcaaggactacttccatactcgcgtctgagcgggctggcaaggcgcatagnn

SEQ ID NO: 30976 - DNA, 256 bp, Homo sapiens; identical to SEQ ID NO: 30975
  misc_feature: GYAE6OF01A9EFF.23.66.F11.1.454.CMB.1.raw
  modified_base (255)..(256): a, c, t, g, unknown or other
  misc_feature (255)..(256): n is a, c, g, or t

SEQ ID NO: 30977 - DNA, 361 bp, Homo sapiens
  misc_feature: GYAE6OF01DYN3E.23.66.F11.1.454.CMB.1.raw
  modified_base (313)..(361): a, c, t, g, unknown or other
  misc_feature (313)..(361): n is a, c, g, or t
tcagacgcgagtatcacgaccggtgctcgatttagtcacgcgagaaggggtagtgaggtttcgattatgggcgatccgtttgactactggggacagggaaccctggtcaccgtctcctcagcctccaaccaagggccccatcggtccttccccctggccgccctgctccaggacgccaccctccgagacgcaacgaggtccggccccgtggggccttacgccgttagggtacaaagggtaccttaaccttccatacctccggccgttcgtggacggccggggtctacgggacgaacggtccgacctaagtagnnnnnnnnnnnnnnnnnnnnnnnnnnnnnnnnnnnnnnnnnnnnnnnnn

SEQ ID NO: 30978 - DNA, 261 bp, Homo sapiens
  misc_feature: GYAE6OF02IS8FH.23.66.F11.1.454.CMB.1.raw
  modified_base (254)..(261): a, c, t, g, unknown or other
  misc_feature (254)..(261): n is a, c, g, or t
tcagacgcgagtatcacgaccggtgctcgatttagtcacgcgagaagggtagtgaggtttcgattatgggcgatccgtttgactactggggacagggaaccctggtcaccgtctcctcagcctccaccaagggcccatcggtcttcccctggcgccctgctccaggagcacctccgagagcacagcggccctgggctgcctggtcaaggctacttccatacgtcgcgtctgagcgggctggcaaggcgcatagnnnnnnnn

SEQ ID NO: 30979 - DNA, 217 bp, Homo sapiens
  misc_feature: GYAE6OF02I01UO.23.66.F11.1.454.CMB.1.raw
  modified_base (206)..(217): a, c, t, g, unknown or other
  misc_feature (206)..(217): n is a, c, g, or t
tcagacgcgagtatcacgaccggtgctcgatttagtcacgcgagaaggggtagtgaggtttcgattatgggcgatccgtttgactactggggacagggaaccctggtcaccgtctcctcagcctccaccaagggcccatcggtcttccccctggcgccctgctccaggagcacctccgagagcacagcggccctgggctgcctgtnnnnnnnnnnnn

SEQ ID NO: 30980 - DNA, 273 bp, Homo sapiens
  misc_feature: GYAE6OF02I6VJK.23.66.F11.1.454.CMB.1.raw
  modified_base (255)..(273): a, c, t, g, unknown or other
  misc_feature (255)..(273): n is a, c, g, or t
tcagacgcgagtatcacgaccggtgctcgatttagtcacgcgagaaggggtagtgaggtttcgattatgggcgatccgtttgactactggggacagggaaccctggtcaccgtctcctcagcctccaccaagggcccatcggtcttcccctggcgccctgctccaggagcacctccgagagcacagcggccctgggctgcctggtcaaggactacttccatactcgcgtctgagcgggctggcaaggcgcatagnnnnnnnnnnnnnnnnnnn

SEQ ID NO: 30981 - DNA, 543 bp, Homo sapiens
  misc_feature: GYAE6OF01CKY91.41.78.H01.1.454.CMB.1.raw
  modified_base (490)..(490): a, c, t, g, unknown or other
  misc_feature (490)..(490): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttccgccagattccagggaaggcgctggaatgggtctcagttatttataccgctggaacaccttctactcagactccgtggagggccgattcatcatctccagagacgtcgaccaataatatgttgtatcttgacatgaactaacttgagagccgacgacacggccctagtattattgtgcgagggctggttgngggaggacggcccacgggcccctgggcctacggtcgggggcccgggtaacccg

SEQ ID NO: 30982 - DNA, 598 bp, Homo sapiens
  misc_feature: GYAE6OF01CW1E1.41.78.H01.1.454.CMB.1.raw
tcagtctatactatcacgaccggtgctcgatttagtgtgagtagtttgggtttggggggagaggagcccagcactgggactccgaggtgtttccattcggtgatcagcactgaacacagaggactcaccatggagttttggctgagcgtgtcggtttcctagttgctaattttaaaaggtgtccatgtgagatgtacctggtggagtctggaggcggcttgatccaggccggggggtccctgagactctcatgtgcagcctctggtttaagtgtcagtagacactacatgagctggttccgccagattccgagggaagcgctggaatgggtctcagttatttataccgctggaacaccttctactcagactcgtgagggccattcgatcatctccagacgacgtcgaccaataatatagttgtattcttagactatacgaataactttgaacgacgcccgaacggaccgaaccggtccccttaggttacttaagttgttcgcggaggggtccgtaaggtttggtacggggaggacgggccccgaccgggtcccccgtagggacccgttacggcgggggggtccccgggtaaaccccgg

SEQ ID NO: 30983 - DNA, 533 bp, Homo sapiens
  misc_feature: GYAE6OF01BDRQI.41.78.H01.1.454.CMB.1.raw
  modified_base (485)..(485): a, c, t, g, unknown or other
  misc_feature (485)..(485): n is a, c, g, or t
tcagtctatactatcacgaccggtgctcgatttagtgtgagtagtttgggtttggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctgagactctcatgtgcagcctctggtttaagtgtcagtagacactacatgagctggttccgccagattccagggaaggcgctggaatgggtctcagttatttataccgctgggaacaccttctactcagactccgtgagtggccgattcatcatctccagagacgtcgccaataatatgttgtatcttgacatgaacaacttgagagccgacgacacggccctgtattatgtgcgagggcaggttgngggaggaggcccgacgggcccctgggcctacggtgggggaccccgggg

SEQ ID NO: 30984 - DNA, 527 bp, Homo sapiens
  misc_feature: GYAE6OF01DSVUE.41.78.H01.1.454.CMB.1.raw
  modified_base (484)..(484): a, c, t, g, unknown or other
  misc_feature (484)..(484): n is a, c, g, or t
  modified_base (511)..(511): a, c, t, g, unknown or other
  misc_feature (511)..(511): n is a, c, g, or t
tcagtctatactatcacgaccggtgctcgatttagtgtgagtagtttgggtttggggggagaggagcccagcactgggactccgaggtgtttccattcggtgatcagcactgaacacagaggactcaccatggagttttggctgagctgcgttttccttgttgcttattttaaaaggtgtccactgtgagatgtacctggtggagtctggaggcggcttgatccgaggccgggggggtccctgagactctcatgtgcagcctctggtttaagtgtcagtagacactacatgagctggttccgccagattccagggaagcgctggaatgggtctcagtttattataccgctgggaacacttctactcagactcgtgagggccgattcatcatctccagagacgtcgaccaataatatgttgtatcttgactatgaacacttgagagcccgagacaccgcctgtattatgtgcgagggcaggttgnggaggacgccacggccctggcctacgnggggcccgggtacccg

SEQ ID NO: 30985 - DNA, 530 bp, Homo sapiens
  misc_feature: GYAE6OF01B2Y9C.41.78.H01.1.454.CMB.1.raw
  modified_base (487)..(487): a, c, t, g, unknown or other
  misc_feature (487)..(487): n is a, c, g, or t
tcagtctatactatcacgaccggtgctcgatttagtgtgagtagtttgggtttgggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccggggggtccctgagactctcatgtgcagcctctggtttaagtgtcagtagacactacatgagctggttccgccagattccagggaaggcgctggaatgggtctcagttatttataccgctgggaacaccttctactcagactccgtgaggggccgattcatcatctccagagacgtcgcccaataatatgttgtatcttgacatgaacaacttgagagccgacgacacggccctgtattattgtgcgagggcagttgtggnggaggccacgggcccctgggctacgtggggcccgggtaacccg

SEQ ID NO: 30986 - DNA, 623 bp, Homo sapiens
  misc_feature: GYAE6OF01DNR63.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgcttattttaaaaggtgtccactgtgagatgtacctggtggagtctggaggcggcttgatccagccggggggtccctgagactctcatgtgcagcctctggtttaagtgtcagtagacactacatgagctggttccgccagattccgagggaggcgctggaatgggtctcagtttattataccgctaggaacctacttctactcagactccggtgacggggcctagttcaatcatcctccagagaccgtcgacctaaataattattgtttgtattcttagactatacgaactaacgtttggaagacggacccgaacggtaccgaaccgggtccccttaggtattttagttggtcggtacgggaggggtcgtaaggtttgggtaggggacgggaacgggcccgaccccgggtccccgtagggtcccttaacgggtccggggggccccggggtaaaccccgg

SEQ ID NO: 30987 - DNA, 617 bp, Homo sapiens
  misc_feature: GYAE6OF01BSTCJ.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagcgtgcgtttccttgttgctatttaaaggtgtcactgtgagatgtacctggtggagtctggaggcggcttgatccgaggccgggggggtccctgagactctcatgtgcagcctctggtttaagtgtcagtagacactacatgagtctggttcccgccagacttccgagggaaggcgcgtggaatgggtctctaagtttatttaacgtaccgcgtacgggaactaccttctactcacgacctccggtggacgggtccgtattcagtcattcctccgagacgacgtcgactaaatatatgttagtattcttgactatacgaactaacttagagaacggcccgaacgaccgaccggtcccttagtactttagtggtggaccggagggtctagggttggtagggacgggacgggcccgaacccgggtcccccgtagggtacccgtacggggtccggggggccccgggtaacccgg

SEQ ID NO: 30988 - DNA, 605 bp, Homo sapiens
  misc_feature: GYAE6OF01BYWNH.41.78.H01.1.454.CMB.1.raw
  modified_base (264)..(264): a, c, t, g, unknown or other
  misc_feature (264)..(264): n is a, c, g, or t
  modified_base (532)..(532): a, c, t, g, unknown or other
  misc_feature (532)..(532): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggcccgggggggtccctgagactctcatgtgcagcctntggtttaagtgtcagtagacactacatgagctggttcccgccagattcccgaaggggaaggcgcgtgggaatggggtctctagttattttatacccgctagggaaccacctttctactcaagctccgtgacggggccattcatcatctccagacgacgtcgacccaaataactatcgtttgtaattcttagacattagaactaacttgaagagcccgaacgtaccgacggtccctgtaattattggtgcgaggggtctagggtttggnggggaaggacgggccccgaaccgggtccccgtagggccttaaccgggtcgggggaccccggggtaaaccccgg

SEQ ID NO: 30989 - DNA, 587 bp, Homo sapiens
  misc_feature: GYAE6OF01C4FLC.41.78.H01.1.454.CMB.1.raw
  modified_base (425)..(425): a, c, t, g, unknown or other
  misc_feature (425)..(425): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctgagactctcatgtgcagcctctggtttaagtgtcagtagacactacatgagctggttccgccagattccgagggaaggcgcgtggaatgggtctcagttatttataccgctggaactaccttctactcagactccgtagacgggccattcatcatctccagagacgtcgacctaataatatgttntatcttgactatagaactaacgttagaagtaacgacccggaacgaccgaccggtccccttagttacttattggtggcggtagggcgtaggttggtagggagggacgggcccgaccgggccccgttagggccgtacggtccgggggtcccggggtaaccccgg

SEQ ID NO: 30990 - DNA, 682 bp, Homo sapiens
  misc_feature: GYAE6OF01CTW3P.41.78.H01.1.454.CMB.1.raw
  modified_base (264)..(264): a, c, t, g, unknown or other
  misc_feature (264)..(264): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggcccgggggggtccctgagactctcatgtgcagcctntggtttaagtgtcagtagacactacatgagctggttccgccagattccgagggaagcgctggaatgggtctctagttatttactaccgctaggaaccacctttctacctcacgtacctccggtggacggggccgtagttctactctaactcctaccgagacggaaccgtccgaccctaaattaactaagttgtttagtattcttagacctatacgaaacctaacgttaggaacgaacggaccccggtaaccgtaaccgacccgggtacccctttagttaacttttagttggttcggaccgggtaggggtccgtagggtttgggtaggggacggggaaccgggccccgaacccggggtccccccgtaggggacccgttaacccggggtccgggggggccccccgggggttaaaccccgg

SEQ ID NO: 30991 - DNA, 565 bp, Homo sapiens
  misc_feature: GYAE6OF01DTDVW.41.78.H01.1.454.CMB.1.raw
  modified_base (264)..(264): a, c, t, g, unknown or other
  misc_feature (264)..(264): n is a, c, g, or t
  modified_base (426)..(426): a, c, t, g, unknown or other
  misc_feature (426)..(426): n is a, c, g, or t
  modified_base (510)..(510): a, c, t, g, unknown or other
  misc_feature (510)..(510): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgtttttccttgttgctattttaaaaggtgtccactgtgagatgtacctggtggagtctggaggcggcttgatccgaggccgggggggtccctgagactctcatgtgcagcctntggtttaagtgtcagtagacactacatgagctggttccgccagattccgagggaaggcgctggaatgggtctcagttatttataccgctggaactaccttctactcagactccgtgacggggccattcatcatctccagagacgtcgccaaataatatgttntatcttgacatagaacaacgttgaagacgacccgaacgaccgaccggcccttagttattagttgtgcggagggcgtaggttggngggaggacggccgaccgggtcccctgggcctacggtcgggggcccgggtaacccg

SEQ ID NO: 30992 - DNA, 680 bp, Homo sapiens
  misc_feature: GYAE6OF01CZTU1.41.78.H01.1.454.CMB.1.raw
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttaattttaaaaggtgtccactgtgagatgtacctggtggagtctggaggcggcttgatccgaggccgggggggtccctgagactctcatgtgcagtcctcgttaggtttaagtgtcagtagacactacntgagtctggttccncagattccgaagggtaacgcgcgtgggaagttcgggtctcgtaagtttaatttacgtaccgtcgtacgggaacctaccgttctaactcaacgtaccgtccggtaggacgggccgtaatttccgatcctactccgtaccgaggacgtaccgtaccgaacctaaaagttaattacgttggtttagtacttcttagactaagtacgaaactaaccgttagaagaacggtacccggaacgaaccgacccggtacccttaggtaactttagttggtagggaccgggagggtcctagggttggtagggcgggaccgggcccgaaccggcccccgtagggaccggttaccgggcggggggccccgggttaaccccgg

SEQ ID NO: 30993 - DNA, 975 bp, Homo sapiens
  misc_feature: GYAE6OF01DYY54.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagtatcgtacgtgggtggagtcgtagggacgggccggtcttgactccgacggggtcccggggggtcctggacgtactcctactagtgtcgacgacgtccttcggtttaggtttaaggtcgtacgtaagtaacgaacctactaactagtgacgtccgttccggttcccgaccgtagtacgttaccgggaaggggaacggccgtacggtagggtaacggttcgggttacctacgtttaaggttttaactttaaccggtaccggtacggttaaccggtaaacccttacccgtttaccgtaaccgtacgaacggttaacccggttccgggtacggggtacccgggggtaccgttaacgtttacctaacgttaccgtaaccgttcccgtaaccggtaacgggtaaccggttaccggtaacccggtaaacccttaaaaagtttaaacgtttaggtttacggttttacgtttaaccgttttacgttaacggtaaacttaacgttaaaccgtaaaaccgtttaacggtttaacgggaaacggtaacccgggtaacccgggtaaacccgtaaccccgggtaacccggttaccccgtttaaggtttaacgttttaacggttacgggttaccgggtaccggggtaacggggtacggtttaacggggtttaggggtaacgggggtaacgggggaccccggtaccccggggtacccccgggttaccccgggtaccggggttaaccccggttacccgggggggtaccccgggggggtaacccccggggttaacccccgggg

SEQ ID NO: 30994 - DNA, 737 bp, Homo sapiens
  misc_feature: GYAE6OF01D2XA0.41.78.H01.1.454.CMB.1.raw
tcagtctatactatcacgaccggtgctcgatttagtgtgagtagtttgggggtttggggggagagggagcccagcactgggactccgaggtgttccattcggtgatcgagcactgaacacagaggactcaccatggagtttggctggagcgtgtcgttttccttgttgctaattttaaaaggtgtccacctgtgagatgtacgtggtggagtcgtggaggcggtcttgatccgaggtccgggggggtaccctggacgactctcgtagtgtgctagccttcgttggtttaagtgtacagtacgacactaacatcgagctaggttccgactagagttccgagggaaggcgcgtggaagtgggtctgtagttatttacgtaccgtcgtacgggaaacctaccgtttactacgtacgaacggtaacccgttcccggtacggtaaccgggggtcccgttaaacgtttccgtaaacgttcccgtaacgttcccgtacccggaaaggtacgggtaaccggtccgtaaaccctaaaagttaacttagttagttttacgtaatttcgttagtaactaagttagaaactaacgttggaacggtacgaccggtaaccgacgtaaccggtcccttaggtattagttcggtagccggtaggtccgtaggttggagggtacggacgggacccgacccgggtcccccgtgggtacccgtaaccgggtcggggggtaccccgggtaaccccgg

SEQ ID NO: 30995 - DNA, 813 bp, Homo sapiens
  misc_feature: GYAE6OF01CYFPR.41.78.H01.1.454.CMB.1.raw
  modified_base (305)..(305): a, c, t, g, unknown or other
  misc_feature (305)..(305): n is a, c, g, or t
tcagtctatactatcacgaccggtgctcgatttagtgtgagtagtttgggtttggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccgggggggtccctgagactctcatgtgcagcctcgttggtttaagtgtcagtagacactacatgagtctggttcccnccgagacgttccgagggaacggcggacgtggaagttgggtctcgtaagttttacgtttaacgtaccggtcgtacgggtaaacctaccctttacgtaaccttcgtaacggtacccgttccgggttagggacgggggtcccgtaatttcccaattcctaacttcccgtaccgaaggtaaccggtacccggttaccggaacccctaaaattaacgttaacgtttaggtttacgttaactttaccgttacggaaacctagttacgtaaactaaccgtttaggaacggaaccggtacccgaaccggtaaccgaacccgggtcccctttaaggttacttttacggttggtacgggtacgggtaacggggtccgtaaagggtttggggtaacgggggtaacggggtacccggggaaccccgtaccccgggggttaccccccggttacgggggtaaccccgggttacccgggggttacccgggggggggtaccccccgggggttaaacccccgggg

SEQ ID NO: 30996 - DNA, 542 bp, Homo sapiens
  misc_feature: GYAE6OF01B6KC6.41.78.H01.1.454.CMB.1.raw
  modified_base (495)..(495): a, c, t, g, unknown or other
  misc_feature (495)..(495): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttccgccagattccgagggaaggcgcgtggaatggggtctcagttatttataccgctgggaaccacctttctactcacgactccggtgaggggccattcatcatctccagagacgtcgcaaataatatgttgtatcttgacatagaacaacttgagagccgacgacacgcctgtattatgtgcgagggcgagttgtggnggaggcccgacggcccctggcctacggtcgggggccgggtaaccccg

SEQ ID NO: 30997 - DNA, 685 bp, Homo sapiens
  misc_feature: GYAE6OF01B7A7U.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgctaattttaaaaggtgtccactgtgagatgtacctggtggagtctggaggcggcttgatccgaggcccgggggggtccctgagactctcatgtgcagcctctggtttaagtgtcagtagacactacatgagctggttccgccagattccgagggaagcgctggaatgggtctcgtagttatttactaccgcgttagggaacctaccctttactaccttcgtaagacctccggtacggacggggccctattcgatcaacttcctaccaggacgaccgtcgaccctaaataaacttagttagtttagttacttcttacgtaactaacgtacgtaaactaacgtttaggaacggacgacccggaaccgaccgacccggtcccttagttactttagttcggtggaccgggtaggggtaccgtagggtttgggtaaggggaacggggaccgggacccgacccggggtccccctaggggacccgttaccgggtcccggggggggaccccggggttaaacccccggg

SEQ ID NO: 30998 - DNA, 584 bp, Homo sapiens
  misc_feature: GYAE6OF01D2R77.41.78.H01.1.454.CMB.1.raw
  modified_base (510)..(510): a, c, t, g, unknown or other
  misc_feature (510)..(510): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccgggggggtccctgagactctcatgtgcagcctctggtttaagtgtcagtagacactacatgagctggttccgccagattccgagggaggcgctggaatgggtctctagtttatttacaccgcgtaggaacctaccgttctactcagacctccgtaggacggggcctattcatcatcctaccagacgacgtcgaccaataatatgtttgtattcgttgtactatagaactaacgttgaagacgaccggacgaccgaccgtcccgttgtatttagtgtcggnggaggtgacggttggtgggaggacggcccgaccggtccccgtggccgtaccgggtcggggcccggggtacccgg

SEQ ID NO: 30999 - DNA, 547 bp, Homo sapiens
  misc_feature: GYAE6OF01CDKLD.41.78.H01.1.454.CMB.1.raw
  modified_base (496)..(496): a, c, t, g, unknown or other
  misc_feature (496)..(496): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggcccgggggggtccctggagactctcatgtgcagcctctggtttaagtgtcagtagacactacatgagctggttccgccagattccagggaaggcgctggaatgggtctcagttatttataccgctgggaacaccttctactcagactccgtgaggggccattcatcatctccagagacgtcgccaaataatatgttgtattcttgacatagaactaacttgagagaccgacgacgacgccctgtattattgtgcggaggcacgttggnggaggagggcccacgggtcccctggacctcggtgggggccgggtaacccgg

SEQ ID NO: 31000 - DNA, 576 bp, Homo sapiens
  misc_feature: GYAE6OF01BW88L.41.78.H01.1.454.CMB.1.raw
  modified_base (264)..(264): a, c, t, g, unknown or other
  misc_feature (264)..(264): n is a, c, g, or t
  modified_base (359)..(359): a, c, t, g, unknown or other
  misc_feature (359)..(359): n is a, c, g, or t
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
  modified_base (522)..(522): a, c, t, g, unknown or other
  misc_feature (522)..(522): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctaattttaaaaggtgtccactgtgagatgtacctggtggagtctggaggcggcttgatccgaggccgggggggtccctgagactctcatgtgcagcctntggtttaagtgtcagtagacactacatgagctggttccgccagacttccgaggggaaggcgcgtggaatgggtctcgtagtttatttactaccgngtaggaacctaccttctactcagacctccgtggacggggcctattcatcatctcagagacgtcgaccaatatatgttntattcgtnacatagaactaacgttgaacgacgccgacgaccgaccggcccttagttacttagttgtgcggaggtcgtaggttggngggaggacggccaccgggcccgtggaccgtacggtcgggggcccgggtaacccg

SEQ ID NO: 31001 - DNA, 651 bp, Homo sapiens
  misc_feature: GYAE6OF01APYYU.41.78.H01.1.454.CMB.1.raw
  modified_base (273)..(273): a, c, t, g, unknown or other
  misc_feature (273)..(273): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccgggggggtccctgagactctcatgtgcagcctctggtttaagngtcagtagacactacatgagctggttcccgccagattccgagggaaggcgctggaatgggtctcgagttatttataccgctgggaactccttctactcagactccgtgagggcctatcatcatcctccagacgacgtcgaccctaaataactagttgttgtattcgttagactatagaactaacgtttagaacgacgtacccggaacgaccgaacccgggtccccttaggttatttaacgttgtacggaccggtaagggggccttagggtttgggtagggggtacgggaccgggaccccgtaacccggggtccccccgttcggggtacccgttaacccgggttccggggggggaccccccggggggttaaacccccgg

SEQ ID NO: 31002 - DNA, 574 bp, Homo sapiens
  misc_feature: GYAE6OF01BHFPQ.41.78.H01.1.454.CMB.1.raw
  modified_base (434)..(434): a, c, t, g, unknown or other
  misc_feature (434)..(434): n is a, c, g, or t
  modified_base (514)..(514): a, c, t, g, unknown or other
  misc_feature (514)..(514): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggcccgggggggtccctggagactctcatgtgcagcctctggtttaagtgtcagtagacactacatgagctggttccgccagacttccgaggggaaggcgcgtggaatgggtctcgagtttatttataccgctagggaacctaccttctactcacgactcggtgacggggcatcatcatctccagagacgtcgaccaatactatgttntatcttgacatcgaactacttgagacgaccgaacgacgaccggtccctagttattattggtggcggagggctaggttggngggagggaggcccgaccggtccccgtggaccgttacggcggggggcccgggtaaccccgg

SEQ ID NO: 31003 - DNA, 539 bp, Homo sapiens
  misc_feature: GYAE6OF01AYUSU.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctgagactctcatgtgcagcctctggtttaagtgtcagtagacactacatgagctggttccgccagattccagggaaggcgctggaatgggtctcagttatttataccgctgggaacaccttctactcagactccgtgaggggccgattcatcatctccagagacgtcgaccaataatatgttgtatcttgacatgaacaacttgagagccgacgacaccggccctgtattatgtgcgagggctgttgtggaggacggcccacgggcccctgggcctacgtgggggcccggggtaacccgg

SEQ ID NO: 31004 - DNA, 632 bp, Homo sapiens
  misc_feature: GYAE6OF01BA0VF.41.78.H01.1.454.CMB.1.raw
  modified_base (477)..(477): a, c, t, g, unknown or other
  misc_feature (477)..(477): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttaattttaaaaggtgtccactgtgagatgtacctggtggagtctggaggcggcttgatccgagggcccgggggggtccctggagactctcatgtgcagcctgtggtttaagtgtcagtagacactacagtgagtcttcggttccgccagtacttccgaaggggaaggcggcgtaggtaagtgggtctacgtagtttatttacgtaccgcgtacggaacctacctttctacgtcaacggtacctccggtggacggggcctattcatcatctcagacgtacgtcgactaaataactattgttgttatcttanactatacgaactaacttagagacgaccgaacggaccgtaccgtcccttagtacttagttcggtggacggtagggcgttaggttggtggggacggacgggccggaccggtccccgtacgggtaccgtacgggtccgggggccccgggtaacccggg

SEQ ID NO: 31005 - DNA, 775 bp, Homo sapiens
  misc_feature: GYAE6OF01B5MWD.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgttatttaaaaggttagtctactagtgagatgtaccgtggtggtaggtcgtggagggcggcgttgtagtccgacgggccgggggggtcccggttgacggtactcctcaatgtgcgacgtcctccgttaggtttaagtgtcagtaagacactacatgagcgtcggtccgccagacgttacgacgggaaggtcgcgtaggtagtgggtctctagtttattactaccgcgtacggaactaccttctactacagtaccgtccggtcgggacgggtccgtacgttactacgtactactcgttacccaaggacgtaccggtaccgacctaaacttaaagttaacgttagtttagttaacttcgttacgaactacttaaggaaactaacgttacggaacggaccggtaacccgaaccggaacccgtaccggtaccccgttagtttaacgttttaacgttcgggttaacggccggtaacgggggtaaccgtaggggtttacgggtagggggtacgggacccggggtacccggacccccgggtaccccgggtaccgggttacccggttaacccggggggtaccggggggtcccccggggggtaaacccggtttccccggg

SEQ ID NO: 31006 - DNA, 591 bp, Homo sapiens
  misc_feature: GYAE6OF01BZSYU.41.78.H01.1.454.CMB.1.raw
  modified_base (513)..(513): a, c, t, g, unknown or other
  misc_feature (513)..(513): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttccgccagattccgagggaaggcgcgtggaatgggtctctagttatttataccgctaggactaccttctactcagactccgtgacggggccattcatcactcctaccagagacgtcgaccaaataactattgttatattcttgacatagaactaattgagacgccgaacgacgaccgtccctagtatttacgtgtggcggtagggtctggtttggnggggagggaccgggcccgaacccgggtcccccgttaggggcccgttacgggtccggggggccccggggttaaccccgg

SEQ ID NO: 31007 - DNA, 593 bp, Homo sapiens
  misc_feature: GYAE6OF01EZLBN.41.78.H01.1.454.CMB.1.raw
  modified_base (314)..(314): a, c, t, g, unknown or other
  misc_feature (314)..(314): n is a, c, g, or t
  modified_base (544)..(544): a, c, t, g, unknown or other
  misc_feature (544)..(544): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgtttttccttgttgcttattttaaaaggtgtccactgtgagatgtacctggtggagtctggaggcggcttgatccgagggcccgggggggtccctggagacctctcatggtgcacgccttctgggtttaagtgtcagtagacactacatgagctggttcccncagattccgagggaaggcgcgtggaagtgggtcttctagtttattacgtaccgctagggaaccacttctactcacgactccgtggacgggcctattcatcatctccagacgacgtcgaccctaaagtaacttagtgtttagtactcttagactatacgaactaacttggacgagcccggaacgtaccgaccggcccttaggttattagtggtagcggagggctaggttgngggaggccggccgacggccccgaggctacggcgggggcccgggtacccg

SEQ ID NO: 31008 - DNA, 687 bp, Homo sapiens
  misc_feature: GYAE6OF01CQ177.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgtcttaattttaaaaggtgtccactgtgagatgtaccgtggtggagtcgtgggaggcggcttgactccgacggggtcccggggggtcctgagactctcatgtgcacgtccttgttaggtttaagtgtcaagtacgactactacagtagacgtcgttcggttcccacgtagtacttaccggagggaacgcgtacgtaggagttcggtctacgtagtttattacgtacgtcgtacggtaacctaccgttactaccgttcgaacgtaccgttcggtacgggtacggggtccttaagttcactacgtactaccgtaccgaggaccgtaccggtaccaactaaattactagttgttatattctagactagtaacgaactacgtaggacgtacgaccgaacgaccgaccgtaccttagttattacgttggacggaggtaggtcgtaggttagggtacgggacggaccggaccccggtccggtaccggtacggtaccggtaccgggccgggggtacccggttaaccccgg

SEQ ID NO: 31009 - DNA, 811 bp, Homo sapiens
  misc_feature: GYAE6OF01BI6LB.41.78.H01.1.454.CMB.1.raw
  modified_base (297)..(297): a, c, t, g, unknown or other
  misc_feature (297)..(297): n is a, c, g, or t
tcagtctatactatcacgaccggtgctcgatttagtgtgagtagtttgggtttgggggggagaggagcccagcactgggactccgaggtgttccattcggtgatcagcactgaacacagaggactcaccatggagttttggctgagctgcgttttccttgttgcttaattttaaaaggtgtccactgtgagatgtaccgtgggtggagtcgtgggagggccggtcttgacgtccgacgggcccgggggggtccctaggacgacctctctatgtcgcacgccttcgttaggtttaagngtacagtacgacactacatgagtcgtcggtcccgacgagtacgttccgaaggggaacggcgcggtagggtaagttcggggtactacgttaaggtttaactttacgtacccggtcggttaacgggaaacctaaccctttcgtaaccgtacgtacggtaccgttccggtagggaccggggtaccttaacgttctaacgtcctaacgttccgtaccgtaggaacggtaccgtaccgtaacctaaattaaggggttattaggtttacttaacgttaccgttagtaactaagtaacgtaaacgtaacgttaggaaacggtaacgtacccggaaaccgtaaccgtaccggttacccgttacggttacgtttaacggttcgggtacgggtaccgggtaacgggtacgttacgggtttaggggacggggtaaacggggtaccggaccccgggtaccccgggtccccggttacgggtacccggtaaccggggtcccggggggaaccccgggggttaaccccgg

SEQ ID NO: 31010 - DNA, 757 bp, Homo sapiens
  misc_feature: GYAE6OF01CS6TT.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgtcttaattttaaaaggtgtccactgtgagatgtacctgggtggagtcgtgggaggcggcttgatccgacgggcccgggggggtccctggagactctcagtgtcgcacgtccttgttaggtttaagtgtcagtagacactacatgagctcggttccgcctagacttccgagggaacggcgcgtaggaacgtgggtactacgttagttatttacgtaccgtcgtagggtaaacctaccgtttctaaccttacacggtaaccgtccggtagggacgggggtacccttaagttcctaacgttctacttaccctacccgaaggtaaccggtaccggtaccgaaccctaaaagttaactttaagttggtttagttaactttcgttacgaactagtaacggtaaacctaacgtttacggaacgacggacccgaaccgaccgtaccggtacccgttagttactttagttcggtcgggacgggtagggtcgttaagggtttggtaggggtaacgggtaccgggaccccggacccgggtcccccggttacgggacccggttaaccggggtcccgggggggtaccccggggtaaacccccggg

SEQ ID NO: 31011 - DNA, 691 bp, Homo sapiens
  misc_feature: GYAE6OF01A8AKU.41.78.H01.1.454.CMB.1.raw
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
  modified_base (332)..(332): a, c, t, g, unknown or other
  misc_feature (332)..(332): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgctaattttaaaaggtgtccactgtgagatgtacctggtggagtctgggaggcggcttgatccgagggcccggggggtccctggacgactctcatgtgcagtcctcgttggtttaagngtcagtagacactacatgagctggttccnccagcttccgagggaagccgngtaggaatggggtctacgagtttatttaacgtacccgcgtacgggtaaacctccgttactaccttcgaagtaccgtccggtaggacgggggccctaattccgattacctaatccgttacaacgacggaccgttccgaacccgtaaataagtacgttagttagtactttcgtagaactagtagaaactaacgttggaacgtacgaccggaacgaccgtaccggtaccctaggttactttacgtcggttagacggtacggggtcgtaacggtttgggtacggggacggacgggtaccccgaaccgggtcccccgtagggtaccgttacccgggtcgggggtaccccggggtaaaccccggg

SEQ ID NO: 31012 - DNA, 732 bp, Homo sapiens
  misc_feature: GYAE6OF01BODVE.41.78.H01.1.454.CMB.1.raw
  modified_base (211)..(211): a, c, t, g, unknown or other
  misc_feature (211)..(211): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggnggcggcttgatccaggccgggggggtccctgagactctcatgtgcagcctctggtttaagtgtcagtagacactacatgagctcggttcccgccgagacttccgaaggggaacggcgcgtggaagtgggtctcgtagtttatttagtaccgcgtacggaactaccgttctactcagtacctccggtggacgggtccgattcatcacttctaccaggacgtaccgtcgaccctaaattaatattggtttagtactttcgttagtaactagtacgtaaactaacgtttaggaaggtaacggacccggaaccgtaaccgacccgggtcccctttaggtaacttttaacgttcgggtacggtaccggggtaacggggtaccggttagggttttaggggtacgggggaacggggtaaccggggacccccggaacccggggtcccccccgggtttacggggaccccgggtttaaccccgggggttcccgggggggggtaaccccccgggggttaaaccccccggggg

SEQ ID NO: 31013 - DNA, 574 bp, Homo sapiens
  misc_feature: GYAE6OF01EIQH0.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttccgccagtacttccgaggggaaggcgctggaatgggtctcagtttatttataccgcgtagggaactaccttctactcgagactccggtgacggggcctagttcatacatctccagacgacgtccgacaaataatattgttgttattcttagtactatacgaactaacgttgagaacgaccgacggacaccggccttagtattagttgtgcgagggctaggttgaggaggacgcccgaccggtcccgtggacgtacggtcggggccgggtaacccgg

SEQ ID NO: 31014 - DNA, 793 bp, Homo sapiens
  misc_feature: GYAE6OF01C2QSR.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctggagactctcatgtgcagtcctcgttaggtttaagtgtcagtaagacacttacagtgacgtctggttcccgaccgtagtacgttcccggaaggggaacggccgtcgtaggtaagttcgggtactcgttaagtttatttacgtaccgtcggttacgggaaacctaccctttacttaaccgtaccaaacgtaccgttcccggtagggacgggggtaccccgtaattttcgaacttacaaccttccgttaaccccgaaggtaaccggtaacccggttacccgtaaccctaaaattaaagttaacgtttagttacgttaactttccgtttacggaactaacgtacgtaaactaacgttagaacgtacgacccggaaccggtaacccgaaccggtcccgtttaagttacgttacgtttagggtcgtaccgggtaagggaccgttagggttacgggtaggggtacggggaccgggtccccggaaaccccgggtcccccggttacgggacccggtttaccggggtcccggggggggtaaccccgggttaaaccccgggg

SEQ ID NO: 31015 - DNA, 596 bp, Homo sapiens
  misc_feature: GYAE6OF01CP7GW.41.78.H01.1.454.CMB.1.raw
  modified_base (430)..(430): a, c, t, g, unknown or other
  misc_feature (430)..(430): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttattttaaaaggtgtccactgtgagatgtacctggtggagtctggaggcggcttgatccgaggcccggggggtcctgagactctcatgtgcagcctcgtggtttaagtgtcagtagacactacatgagctggttccgcagattccgagggaagcgctggaatgggtctctagttattataccgcgtggaacctacgttctactcagacctcgtgacgggtccattcatcatctacgagacgacgtcgaccaataatattgttntatcttagacatagaactacgtgaagacgcccgaacgaccgtaccggcccttagttacttagttggtgaccgggtagggtctagggttggtacgggagggaccggtcccgaccgggtcccccgtagggcccgttaacggccggggggtaccccggggtaaccccgg

SEQ ID NO: 31016 - DNA, 666 bp, Homo sapiens
  misc_feature: GYAE6OF01B8YJB.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccgggggggtccctgagactctcatgtgcagtcctctggtttaagtgtcagtagacactacatgagcgtggttccgccagacttccgagggaaggcgcgtggaagtgggtctcgtagttatttacaccgtcgtagggaacctaccttctactcagacctccggtaggacggggccgtattcgacttcacttcctacccaggacgtaccggtccgacctaaattaatagttgttagtattcttagactattacgaactaacgttaggaacgtaacgacccgggtaaccgacccgaccgggtaccccttaggtatttaacgttggttggacccggagggggtaccgtagggtttgggtaggggacggggaccgggcccgacccgggtcccccgttgggacccgttacgggtccgggggggacccccgggtaaccccgggg

SEQ ID NO: 31017 - DNA, 607 bp, Homo sapiens
  misc_feature: GYAE6OF01ET549.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctgggaggcggcttgatccgaggccgggggggtccctgagactctcatgtgcagcctctggtttaagtgtcagtagacactacatgagctggttcccgcagattccgaggggaggcgctgggaatgggtctcagtttatttagtaccgctaggaactaccgttctactcagactccgtggacggggccattcatcatctccagacgacgtcgaccaataactatgttgtattcttgacatagaactaacttgagtacgacccgacgaccgacggcccgttagtagtttagttggtggtcggtaaggggtccgtaggtttgggtagggagggacgggcccgacccgggtcccccgtcgggtaccgttaccgggttcggggggccccgggggtaacccccggg

SEQ ID NO: 31018 - DNA, 606 bp, Homo sapiens
  misc_feature: GYAE6OF01EENAE.41.78.H01.1.454.CMB.1.raw
  modified_base (302)..(302): a, c, t, g, unknown or other
  misc_feature (302)..(302): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctgagactctcatgtgcagcctctggtttaagtgtcagtagacactacatgagctggttccgtnagattccagggaaggcgctggaatgggtctctaagttattataccgtcgtacggtactacttactactctacgactcgtcggagggcgtactactactctactcctaccacgacgtacgtacgtactaataattattagttagttatactacgtactatagtaactaacgtagacgacgaccgaaccgaccgtaccgtaccgtacgttagttagttgtgacggacgggtcgtaggttaggtgggacgggacggacccgtaccggaccccggtaccggtaccgtccggtccgggggtacccgggg

SEQ ID NO: 31019 - DNA, 585 bp, Homo sapiens
  misc_feature: GYAE6OF01BLBP9.41.78.H01.1.454.CMB.1.raw
  modified_base (350)..(350): a, c, t, g, unknown or other
  misc_feature (350)..(350): n is a, c, g, or t
  modified_base (524)..(524): a, c, t, g, unknown or other
  misc_feature (524)..(524): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccgggggggtccctgagactctcatgtgcagcctcgtggtttaagtgtcagtagacactacatgagctggttccgcagattccgagggaaggcgcgtggaagtgggtctctagtttatttanaccgctaggaactaccttctactcagacctcggtgacggggccattcatcatctcagagacgtcgaccaaataatattgttgtattcgttgactatacgaactaacgttggaagacggacccggaacgacgaccggtcccttagtactttagttggtgcggagggctggttggngggaggacggccgaccgggtcccctgggaccgtacgggtcgggggacccgggtaaccccgg

SEQ ID NO: 31020 - DNA, 755 bp, Homo sapiens
  misc_feature: GYAE6OF01EE9S9.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggtagttttggctgagctgtcgttttccttgttgtcttaattttaaaaggtgtccactgtgagatggtactggtggacgtcgtggaggcggtcttgacgtccggagggtcccggggggtcctggacgtctcgtacatgtcgcacgtccttcgttaggtttaagtgtcaagtacgaacacgtacagtgacgtgttcggttcccgacagtactttaccggagggaagccggacgttaggaagttcgggtcttagtaagtttacgttacgtaccgtagttaaccggtactaccgtttacctactacgacgtaccggtacggttcgggaccggggtacccgtattacctagtaccttactaccgttaccgaacggtaacgcggttacccggaacctaaagtttaaactagttacgttacgttacttacgtttacgaactacgtacgtaaactacgttacgaacggtacgacccgtaccggtaacgtacccggtacttacgttagttgttcggtaggtaccggaggtacggtacggttagggtacgggaacggggcggtaccccggaacccgggtcccggtcggtaaccgggttccgggcccgggggggtacccggttaaccccgggg

SEQ ID NO: 31021 - DNA, 790 bp, Homo sapiens
  misc_feature: GYAE6OF01DMM0J.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgcttattttaaaaggtgtccactgtgagatgtacctggtggagtctggaggcggcttgacgtccgagggcccgggggggtccctgacgactcgtcagtgtgcacgtcctgttaggtttaagtgtcaagtacgactactacatgacgtctcggttccgcctaagtacgttaccggaaggggaacggcgtacgtagggtaagtcgggttactacgtagtttaacgtttacgacccgtcgtacggtaaccctccgtttacctaccgtacgaacgtacccgtccggtagggaccggggtcctagttcctacgttaccacttcccgtaccgaggtaaccggtacgtaccgaacctaaagttaacttagttcgtttacgtatttccgttaacgactagtaacgtaaccttacgttacggaacgtaccggaccgtaaccgtaacccggtacccgttacccgttagttacgtttacggttcgggtacggacgggtacgggtacgtttacggggttagggtacggggtaaccggggtaccgggttacccccggaccccggggtttacccccgtaggggtacccgggtttaacccgggggggtcccggggggtaacccccggggttaaacccccggg

SEQ ID NO: 31022 - DNA, 599 bp, Homo sapiens
  misc_feature: GYAE6OF01C499N.41.78.H01.1.454.CMB.1.raw
tcagtctatactatcacgaccggtgctcgatttagtgtgagtagtttgggtttggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccggggggtcctgagactctcatgtgcagcctctggttaagtgtcagtagacactacatgagctggttccgccagtattccagggaagtcgctggaatgggtctctagttatttataccgctgggaactaccttctacctcagactccggtgacggggccagttcatcatctccagacgcgtcgctaaatatatgttagtattctgacatacgaacaacttgaacgtagaccgaacgacgaccggcccttaggttattaacgttggtacgccggtagggtactagggtttggtagggacgggtaccggcccgaaccgggtcccccgttagggacccttaccgggtcgggggggtaccccggggtaaaccccg

SEQ ID NO: 31023 - DNA, 618 bp, Homo sapiens
  misc_feature: GYAE6OF01AYQZ0.41.78.H01.1.454.CMB.1.raw
  modified_base (307)..(307): a, c, t, g, unknown or other
  misc_feature (307)..(307): n is a, c, g, or t
tcagtctatactatcacgaccggtgctcgatttagtgtgagtagtttgggtttgggggggaggaggagcccagcactgggactccgaggtgtttccattcggtgatcagcactgaacacagaggactcaccatggagttttggctgagctgcgttttccttgttgctattttaaaaggtgtccactgtgagatgtacctggtggagtcgtggaggcggcttgactccgaggcccgggggggtccctggacgactctcatgtgcagcctctggtttaagtgtcagtagacactacatgagctggtccnccagacttccgagggaaggcgcgtgggaagtgggtctcgtagtttactttacgtaccgtcgtacgggaacctaccgtttctacctcgacgtactccggtaggacggggtccgtattccatcatcctaccgagacgaccgtcgacctaaagtaactagttgttagtattcgttgaactagtacgtaaactaacgttgaacgacgaccgaacgaccgaccggtcccttagtacttagtgcgcggagggctagggttgagggagggcgcccgaccggtccccgtggaccgtacggtcgggggcccggtaacccg

SEQ ID NO: 31024 - DNA, 740 bp, Homo sapiens
  misc_feature: GYAE6OF01D17FF.41.78.H01.1.454.CMB.1.raw
  modified_base (311)..(311): a, c, t, g, unknown or other
  misc_feature (311)..(311): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttaattttaaaaggtgtccactgtgagatgtacctggtggagtctgggaggcggcttgatccgagggccgggggggtccctggagactctcatgtgcagccttcgttggtttaagtgtcagtagacactacatgagctggttccncagattccgagggagcgcgtggaatgggtctctagtttaatttactaccggcgtacgggaaacctaccgtttctaacctcaacggtaccttcccggtgggaacggggcctatttccatcaatcctaccaggacgtaccgtcgacaaattaatattgtttagttattcttaggaactataacgtaaactaacgttaggaacgacggaccccggaacgaacccggtaacccggtaccccgttaggttttaacgtttacgtttacggtacgggtaccgggtaacgggggtaccgttaacgggttttggggttaacggggaacgggggtacccggggacccccggtaacccggggtcccccccggttaggggtaaccccgtttaacccgggggttcccggggggggaaccccccgggggtttaaacccccggg

SEQ ID NO: 31025 - DNA, 821 bp, Homo sapiens
  misc_feature: GYAE6OF01C84XV.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcacatggtagtttggctgagctgtcgttttccttgttgtacttaagttttaaaaggtcgtccactgtgagatcgtaccgtgggtggagtcgtggggaggcggtcgttgacgtccgacggggtcccgggggggtccctggacgtacctctctatgtcgacgacgtccttacgttaggtttaaggtgtacaagtaacgaactaacctacagtaggacgtccggttacggttccccgaccgtagtaccgttaccggaaaggggacgggccggtcggttaagggtaacggttcgggttaccttacggttaagttttaacgtttacgtaacccggtcggtaacggtaacctacctttactaccgacgtaacgtacgtcggtagggtacgggtccgtattccaatacctacgtacctacgaacggtacgtaccgtaccgtaactaaaagttattacgttggttattagttccgttaagtaactaagttaacgaaacttaacgtaggaaccggacgacccggtaacggaaccctaccggttaccgttagttaacgtttagtcgggtcgggaacgggtaaggggtacgttagggtttaggggaccgggaacggggacccggtacccccgggaaccccgggtccccgggttagggacccccgggttacggggggttcccccgggggggaaccccgggttacccg

SEQ ID NO: 31026 - DNA, 660 bp, Homo sapiens
  misc_feature: GYAE6OF01EYF0F.41.78.H01.1.454.CMB.1.raw
tcagtctatactatcacgaccggtgctcgatttagtgtgagtagtttgggtttggggggggagaggagcccagcactgggactccgaggtgtttccattcggtgatcagcactgaacacagaggactcaccatggtagttttggctgagctgtcgttttccttgttgcttaattttaaaaggtgtccactgtgagatgtacctggtggagtctgggaggcggcttgatccgagggccgggggggtccctggagactctcatgtgcagccttcgttggtttaagtgtcagtagacactacatgagctggttccgccagattccgagggaaggcgcgtggaagtgggtctcgtagtttattactaccgcgtaggaacctaccttctactcagtacctccggtggacggggtcctagttcactcacttcctaccgagacgacgtcgacctaaataatattgttagttatcttagactagtacgaaacctaacgttagaagacggacccgacgaaccgtacccggtacccttagttaactttagttggtacggtaccgggaggggtcgtagggttgggtaggggtacgggaccggtcccggacccgggtccccggtacgggtaccgtaccggggttcccgggggggcccgggttaacccccggg

SEQ ID NO: 31027 - DNA, 757 bp, Homo sapiens
  misc_feature: GYAE6OF01DCZKE.41.78.H01.1.454.CMB.1.raw
tcagtctatactatcacgaccggtgctcgatttagtgtgagtagtttgggtttgggggggagaggagcccagcactgggactccgaagtgtttccattcggtgatcagcactgaacacagaggactcaccatggagttttggctgagctgtcgttttcttgttgcttaattttaaaaggtgtccactgtgagatgtacctggtggagtctggaggcggcttgatccgacggcccgggggggtccctgacgactctctagtgtgcacgtccttcgttaggtttaagtgtcaagtagacactacatggacgcgtcggtttccgccagtacttaccggagggacggcgcgtagggtaagtcgggttctacgtagtttactttagaccggtcgtagggtaacctaccgtttactacctcgacgtaccgtccggtaggtacggggccgtattcatctacgtctacagacgacgtaccgactaaataattagttgttattacttcttagactaatacgtaaactaacgttacggaacgaccggaacccgacggtaacccgtaccgggtccctttaaggttagttttacggttcgtcggggtaccgggtacggggttaccggtaaggggtttcggggtaacgggggtaaccggggacccgggacccccgggttaaccccggggtcccccggggttacggggtacccccgggtttaccggggggttaccccgggggggggtccccccggggttaaacccccgggg

SEQ ID NO: 31028 - DNA, 706 bp, Homo sapiens
  misc_feature: GYAE6OF01DF7ON.41.78.H01.1.454.CMB.1.raw
  modified_base (263)..(263): a, c, t, g, unknown or other
  misc_feature (263)..(263): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggcccgggggggtcctgagactctcatgtgcagcctntggtttaagtgtcagtagacactacatgagctggttccgcagattccgagggaaggcgcgtggaagtgggtctctagttatttactaccgcgtcgggaaactccgttactactcaagacctccggtggaggggcctagttcatcatcctaccagacgtacgtccgactaaacttaatattcgtttgtattctttaggaactagtagaaacctaacgtttagaagacggaccccgtaaccggaaccgtacccgggtaccccttaggtttaactttagtttacgggtacggaccgggtaagggggtaccgttaaaggggttttcgggtaacgggggtaacggggtaacggggacccccggtacccggggtaccccccggttacggggtacccggttaacccggggttccgggggggggaccccccgggggttaaaacccccgggg

SEQ ID NO: 31029 - DNA, 772 bp, Homo sapiens
  misc_feature: GYAE6OF01BARRP.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctgggaggcggcttgatccaggccgggggggtccctgagactctcatgtgcagcctcgttggtttaagtgtcagtagacactacatgagctggttccgccagacttccgagggaaggcgcgtggaagtgggtctctagtttatttactaccggcgtacgggaacctacccgtttacctactacacggtaccgtccggtagggacgggggtcccgtaagtttccaacttcctaacgttcctacccgtaaggaacggtaacccggttccgaacccgtaaaatttaaacgttaagttaggttttaggtttaactttccgtttacggtaacctaagttacgtaaaaccctaacgtttagggaacgtaacgggaccccggaaccggtaacccgtacccgggtaccccttaggtttaacgtttaagtttacgggtacgggtccggggaacggggtcggttaagggttttagggtagggggtacggggacgggaccccgaaccccggggtccccccgtacggggtacccgtaccggggttcccgggggggaaccccgggggttaacccccggg

SEQ ID NO: 31030 - DNA, 649 bp, Homo sapiens
  misc_feature: GYAE6OF01ENZ3E.41.78.H01.1.454.CMB.1.raw
  modified_base (477)..(477): a, c, t, g, unknown or other
  misc_feature (477)..(477): n is a, c, g, or t
  modified_base (493)..(493): a, c, t, g, unknown or other
  misc_feature (493)..(493): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttattttaaaaggtgtccactgtgagatgtacctggtggagtcgtgggaggcggcttgactccgagggcccggggggtccctgagactctcatgtgcagccttcgttggtttaagtgtcgaagtacgaacacgtacagtgacgtcgttcggttcccgccagtacttccggaaggggaaggccgcgtagggaagttgggtacttcgtagtttatttactaccgcgtacggaactaccttctactcacgccgtccggtagggacgggcctagttcagtcatctaccgagacgacgtcacgaataatattgttntatcgttgactagtanaactactggaacgtacggaccgaacgtaccgacggtacccttaggttattcgttggtcgtagggagggtacgtaggttagggtgggacgggacggccccgtaccgggtcccgtacgggtaccgtacccggggtccgggggaccccgggtaacccgg

SEQ ID NO: 31031 - DNA, 738 bp, Homo sapiens
  misc_feature: GYAE6OF01DYZI7.41.78.H01.1.454.CMB.1.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttaccttgttgctattttaaaaggtgtccactgtgagatgtacctggtggagtctggaggcgcttgatccaggccggggggtcctgagactctcatgtncagcctntggtttaagtgtacagtagacactacatganctcggttccnccagtacttccgagggaacggcgcgttagggaatgggttctacgtagtttactttactaccgcgtacggaactaccttctactcacgactccggtaggacggggcctattacgactacgtacttaccgtccaaggacggtaccgttaccgaacctaaaagttaagttagttgtttagttaacgtttaccgtttaggaacccttaagtacggtaaaacctaacggtttacggaacggtaacggtaccccggaaacgaccgtaacccgggtccccttaggttaacttttacgtacggtacgggaccggtaacgggggcttaacggggtttagggaccggggtaaggggtaaaccccgggtcccgtaaccccggggacccccgtttaaggggacccgtttaacccggggacgggggggacccccccggggttaaaccccg

SEQ ID NO: 31032 - DNA, 640 bp, Homo sapiens
  misc_feature: GYAE6OF01AXDAD.41.78.H01.1.454.CMB.1.raw
  modified_base (558)..(558): a, c, t, g, unknown or other
  misc_feature (558)..(558): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctaattttaaaaggtgtccactgtgagatgtacctggtggagtctggaggcggcttgatccaggccgggggggtccctgagactctcatgtgcagcctcgtaggtttaagtgtcagtagactactacatggagtcgtcggttcccgacctagacttcccgaagggaaggccgcgtggaagtgggtctcgtaagtttatttaacgtaccggtcgtagggtaaacctccctttactaacctcaacggtaccgtcccggtgggacgggggtccctaattccgaattccaactcctacccaggacgtaccgtcgaccctaaataacttatgttagttattcttgaacatagaactaacgtgacgagccgacgacgacggtccctagttattagttgngtcggagggtctaggttggaggacgggaccggcccgaccgggtcccgttggcgtacgggtccgggggcccgggtaaccccgg

SEQ ID NO: 31033 - DNA, 569 bp, Homo sapiens
  misc_feature: GYAE6OF01DV9AH.41.78.H01.1.454.CMB.1.raw
  modified_base (435)..(435): a, c, t, g, unknown or other
  misc_feature (435)..(435): n is a, c, g, or t
  modified_base (513)..(513): a, c, t, g, unknown or other
  misc_feature (513)..(513): n is a, c, g, or t
  modified_base (516)..(516): a, c, t, g, unknown or other
  misc_feature (516)..(516): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttccgccagacttccgaggggaaggcgcgtggaatgggtctctagttattactaccgctgggaactaccgttctactcacgtactccgtggacggggcctagttcatcatctccagacgacgtcgacaataatatgttntattctgactatagaactaacttgagtacgaccgacgacgaccggcctagtattgttgtgcggtagggcgtaggttgnggngggacggtccgaccggtcccgtggaccgtcggcgggggcccgggtaaccccgg

SEQ ID NO: 31034 - DNA, 785 bp, Homo sapiens
  misc_feature: GYAE6OF01DSASP.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagcttgtcgtttttccttgttgtcttaattttaaaaggtgtccactgtgagatgtaccgtggtggagtctgggaggcggtcttgactccgacgggcccgggggggtccctggacgactctcagtgtgcacgtcctcgttggtttaagtgtcaagtagacactacatgagcgtcggttccgcagtattccgagggacggcgcgtaggagtgggtctcgtaagttatttacgtaaccgtcgtacgggtaacctacctttctacctacgtaacggtacctccggtagggacggggccgttaacttccgtaattccattccgtaccgaacgtacgaccgtaccgaacctaaattaattattgtttagttaacgttcttagtacttaagtacgtaaacttaacgttacgaacggtaaccgtacccgggaaccggtaacccggtaacccgggttaccccgttaaggtttaacgttttaacgttcgggttacgggtaccgggtacggggtacgttacggggtttggggtaacggggtaacgggggtaaccggggtaccccggtaccccggggtccccccgttacgggggtaccccggtttacccgggggtcccggggggggtaacccccgggggttaacccccgggg

SEQ ID NO: 31035 - DNA, 907 bp, Homo sapiens
  misc_feature: GYAE6OF01BSCJJ.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggtagttttggctgagctgtcgttttccttgttgcttaattttaaaaggtgtccactgtgagatgtacctggtggagtcgtggaggcggcttgactccgacgggcccggggggtcctgagactctcatgtgcacgtccttcgttaggtttaagtgtcagtagacactacagtgagcgttcggttcccgccgtaaggtacttaccggaaggggaaacggtcggtacgtagggtaaacgttcggggttacttacgtaaggtttttaacttttaaccgttaacccggtaccggttaacggggtaaacccttaaccccgtttaccttaaccctaccgaaacggtacccggtttcccgggtaggggtaccggggggtacccgttaacgtttacctacgtttaccctaactttcccgtacccgtaacggtaaccgggtacccggttaccgtaaaccccgtaaaaagttaaagtttagtttacggttttacgggtttaactttaccgtttacggtaaacctaagtttaaaccggtaaaacccgttaaacgtttaacggaaccgggtaacggaaccccggtaacccggtaacccggtaacccgggttacccccgtttaggtttaacttttacggttgggttacgggtacggggtaacggggtacgttagggtttagggacggggtacgggacccgggtacccgggtaccccgggtcccccgggttaggggtaccccggtaccgggggttccccgggggggtaccccgggggttaacccccggg

SEQ ID NO: 31036 - DNA, 768 bp, Homo sapiens
  misc_feature: GYAE6OF01DQXQO.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggctcaccatggagttttggctgagctgtcgttttccttgttgcttaattttaaaaggtgtccactgtagagatgtaccgtggtggagtcgtgggaggccggtcttgactcccgacggggtcccgggggggttccctggacgtacctctcagtgtgaccgtacgtccttcgtttaggtttaagtgtacgaaggtacaacctactaacagtgacgtcgttcggttccacgagtacgttaccggagggacggcgtacgtaggtagtggtccttacgtaagtttacttacgtaccgtcgtacggtaaaccttccgttactaccgtacgacgtaccgtcggtacgggacgggtacctagttccacgtactactccgttaaccgagtaaccgtaccggtaaccaacctaaattaacgttagttgtttacgtattcggtataataacgttagtaaacctacggttagaacggtacccgaacccggaaccgtacccgtaccgttacccttaaggtttattacggtcggtagggcgggtaagggtcgtaagggtttgggaacgggtacggggacccggtcccggaccccgggtaccccggttacgggtacccgggttaacccggggtaccggggggtaccccggtaacccccggg

SEQ ID NO: 31037 - DNA, 717 bp, Homo sapiens
  misc_feature: GYAE6OF01BNIEA.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgactccgagggcccgggggggtccctggagactctcatgtgcacgcctctggtttaagtgtcaagtagacactacatgagcgtcggttcccgccacgagttcccgaaggggaacggcgacgtgggaagtggggtcctacgtagtttatttacgtaccggcgttacgggaacctacctttactactcacgacctcggtacgacggggacctacgttcagttctaactcctaccgaacggacggtaccgttcgaaccctaaagttaaactaatttgtttacgttactttaccgttgaacctagtacgaaacctaaacgttcggaaagaccggacccgaaccggaaccgtaccgggtacccttaggttactttaacgtttggtacggtccgggtaacggggtcgtagggtttgggtaggggtaacgggacgggaccccgtaccgggacccccgttcgggaccgtttaccgggtccggggggccccgggggttaaaccccgg

SEQ ID NO: 31038 - DNA, 667 bp, Homo sapiens
  misc_feature: GYAE6OF01ADE97.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgagggcccgggggggtccctgagactctcatgtgcagcctcgtggtttaagtgtcagtagacactacatgagctggttccgccagattccgagggaaggcgcgtaggaagtgggtctacgtagtttatttacaccgtctacgggaacctacctttctaactcaacgtaccgtccggtggacggggtcccgtaattcatcgactccgtaccagacgacgtcgacctaaagtaactattgttagttattcttagactatagaactaacgttagagtacgcccgacgaacccgaccggtcccttagttatttagttcggtggtccgggaaggggccgtagggttagggttacggggaacggggttaccgggacccggtaacccgggtcccccggtagggtacccgttaccggggtccggggggtaccccgggggttaacccccggg

SEQ ID NO: 31039 - DNA, 1031 bp, Homo sapiens
  misc_feature: GYAE6OF01DBJ4N.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgtcttaattttaaaaggtgtccactgtgagatgtacctggtgagtcgtggaggcgcttgatccgacgggtcccggggggtccctgagtacctctctagtgtgcagtcctgttaggtttaagtgtacgagtagaccactacatgagcttcggttcccgaccagtacgtccggaagggaacggcgtcgtagggaagttcggggttctacgttaagttttaacgtttaacgtacccggtaccgttagggaaacccctaccctttccgttaacctccctaagggtaccctcccgggttaacggggacgggggtacccctaacgtttaccgtaacttcccgtaacgtttcccgttaacccgaacgggtaaaccgggtaccccgttaaccggtaacccccttaaaaagtttaaaagtttaacgttttacgggttttaaggtttaaccgtttaccgttttaacggtaaacccgttaaaacgttttaaccggtaaaaaacccctttaaacgttttaacggggaaaccgggtaaacccgggtaaaccccccggtaaaacccggggtaaacccccggtaacccccggggttaaccccccggtttttaagtttttaaccgttttaaacgggtttttaccggggtaccggggttaaacccgggggtaccggggttaaacccggggttaaaggggttttacggggttaacggggggtaaacccgggggtaaccccgggggtaaccccccccggggtaacccccggggtcccccccccggggtttaaacggggggtcccccggttttaaacccccggggggggttaacccggggggggggtaaacccccccccccgggggggttttaaaacccccccgggg

SEQ ID NO: 31040 - DNA, 624 bp, Homo sapiens
  misc_feature: GYAE6OF01B6Q96.41.78.H01.1.454.CMB.1.raw
  modified_base (416)..(416): a, c, t, g, unknown or other
  misc_feature (416)..(416): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccgggggggtccctgagactctcatgtgcagcctcgttggtttaagtgtcagtagacactacatgagctggtccgccagattccgagggaggcgctggaagtgggtctcgtagtttatttactaccggcgtacgggaacctaccttacgtaactcagaccttccgtaggacggggccattcatcatcncagagacgtcgaccaataatattgttagtattcgttagactagtacgtaaactacgttgaacgacggacccgaacgtaccgaccgggtcccttagttaacttagttggtcgcgggagggtcgtagggttggaggggacgggacggcccgtaccgggtcccccgttgggaccgttaccggggtcggggggtccccggggtaaaccccgg

SEQ ID NO: 31041 - DNA, 677 bp, Homo sapiens
  misc_feature: GYAE6OF01D5JUH.41.78.H01.1.454.CMB.1.raw
  modified_base (453)..(453): a, c, t, g, unknown or other
  misc_feature (453)..(453): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgcttaattttaaaaggtgtccactgtgagatgtacctggtggagtctggaggcggcttgatccgagggccggggggtcctgagactctcatgtgcacgtccttcgttaggtttaagtgtacagtagacactacagtgacgctggttcccgcagcttccgagggacgcgcgtggaatgggtctacgtagttatttacgtaccgcgtacggtaacctaccttctacctcacgtacctccgtaggacgggcctatcactcactctacgagacgacgtcgaacctaaattaatnttgttagtacttctagactaagtacgtaaactaacgttagaacggtaaccgccggaaccgtaaccgtacccggtacccgtttagttacgtttagttacggtcgggtaccgggaggggttccgtaggttacggggtacggggacggggaccggtaccccggaccccgggtaccccgtgggtacccggttaaccggggtcccgggggaaccccggggttaccccgg

SEQ ID NO: 31042 - DNA, 546 bp, Homo sapiens
  misc_feature: GYAE6OF01EIRPQ.41.78.H01.1.454.CMB.1.raw
  modified_base (304)..(304): a, c, t, g, unknown or other
  misc_feature (304)..(304): n is a, c, g, or t
  modified_base (342)..(342): a, c, t, g, unknown or other
  misc_feature (342)..(342): n is a, c, g, or t
  modified_base (502)..(502): a, c, t, g, unknown or other
  misc_feature (502)..(502): n is a, c, g, or t
  modified_base (505)..(505): a, c, t, g, unknown or other
  misc_feature (505)..(505): n is a, c, g, or t
  modified_base (520)..(520): a, c, t, g, unknown or other
  misc_feature (520)..(520): n is a, c, g, or t
tcagtctatactatcacgaccggtgctcgatttagtgtgagtagtttgggtttggggggagaggagcccagcactgggactccgaggtgtttccattcggtgatcagcactgaaacacagaggactcaccatggagttttggctgagctgcgttttccttgttgctattttaaaaggtgtccactgtgagatgtacctggtggagtctggaggcggcttgatccagccggggggtccctgagactctcatgtgcagcctctggtttaagtgtcagtagacactacatgagctggttccgccagnttccgagggaagcgctggaatgggtctcagttatttanaccgctggaactaccgttctactcaagactccgtagaggggccaagttcatcatctccagacgacgtcgaccaaagtaatatgttcgtaatccttagacctatgaactaacgttgagtacgccgacgacacggcctgtacttatgtagcgaggcagttgnggnggacgccacggcccnggactcggtggggcccgggtaacccg

SEQ ID NO: 31043 - DNA, 853 bp, Homo sapiens
  misc_feature: GYAE6OF01CFCWU.41.78.H01.1.454.CMB.1.raw
  modified_base (297)..(297): a, c, t, g, unknown or other
  misc_feature (297)..(297): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttattttaaaaggtgtccactgtgagatgtacctggtggagtcgtggaggcggcttgatccgaggcccggggggtccctgagactctcatgtgcagcctcgttaggtttaagtgtacgagtacgacactanagtgagtcgttcggtccgcagtactaccggagggacggcgtcgtaggagttgggtactcgttaagtttactttacgtacccgtacggtacggtaacctacctttctacgtacgtacgtaccgtccggtacggggacggggtaccgtacgttacaacgttctaccgttccgtaaccgaacggtaccggtaaccgtacccgtaaaccttaaaagtttaacgttagtttcggtttacttacgtttaccgttacggaacttaacgtaacgtaaacgtttaaacccgttaggaaccggtaacccggggtacccggtaaaccccgggtaacccgggtaacccccgggtttacccgtttagggttttaacgttttaccgggtttcggggtaacggggtacccgggggaacgggtttcggtttaaggggttttcggggaacggggggttaccgggacccgggtacccccgggtacccccggggtacccccggtttacggggttaccccgggtttaccccggggggtacccggggggggtaaccccccggggtttaacccccggg

SEQ ID NO: 31044 - DNA, 677 bp, Homo sapiens
  misc_feature: GYAE6OF01B4GOY.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctaattttaaaaggtgtccactgtgagatgtacctggtggagtcgtggaggcggcttgatccaggccggggggtccctgagactctcatgtgcagcctcgtggtttaagtgtcagtagacactacatgagctggttcccgccagattccgagggaacggcgcgtggaatggggtctcgtaggtttatttacgtacccgcgtagggaacctaccgtttctacttccaagtaccgttccggtggacggggcctaattcagtcacttctaccgagacgacgtcgacccaaattaactagtgttagtattcgtgaacatagaactaacgtttgaacgtacgacccggaaccggtaaccgaccgggtaccccttaggttaacttttacgttggttacggcgggtaacggggtcgtaggggtttggtaggggaacgggtaccgggccccgtaaccccggggtccccgttacgggacccgttacggggtcccggggggaccccggggttaaacccccggg

SEQ ID NO: 31045 - DNA, 874 bp, Homo sapiens
  misc_feature: GYAE6OF01DI80H.41.78.H01.1.454.CMB.1.raw
tcagtctatactatcacgaccggtgctcgatttagtgtgagtagtttggggtttgggggggagaggagcccagcactgggactcgagtgtttccattcggtgatcagcactgaacacagaggactcacagtggtagttttggctgagctgttcgttttccttgttcgtattaagttttaaaacgggtctaccagttagtagagtattgtaccgtgggtggtcggtcgtgggaggtcgtcttagacgtccggacggggtcccggggggttccaggacgtaccttactacgtagttcggtcgacgtaccgttaccgttcggtttagggtttaagttacgtaaccgtaagtaaccgtaaactaaccgaatacgtagtaccggttccggtccggttacccggaccgtaagtaccgttacggaacggggtagccggagtacggtagtcggtactagtttacttaacgtttagaccgtaccggacgttaacctaccgttactaccgtacgtaccgaccgttacggtacgggtccggttacgtaacttacgactacctaccggtactacggaaacgtaccaacgggttaaccctaaacttaaagttaaagttacgttaaggttacgtacttacgtaaacggtactaacgtaattaacgtaacggtagtaccgggaaccggtacccaaaccgggtaccttaccgggttaacccttagggtttaacttacgggttaacggtacggggtacccgttaagggagggtttaggggttaacggggacggggaccggaacccggggttaaccccggaaccccgggttcccggttaacggacgggggtttaacccgggtaccccgggggggccccggttaaacccgggg

SEQ ID NO: 31046 - DNA, 693 bp, Homo sapiens
  misc_feature: GYAE6OF01CHZYL.41.78.H01.1.454.CMB.1.raw
  modified_base (501)..(501): a, c, t, g, unknown or other
  misc_feature (501)..(501): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttaattttaaaaggtgtccactgtgagatgtacctgggtggagtctggaggcggcttgactccgacgggcccgggggggtccctggagactctcatgtgcagtccttcgttggtttaagtgtcagtagacactacatgagtctggtcccgcagtacttccgagggaaggcgcgtaggaagtggtctgtagtttatttacgaccgtcgtacggaacctacctttcgtactcgtaacgtaccgtccggtaggacggggcctacttcactacctacgtcctacgacggtacgtaccggtccgaacctaaattacttagttcgtttagtacttcgttanacgttataacgaaacctaacgttaggacgacgtacccggaaccgaccgtaccggtacccttagttacttagttggtacgggacggtacgggtcgttagggttgggacggggacgggtaccgggaccccggacccgggttcccgtggggaccccggtttaccggggcccggggggtaccccgggttaacccgg

SEQ ID NO: 31047 - DNA, 809 bp, Homo sapiens
  misc_feature: GYAE6OF01EY465.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttaattttaaaaggtgtccactgtgagatgtaccgtggtggagtcgtggaggcggtcttgacgtccgacggggtcccgggggggttccctggacgtaccgttcctacgtagttcggtcggaccgacgtcccgtttacggttttagggtttttaaacggttcggttaacgtaacggttaacgtaaccctaaccgttaacgtaacgttaggacggttccggtttaccggggtttccccgaccgtaggtaccgtttacccggggaagggggaacggccggtacggtagggtaacgttcgggttacttacgttagttttaactttacgtaccgtcgttaacggaaccttacctttccgtaactcgtaacgtacccgttccggtaggaccggggtcctaacttcacttacgtacttcctaccgtaacgtaccgaccgtacgtaaccttaaagttaattagttgttacttagttcgttagaactacgtaacgtaaactacgtaggaacgaccggtacccgacgtaccgtccgtcttagttacttgttggtcgacgggtaggtcgttggtgggtacgggacgggtaccggacccggtcccggtacccggttcggaccgtaccgggggtcggggtaaccccggtacccggg

SEQ ID NO: 31048 - DNA, 813 bp, Homo sapiens
  misc_feature: GYAE6OF01C1F6G.41.78.H01.1.454.CMB.1.raw
  modified_base (182)..(182): a, c, t, g, unknown or other
  misc_feature (182)..(182): n is a, c, g, or t
  modified_base (214)..(214): a, c, t, g, unknown or other
  misc_feature (214)..(214): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctggagctgtcgttttccttgttgcttaattttaaaggtntccactgtgagatgtacgtggtggagtgtggnggcgtcttgactccgacgggcccggggggtccctggacgacttctctagtgtgcagtcccttgttaggtttaaggtgttacagtaagactaacctaacagtagacgtccgttcggttacccgccgtaagtacgttccggaaggggaacggtccggtcgtagggtagttcgggttctaacgttaggtttaactttacgaccggtacgtacggtaacctaccgtttcctaacgtaccgaacggtaccgttccggtagggtaccggggtacctaagtttccaagttaccttcgtaccgtaccgacggtaacgtaccgtaccgtaaacctaaacttaaagtttaacgttgtttacgttacgtttacgttaagtaacgtacttaacggtaaaccttaacgtttacggaaacgggaccggtaacccggtaccggtacccgttaacccggtacccgttagttttaacgtttacggtttcggttacgggacggtacggggtccgttaagggttcgggtacggggacgggtaccgggacccgtaccccggggtcccggtacgggttacccgtaccgggggtcccggggtaccccggggttaacccggg

SEQ ID NO: 31049 - DNA, 939 bp, Homo sapiens
  misc_feature: GYAE6OF01B24Q3.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttaattttaaaaggtgtccactgtgagatgtacctggtggagtctggaggcggcttgatccgacgggcccgggggggtccctgacgacctctcatgtgcagccttcgttggtttaagtgtcaagtagacactacatgagctcggttccgccagtacttccgaggggaacggcgcgtggaagtgggtctacgtagtttactttacgtaccgacgtacgggaacctacctttactacctacgacgtacccgttaccggtacggggaccggggtaccgttaactttaccgtaacttcctaacgtttacccgtacccgtaaacgggtaaccggtaacccggttacccggtaaacccttaaaaagttaaactttaacggtttaggtttttaacggtttaacttttcccggtttaaacgtaaccgtaaacgtttaacggtaaaaacccgttaaacggttttagggaaaaccgggttaacccgggaacccccgggtaaacccgggtaaccccggtaacccccgggtttacccgttttaacgggttttaacttttaacggttttccgggggttacgggaccggggttaaacggggggttaccgtttaaagggggttttacgggggtacggggggtaaaccgggggaccccggggtaacccccccgggtaacccccggggggttaccccccgttacgggggttaacccccggggttaacccggggggtttaacccccgggggggggggtacccccccggggggtttaaaacccccccggggg

SEQ ID NO: 31050 - DNA, 658 bp, Homo sapiens
  misc_feature: GYAE6OF01CON0T.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggtagttttggctgagtctcgtccgtttttccttgttgtacttaagttttaaaaaggtcgtccactgtgagatgtaccgtgggtggagtcgtgggacggtcggtcttgacgtccggacggggcccgggggggtccctggacgtacctctctagtgtcgccacgtccgttcgttaggttttaagtcgtacgagtaacgactactaacagtgacgtcgttcggttcccgaccagtacgttaccgaagggaacggcgacgtaggacgtcgggtctacgtagtttaattacgtaccgtcgtacggtaacctaccgtttcactcacgtcctcggtaggacggtactacttcatcatcacagacgacgtcactaatatagttgttagtattctagactagtactaactagtagacgacgaccgacgaccgtacgtcttagtagttcgtggtacgcggaggtagtgggttggacgggacggaccggcccgtaccggtccgaggtaccggtcgggccggggtcccggtacccgg

SEQ ID NO: 31051 - DNA, 873 bp, Homo sapiens
  misc_feature: GYAE6OF01B8OP9.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgctaattttaaaaggtgtccactgtgagatgtacctggtggagtcgtggaggcgcttgatccgagggcccggggggtccctggagactctcatgtgcagtcctcttaggtttaagtgtcagtagacactacatgacgtcgtcggttcccgaccgaggtacgttaccggaaggggtaacgggccgtaccggtagggtaacggttcgggttacttacgttaagttttaacgtttacgtaacccggtcgtaacggaaccttacccgttactacctacgaacgtaccgttcggtacgggtaccgggtccgtattccgtaacgtactacttcccgtaccgtaaggtaacggaccccgttaccgaaaccgttaaaattaacgttagttacggttttagtactttccgtacgacgttaacgttaacgtaaacgttaacgttggaaccggtaaccggacccggtaaccggtaaacccggtaccccgggttacccgttaagtttaacgttttacgggtacgggtaccgggtaccggggtaacggggttaacccggttggggttttaccgggggtaacggggggaaaccggggttacccccgggaaacccccgggaccccccgggggttttaacccccgggtaggggttaaccccccggggttacccgggggggggtccccggggggggttaacccccccgggggttaaacccccgggg

SEQ ID NO: 31052 - DNA, 721 bp, Homo sapiens
  misc_feature: GYAE6OF01CS4DN.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttaattttaaaaggtgtccactgtgagatcgtaccgtggtggagtcgtgggaggcggcttgactccgacgggcccggggggtccctggagactctcgatgtgcacgtccgttacgttggttttaaagtgtactaggtaacgacaactacagtgacgcgtcggttcccgaccaggtacgttccggaaggggtaacggcgtcgtaggaagttcgggtctacgtagtttaactttacgtaaccgtcgtacggaaaccttacccgttcttaaccgtcgagtaccgtccggtaggaccgggtaccgtaacttctactacgtacttccgtaccgtaggtaaccgtacgtaccgaccgttaaaattaaacgttaattggtttagttaacttcgttacgtaacgtaataacggtaaacctaacgttagacgtaccggaccgtaaccggacgtaccgtaccttagttagttacgtggtcggacggtggtacgtggttcggaggtacggaccggaccgcccggtccccgtaggtccgtaccgggtcggggaccccgggtaacccg

SEQ ID NO: 31053 - DNA, 757 bp, Homo sapiens
  misc_feature: GYAE6OF01C99YI.41.78.H01.1.454.CMB.1.raw
  modified_base (343)..(343): a, c, t, g, unknown or other
  misc_feature (343)..(343): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttaatttaaaaggtgtccactgtgagatgtaccgtggtggagtcgtggagggcggcttgactccgacgggtcccggggggtccctggacgacctctactagtgtgccgagtcccgttcgttaggtttaaggtgtaccgtaggtagaacctaactacatgacgtcgttcgggttcccnccgagtacgttccgaagggaacgcgcgtaggtaagtcgggtctacgtagtttacttacgtaccggtacgtacggtaacctacctttacgtacctctaacgtaccgtccggtaggacgggtcctagttcacgtacgtactccgtacgaggtaccgtacggtacctaccgtaaataacgttagttacgttagttactacgttacgaactagtaacggtaactaacgttaggaacgtaacggcccggtaacgtacccgtaaccggtaccgttagttaatttaacggttcggaggtaccgggtaacgggtagttaaccgggttggaacgggtacgggaccggggtaccccgtaccccggggtacccgtcgggtaacccgggtacccgggtccggggggtacccccgggttaacccggg

SEQ ID NO: 31054 - DNA, 642 bp, Homo sapiens
  misc_feature: GYAE6OF01BL3Z9.41.78.H01.1.454.CMB.1.raw
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctgggtggagtctgggaggcggcttgactccgaggccgggggggtccctgagactctcatgtgcagcctctggtttaagtgtcagtagacactacatgagcgtggttcccgcagacttccgaggggaaggcgctaggagtgggtctntagttatttagtaccgngtggaacctaccttactactcacgtcctccggtgggacgggacctatcacgtacatcctcgacgagacgtcgacctaaatatattgtattatcttgacatacgaacacgttgaagacgtacgacgactaccggtcccttagttattagttaggcggtacgggacgggtacgtaggtttggggaaggggtacgggacccgggaccccggtaaccccgggtccccgtacgggtaccgggtaaccccggggttccggggggggcccccggggttaaacccccggg

SEQ ID NO: 31055 - DNA, 846 bp, Homo sapiens
  misc_feature: GYAE6OF01E12VQ.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagcgtgcgttttccttagttgtctaattttaaaaggtgtccactgtgagatgtacctggtggagtctggaggcggcttgatccgagggcccgggggggtccctgacgacctctccagtgtgcctacgccttcgttaggttaagtgtacagtacacacgtacagtgacgtccgtcggttcccgacgtaacggtacttaccggtaaacggggaacggccggacggtagggtaaacgttcgggtttacctaccgttaagttttaacgtttaccgtaccggtccgttaacgggtaaccttacccgttactaccgtacgtacgtaaccgtccggtagggacgggtcccgtaagtacgtatacctactccgtaccgtaaggaccggtaaccgtaccgtaaccctaaagttaacgttagttagtttagtacttcgttacgtaaccgtaacgtacgtaaacgtaaccgtaaggaaccggtaacccggaacccggtaacccggtaaacccgtaacccgggttacccgtttaacgtttacgttaacggtttcggtacggtacgggtaacgggtacggttacggggttaacggggtacggggtaaccggggaacccgggtcccccgggtaaccccgggtccccgggttacccgggtacccgggttaaccccgggggttaccgggggggtacccccggggttaacccccgggg

SEQ ID NO: 31056 - DNA, 810 bp, Homo sapiens
  misc_feature: GYAE6OF01DKW3C.41.78.H01.1.454.CMB.1.raw
  modified_base (225)..(225): a, c, t, g, unknown or other
  misc_feature (225)..(225): n is a, c, g, or t
tcagtctatactatcacgaccggtgctcgatttagtgtgagtagtttgggtttgggggggagaggagcccagcactgggactccgaggtgttccattcggtgatcagcactgaacacagaggactcaccagtggtagtttggctgagtctgtcgttttccttgttgtacttaagttttaaaaggtcgtccactgtagagtatgtaccgtgggtggagtcgtgggnggcggtcttgacgtccgacggggtcccggggggtccctagtacgaccttctacgtagtgtcgcacggtccgttacgtttaggtttaagtcggtactaggtaacgaactactacgagtgacgtcgtccggttacccgaccgaagtacgttccggaagggacggcgtacggtaggtaagtcggtctacgttagttaacgtttacgtaccggtacgtacggtaaccctaccgttactacgtaccgaacgtaccggttccggacgggtaccgggtacctaacgttactacgtacctacgttacccgtaccgaacggtaaccggtacgtaacccgtaaactaaacttaagttagtttacggttagttaccttctaaggaactttaacgaacgtaaacctaagttacggaaacggcggtaacccggaccgtaaccgtaccggttaccgttagttaacgtttcgttgggacgggtaccgggttagggtggttaagggttcgggtaaggaccggggttacccggacccggtaaccccgggttcccgggccgtaccgggtacccgggggtccgggggaccccggtttacccggg

SEQ ID NO: 31057 - DNA, 909 bp, Homo sapiens
  misc_feature: GYAE6OF01CY70Q.41.78.H01.1.454.CMB.1.raw
  modified_base (270)..(270): a, c, t, g, unknown or other
  misc_feature (270)..(270): n is a, c, g, or t
tcagtctatactatcacgaccggtgctcgatttagtgtgagtagtttgggtttgggggggagaggagcccagcactgggactccgaggtgtttccattcggtgatcagcactgaacacagagactcacatggagttttgctgagctgtcttttccttgttgtcttaatttaaaaggtgtccactgtgagtatgtaccgtgggtggagtcgtgggacggcgtcgttagacgtccggacggggtccccggggggtcctagacgtactcctanagttgtcgcgtacgtccttacggtttaggtttaaggtcgtacgtaacggtaacgtaacctaacctaacgagtaggtaacggtccggttcggtcccgaccgtagtaaccgttaccggagggaacgtcgacggtaggtaagtcgggtactagttagttaacgttacgtaccggtacggtacggtaaccgttacccttcgtaacctaccgaacgtacccgtacgggttacggggaccgggtaccgtacgttaccgtacgtaccgtactacccggtaccgaacggtaaccgtaaccggtacccgtaaacgttaaacgttaacgttaggtttacgttacgtttaacgttaccgttaacgtaacgtaacgttaaaccggtaaacgtaaccggtttaacggaaccggtaaccgggtaccccggaaacccggtaaccggtaaccccggttacccggtttaaaggtttaccgttaaacggtttcgggtaacgggtacggggtaaccgggtacgggttaacgggttaggggttaaccggggtaccgggggtaacccggaccccggtaacccccgggtaccccgggtacccggggtacgggtttaccccggggggacccggggggttaacccccgggttaaccccggggg

SEQ ID NO: 31058 - DNA, 685 bp, Homo sapiens
  misc_feature: GYAE6OF01ADM11.41.78.H01.1.454.CMB.1.raw
  modified_base (221)..(221): a, c, t, g, unknown or other
  misc_feature (221)..(221): n is a, c, g, or t
  modified_base (303)..(303): a, c, t, g, unknown or other
  misc_feature (303)..(303): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgcttaattttaaaaggtgtccactgtgagatgtaccgtggtggagtctgggaggcggnttgatccgagggccggggggtcctgacgactctcatgtgcgtagtccttcgttaggtttaagtcgtacagtagactacgtanagtgacgtcgttcggtcccgctagtacttccggaaggggtacggccgtcgtagggtaacgttcgggtcttacgtagtttatttacgaccggtcgtacggaaccttaccttctacgtacgacgtccgtcggtagggaccggggcttatccgattacgactccgtacgaacggtacgaccgttaccgaacctaaattaagttacgttgttacgttattaccgtagaacgtagtaaacgtaacttaacgtaggacgaaccggaccgaccgaacgtcccgtacccgttagttacgttcgttagtcggtacggaggtcgtaggttcggagggcgtaccggcccgtaccggtccgtacggcggtacgggtcccggggccggtacccgg

SEQ ID NO: 31059 - DNA, 688 bp, Homo sapiens
  misc_feature: GYAE6OF01C3WR7.41.78.H01.1.454.CMB.1.raw
  modified_base (388)..(388): a, c, t, g, unknown or other
  misc_feature (388)..(388): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttaattttaaaaggtgtccactgtgagatgtacctggtggagtctgggaggcggcttgatccgagggcccgggggggtccctggacgactctcatgtgcagtcctgttaggtttaagtgtcaggtagactactacatgagcgtcggttccgccagtagtccgaggggaagcgcgtggaagtgggtctctagttactttagaccgcgtagggaacctaccttntacctcaacggtacctcggtggacggggctagttcacgttcatcctaccgagacgtaccgtacgacctaaagttaacttagtgtttagttaacttcgttagactaagtacgaaactaagttgaagtaccggaccgacgtaccgaccggtcccgttagttatttacgttgggtacgccgggtagggccttagggtttagggtacggggtaagggaaccgggtccccggacccgggtccccccgttaggggtacccgttaacccggggtcggggggggtaccccccggggttaaaaccccgg

SEQ ID NO: 31060 - DNA, 917 bp, Homo sapiens
  misc_feature: GYAE6OF01CITYI.41.78.H01.1.454.CMB.1.raw
  modified_base (683)..(683): a, c, t, g, unknown or other
  misc_feature (683)..(683): n is a, c, g, or t
tcagtctatactatcacgaccggtgctcgatttagtgtgagtagtttgggtttgggggggagaggagcccagcactgggactccgaggtgtttccattcggtgatcagcactgaacacagagactcaccatggagttttggctgagctgtcgttttccttgttgacttaatttttaaaaaggtgtaccaactgtagagatgtaaccgtggtggagtcgtagggaggcggcttagaactcccgaacgggcccggggggggtccctaggacgaccttacgtccaagttggtacgacgaaccgtcccgttacgttagggtttttaaaggtagttaccgaagtaacggaactaaccgtaactagtacggacgtaccggttacggttacccgaccgtaaacggtaacgtttacccggaaagggggtaaaccggtccggacgttaaggggtaaacgttcggggttaaccttaacgttagttttaaattttaccggtaacccggtacggttaacgggaaaccttacccgtttaacctaaccgtaccgtaagtaaccgttcccgggttaggacgggggtacctacgtttaccacttacctaacttcccgtaacccgtaacggaacgtacccggttaaccgtaaacgtaaaacgttaaactaagtttggtttaacgttagttaccggttaanaacgtaagttaacgaaaccgttaacttgggaaacgaccggacccgaaaccggtacgtacccggttaaccctttaggttaacttttaacggtcggttacggtaagggtaacgggtccgtttaacggggttagggtaggggtaaaccggggacccggaccccggtaacccgggttccccggtaaggttcccccgggaaggggtaccccggggggtaccccggggttaaaccccggg

SEQ ID NO: 31061 - DNA, 788 bp, Homo sapiens
  misc_feature: GYAE6OF01BCC8F.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttaattttaaaaggtgtccatgtgagatgtacctggtggagtctggaggcggcttgactccgagggcccgggggggtccctgagactctcatgtgcagtcctcgtaggtttaagtgtcagtagacactacatgacgtcgttcggttcccgccaaggtacttccggaagggggaacgggcgtcgtagggaacgttggggttacctacgttaagttttaacttttacgtacccggtcgttaacggggaaaccttaccctttacgttaacctaccgtaacggtaccttaccggggtagggtaaccgggggtccgtaattttccgaattccgacttcctaccgaaggtacgaccggtaccgaacctaaattaacttagtttcgtttagttaactttcgttagtaacgtagtaacgtaaacttaacgttaggaacgacggtacccggaaccggtaaccgtacccggttacccgtttagttaacgtttagttcgggttacgggccgggtagggggttcgtaagggtttgggtacgggggacgggtaccgggccccggtaaccccgggtccccggtacgggtacccgggtaccggggttcccgggggggaacccccgggttaacccggg

SEQ ID NO: 31062 - DNA, 845 bp, Homo sapiens
  misc_feature: GYAE6OF01CGE5V.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttaattttaaaaggtgtccactgtgagatgtaccgtggtggagtcgtgggaggcggtcttagactccgacgggcccgggggggtcctggagactctcagtgtcgcagtccttcgttaggtttaagtgtcagtagacactacatgacgtcgttcggttcccgaccagtacttaccgaaggggaacgcgtcgtaggtaagtgggttctacgttaagtttactttaacgtaccggtcgtacgggaaaccctacccgtttaccttaacgttccaacggtacccgtccgggtacggggtaaccgggggtaccctaaggtttacctaacttactaacttcccgtaccgaaacggtacgggaacccgtcccgtaaacctaaaattaagttaagtttaggtttacgttaactttcgtttaacgactaacgtacggaaaaccttaacggttaggaaccgggtaaccggacccggaaacccgtaacccggtaacccggtccctttaaggttaacgtttaacggtttgggaccgggtacccgggaagggggttacccgttaggggttggggtaacggggtacggggaaccccgggtacccccgggtaaccccgggtcccccgggttaggggttaacccccggtaccgggggtaccccgggggggggtacccccggggttaaacccccggg

SEQ ID NO: 31063 - DNA, 743 bp, Homo sapiens
  misc_feature: GYAE6OF01ASSG6.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagggccggggggtccctgagactctcatgtgcagcctacgaggtttaagtgtcaggtagacactacatgagcgtcggttcccgccgaagtacgtttcccgaaggggaacggcgtcgtagggaacgttggggttcctacgtaaggttttaacgttttaacgtacccggtcgttacgggtaaaccctacccgtttacctaaccgttccgaacggtaccgtccggtaggggaccggggtacccgtacgtttccacgttctagttccctaccgaggaacgtaccggtcgaacccctaaagttaacttagttgtttgttaactttcttagactagtacgtaactaacgttacggaagtacgacccgaaccgtaccgaccggtcccttgttaagtttacgttcggtcgtaccgggtacgggtacgttagggtttaggtcggggacgggtacccgggtcccggaccccgggtccccggtagggtacccgtaccggggttccggggggaccccgggttaaccccggg

SEQ ID NO: 31064 - DNA, 852 bp, Homo sapiens
  misc_feature: GYAE6OF01AT5TJ.41.78.H01.1.454.CMB.1.raw
  modified_base (712)..(712): a, c, t, g, unknown or other
  misc_feature (712)..(712): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttcttgttgtcttaagttttaaaaggtgtccactgtgagatgtaccgtggtggagtcgtggacggcggtcttagacgtccgacgggccgggggggtccctggacgtactctcacgtggtgcacgtccgttcgttaggtttaagtcgtacgtaagtaacgacctaactacagtaggacgtccgttcggtcccgaccgtagtacgttaccggaggggaacggccggtagtagggtaacgttcgggttccttacgttaagttttacgttttaccgaccggtacggtaacggtaaaccttaccgtttacctaccgtacgtaccggttaccgttaccggtacggggtaccgggtaccgtttacgttaccctactacgtaaccttccgtaaccggtaacgaacccgggttaaccgtacccgttaaaacccttaaaagtttaacgttacggttttaaggttaccgttttatttaccggttaacgtaacttaaggttaacggtaaaccttacgggtacggtaacgggtaaccgaaccccggtaaacggtacccggtacccggttnttttaacggttacgtttacggttaggacgtacgggggtacggttacgtaggggttggacggggtacggaacccggcccggtaccccggtcccgggtacgaccggggttcccggggtcccgggggaaccccggtacccggg

SEQ ID NO: 31065 - DNA, 828 bp, Homo sapiens
  misc_feature: GYAE6OF01D0EBB.41.78.H01.1.454.CMB.1.raw
  modified_base (266)..(266): a, c, t, g, unknown or other
  misc_feature (266)..(266): n is a, c, g, or t
tcagtctatactatcacgaccggtgctcgatttagtgtgagtagtttgggtttgggggggagaggagcccgagcactgggactccgaggtgtttccattcggtgatcagcactgaacacagaggactcaccatggagttttggctgagctgtcgttttccttgttgtcttattttaaaaggtgtccacttgtgagatcgtacctggtggagtcgtaggaggcggtcttgatccgagggcccggggggtccctgagctctcagtgtncagtcctgttacggtttaagtgtcgtaagtacgacctaactacagtcgagtcgttcggtccgcctagtacgttccgaagggacggcgcgtggtagttcgggtactcgtaagttttattacgtaccggtacgtacggtaaacctacctttactaactacgtacgtaccgtccggtagggacggggtccctagttactactaccgtacttaccgtacccgaggtaacgtaccggttacgaacccttaaacgttaaagttacgttaggttttacttaactttacgtttacgaactaacgtaacccggttaaacgtaacgttaacggaacggtacccggaaccccggtaaccggacccggtaaccccgggttaccccttagggtttaaccgttttaaggtcggttaacggtaccggggtacgggttaccggttaagggttacgggggttaagggaacccggggtaacccgggtccccggaaacccccggggttcccccgggttagggtacccccggtttaaccggggggtaccccggggggtacccccgggggttaaacccccggg

SEQ ID NO: 31066 - DNA, 880 bp, Homo sapiens
  misc_feature: GYAE6OF01CM60J.41.78.H01.1.454.CMB.1.raw
  modified_base (305)..(305): a, c, t, g, unknown or other
  misc_feature (305)..(305): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtccgttttccttgttgtcttaattttaaaaggtgtccactgtgagatcgtaccgtggtggagtcgtggaggcggcttgactccgagggtccggggggtcctgagactcgtcagtgtgctagtccttcgttaggtttaagtgtcagtagacactanagtgacgtcgtcggttcccgaccagtacttccggaagggaacggcgtacgtagggaacgttcgggttacctacgttaagtttaactttaaaccgtaccggtacggttaacgggtaaacccttaacccgttttacctaacctaccggtaacgtacccgttccgggttaggggaaccgggggtacccgtaacgtttacgaacgttaccgtacttacccgttacgacccccccggaaggtacccgtaaccgaacccgttaaattaaacgttagtttagtttacgttacgttacgttacgtaacgtaacgtaacgtaaacgttaaaccgttaacggtaaacggtaaccggacccggtaaacccggtaaccggtaacccgggttacccgttaacggtttaacgtttaacggttacgggttacgggtaccgggtaacgggtacgggttaacgggttaggggttacggggtaaacggggtaacccggggacccgggtaccccgggtacccccgggttacggggtacccgggtttaacccgggggtacccgggggggtaaccccgggggttaaacccccgggg

SEQ ID NO: 31067 - DNA, 725 bp, Homo sapiens
  misc_feature: GYAE6OF01DMHY5.41.78.H01.1.454.CMB.1.raw
  modified_base (567)..(567): a, c, t, g, unknown or other
  misc_feature (567)..(567): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggtagtttggctgagctgtcgttttcttgttcgtacttaagttttaaaggtcgtaccacgtgtgagtatcggtaccgtgggtaggagtccgtagggacggccggtcttgacgtacccggacgggggtccccggggggttcctaggacgtacttccgtacgtagttcggtcgaccgtacgtcccgttaggtttaaggtttaacgtcgttacgtaacggtacgtaacctaacctaagtaacgtggtaccgtccggttccgggtacccaccgtacgtaaccggttaccgggaagggtaccgcggtacggtagtaggttcggtactagttacgttataccgccggtcgtaacgtacttaccttcactgacgtccgtaggaggtacgtctatactactctactcgtacgacgtacgtacgtaccaattaatattacgttnttagtattcaagtacaagttacgaacgtgtagaccgacgacccgcgtaccgccgtattacttgtacgtcgtaggacggtacgtggtaggtagggccggacggtacccgaccgggtcccgtcgtacggaccgggttccgggacccggggtcccgtaccg

SEQ ID NO: 31068 - DNA, 760 bp, Homo sapiens
  misc_feature: GYAE6OF01CLLM1.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttaattttaaaaggtgtccactgtgagatgtacctgggtggagtcgtgggaggcggcttgactccgagggcccggggggtccctgagactctcatgtgcacgtccttcgttaggtttaagtgtacagtacgaactactacagtgacgtcgttcggttcccgccgtaagtacgttacccgaaggggaacggccgcgtagggaagttcgggtactacgtagttttatttacgtaccggtcgtacgggtaacctaccgtttcctaacgttacgaacgtacccgttcggtaggggtacggggccgtaacttccactcctactccgtacccgacggaccgtaaccgtaccgaaccctaaaattaagttaagtttgtttaagttacgtttcgttagtaactaagtaacgaaacttaaacgttaggaacggaaccgcccggaaccgtacccgtacccgggttcccttaggtttactttaaggttggtacggacgggacggtcggtaggtttgggagggtagggacccgggacccggacccgggtcccccggtgggtacccggttcgggggtcccggggggtacccccgggttaaccccggg

SEQ ID NO: 31069 - DNA, 697 bp, Homo sapiens
  misc_feature: GYAE6OF01C0SNY.41.78.H01.1.454.CMB.1.raw
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (361)..(361): a, c, t, g, unknown or other
  misc_feature (361)..(361): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
  modified_base (446)..(446): a, c, t, g, unknown or other
  misc_feature (446)..(446): n is a, c, g, or t
tcagtctatactatcacgaccggtgctcgatttagtgtgagtagtttgggttggggggagaggagcccagcactgggactccgaggtgtttccattcggtgatcagcactgaacacagaggactcaccagtggtagttttggctgagtctgtcgttttccttgttgtacttaagtttaaaggtcgtaccctatgtgagtatgtaccgtggtaggagtcgtggaggcgtcgttgactccgacgggcccgggggtcctggtanactctagngttgngccgagtccttagttaggtttaagtcgtacgtagtaactatacctatagtgacgtcgtcgtcccgacgagtacgttccgaaggacgngcgtagagtgtactgttataacgttacgacgtcgtacggtaactaccttctacncgtaacnccggttacggtacggacgacgttntacgattacgactaccgtacgtacgagttaccgacgtaacgtaataacgttagtgttagtacttacgtagaacgtaccgtaagtaaccaggttaacgacggtacgaccggaaccgtaccgtacccgtacttagttacgttcgtacggttaggccggtagggtcgttagggtccgggttaggaccgggaccggtacccgcccggtacccggtaccggccggtaccgggtccggggaacccgggttacccggg

SEQ ID NO: 31070 - DNA, 854 bp, Homo sapiens
  misc_feature: GYAE6OF01CP39P.41.78.H01.1.454.CMB.1.raw
  modified_base (216)..(216): a, c, t, g, unknown or other
  misc_feature (216)..(216): n is a, c, g, or t
  modified_base (613)..(613): a, c, t, g, unknown or other
  misc_feature (613)..(613): n is a, c, g, or t
tcagtctatactatcacgaccggtgctcgatttagtgtgagtagtttgggtttgggggggagaggagcccagcactgggactccgaggtgtttccattcggtgatctagcactgaacacagaggactcaccatggtagtttgctgagcttgtcgttttccttgttgtacttaattttaaaaggtcgtccactgtgagtatcgtaccgtgggtaggngtacgtgggaggccggtcttgactccgacggggtcccggggggtcctaggacgactctactagttgtcgcacgtcctacgtttaggtttaagtcgtacgtaagtaacgaactacctagtagtcggtacgtcgttcggtcccgacgacgttacgtaccggaggggacgcgtacggtaggtaacgttcggttacttacgttaagtttaacgttaccgtaccggtacggttaacggtaacccttaccgtttacctaaccgtacgtaccgtacggtaccggtacgggtccgggtaacctgttacctacgttacctactaaccgttaccgaacggtaaccgtaacccgtaccgtaaaccttaaagttaattacggtttacgttacgttacttaccggtttanacttaacgttaaccgaaacgttacgttaaggaccgaaccgttacccggaaaccgtcccggtaaccgggtttacccttaagggttaaactttcgggtaacgtccgggacggtaaggggttcttaaacgggggttggaccgggggtaaacggaccccggggtaccccgttacccgggtccccgggtaacggttcccggggtaacccgggggttccccggggggtaacccggttaacccccggg

SEQ ID NO: 31071 - DNA, 769 bp, Homo sapiens
  misc_feature: GYAE6OF01B0GC4.41.78.H01.1.454.CMB.1.raw
  modified_base (266)..(266): a, c, t, g, unknown or other
  misc_feature (266)..(266): n is a, c, g, or t
tcagtctatactatcacgaccggtgctcgatttagtgtgagtagtttgggtttggggggaggaggagcccagcactgggactccgaggtgtttccattcggtgatcagcactgaacacagaggactcaccatggagttttggctgagctgcgtttccttgttgctaattttaaaaggtgtccactgtgagatggtacctggtggagtcgtggaggcggcttagatccgaggccggggggtcctgacgtactctacagttggcgacncgtccttcgttaggtttaagtcgttacgaagttacgaactaaccttacgatacggtacgcgttggttcccgaccagtacgttacccgaaggggaacgcgacgtggaagtcgggtactagttacgttaactttacgaccgtacgttacggaaaccttaccgttacttaaccgtcgtaaacggttcctacggtacggtaccgggaccgtaacttcaacgttccaagtcctaccggtagacgtaccgttaccgaactaaattaagtagttagttacgtattacgttaagtactaagttacgaacgttaaccgttaggaacgtaccggtaacccggaacgtaacccggtaccggtaccccgttgttaactttaccggtacggttacggaccgggtacgggtaccgtagggtaggttaacggggaaccggtaccgggtacccggtaccggtacccggttacgggaccggttaccgggttcccggggggaacccgggttaacccccggg

SEQ ID NO: 31072 - DNA, 894 bp, Homo sapiens
  misc_feature: GYAE6OF01ALTZQ.41.78.H01.1.454.CMB.1.raw
tcagtctatactatcacgaccggtgctcgatttagtgtgagtagtttgggtttgggggggagaggagcccagcactggactccgaggtgtttccattcggtgatcagcactgaacacagaggactcaccagtggtagttttggctgagctgtcgttttccttgttgtacttaagttttaaaaggtgtccactgtgagatcgtaccgtggtgagtcgtgggaggcggtcttgacgtccgacggggtcccgggggggtccctggacgtacctccgtacgtacgttggtacgtccgtacggttcccgtttacggttttaagggtttttaaacgttcggttaaccgtaacggtttaaccggaaaccctaaccgttaaccggtagttacggtaacgtccggtttccggttccccgaccgtaaggtaaccgttacccgggaagggtaaccgggccgtacggtagggtaacgttcgggttaccttacgttaagttttactttaaccgtacccggtacgtaaccggtaaccttaccctttactaccgtcgaacgtaccggtcggtacgggaccggggtcttaagttccgtaacgtcctaccgtacccgtacgtaacggtaccggtacccggtacccgtaaacgttaaacttaagttacgttttcgtttaggttacttaccgttaggaaaccttgtaaacgtaaccgtaagttacggaacggaccgacccggaacgtacccggtaccggttccttaagggtttactttcggtacgggtacggcggtaacggggtcggttaacgggttcggggtaaacgggacgggtacccggtaccccggtacccggtcccgggtacggtaacgggtaccccggggttcccggggggaacccgttaccccggg

SEQ ID NO: 31073 - DNA, 783 bp, Homo sapiens
  misc_feature: GYAE6OF01B2YRM.41.78.H01.1.454.CMB.1.raw
  modified_base (178)..(178): a, c, t, g, unknown or other
  misc_feature (178)..(178): n is a, c, g, or t
  modified_base (291)..(291): a, c, t, g, unknown or other
  misc_feature (291)..(291): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggngtccactgtgagatgtacctggtggagtcgtggaggcggcttgactccgagggcccgggggggtccctggacgactctcatgtgcagtcctcgttggtttaagtgtctagtanactactactagtgagcgttggtcccgccagtacttccgaggggaggcgcgtaggaatgggtctntagttactttanaccgngtacggtaactaccttctactcacgaccgttcggtgggacgggtccgtaatttcacgttaccacgttccctaccgaacggtacgtacccggtacctaacccgtaaatttaaacgttgtttacggtttcgttaactttcgttagtaccgtaataacggtaaacttacgtttaggaacggtaaccggcccgtaaaccgaacccggtaaccccggtccctttaggttttaactttaggtttcgggtacggtaccggggtaaggggtacgttacgggggtttaggggtagggggaaacccggggtaccggtacccccgggtaacccccggggtcccccgggttaccggggtaaccccgggtttaccgggggggtaccccgggggggtacccccgggggggttaaacccccccggg

SEQ ID NO: 31074 - DNA, 845 bp, Homo sapiens
  misc_feature: GYAE6OF01BHQSG.41.78.H01.1.454.CMB.1.raw
  modified_base (493)..(493): a, c, t, g, unknown or other
  misc_feature (493)..(493): n is a, c, g, or t
tcagtctatactatcacgaccggtgctcgatttagtgtgagtagtttgggtttgggggggagaggagcccagcactgggactccgaggtgtttccattcggtgatcagcactgaacacagagactcaccatggtagttttggctgacgctgtcgttttccttgttgtacttaagtttttaaaaaggtcgtaccctacgttaggttagaagtagttacgtacccgttgggtggtaggtccgttgggagggtccggtagtttaggacgtccggaccggggtcccgggggggttccctaggacgtaccttctcgtagtgtcgacgtaacgtccgttacgttaggtttaagtcgtacgtaggtaactaactaaccttaacgtagtcgacgtcgtcggttacccgccgagtacgttaccgaggggtaacgccgtagtaggtaacgttcgggtctacgtagtttacttacgaccgtcgtacggtactaccgtctaaccntacgtcctacggacggtacggacctagtactacgtactatcctacgacgacgtaccggtacaacgtaacttaagttagttagttacgttacgttcttaacgaacgttaagaaccgtaaacctaggttaaccggaacggtaaccgaaacccggtacccgtaaccggtaaccgggttacccgtttaaggtttaacgtttacggttacgggtaccggtacgggttacggacggttaacggggtttggggaaagggtccccgggtaaccggaccccccgggttaccgggtacccccggtaccgggtacccgggttaccggggtaacccggggggtacccccggttaaaccccgggg

SEQ ID NO: 31075 - DNA, 887 bp, Homo sapiens
  misc_feature: GYAE6OF01DQR11.41.78.H01.1.454.CMB.1.raw
  modified_base (352)..(352): a, c, t, g, unknown or other
  misc_feature (352)..(352): n is a, c, g, or t
tcagtctatactatcacgaccggtgctcgatttagtgtgagtagtttgggtttggggggagaggagcccagcactgggactccgaggtgtttccattcggtgatcagcactgaacacagagactcacagtggtagttttgctgagtctgttcgttttccttgttgtacttaaagttttaaaggtcgtcctacgtgtagtagtacgttcgtaccgtggtggtagttcgtagggcggcgtacgtagacgtccggacggggtcccgggggtcctagacgtacttcgtcgtagtcgtcgacgtacgtccgtttagttaagggtttaacgtcgtaacgtagtaacgtactaacgtanagtcgacgtcgtacggtccacgtagtacgtaccggaagggacgcgtacggtaagtcggttcgtcgttacgttacgtttaacgtaccgtcggacgtaaaccggttaaccttaccttaacgtacgtacgtaccgtaccggtccggtacgggtaaaccggtccgtttaacgtacccgtaagtccgtaacgtccgtaacccggtaagtaccgtacccgttaaccgtaacttaaaacgtttaagttaacgttttagtttacgtaacgtttacgttaacggtaaccgttaacgttaaaccggtaaccctttaagggaccgtaacggtaacccgacccggtaaccgtaaacccggtaccgtttcgtttaaggtaccgttttaacggtcggttaaccgggttacgggtaccggtacgggttaaacggttgggaaccgggtaccgggccccggtaccccggttacccgggtccccggttaaccgggttaacccggggttaaccccggggtaaccccggggggtaaccccgtttaacccccgggg

SEQ ID NO: 31076 - DNA, 1080 bp, Homo sapiens
  misc_feature: GYAE6OF01ATQCJ.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggtagttttggctgagctgtcgttttccttgttgcttaattttaaaaggtgtccactgtgagatgtaccgtggtggagtcgtgggaggcggtcttgactccgacgggcccgggggggtccctggacgactcctcatgtgcagtccttcgttggtttaagtgtcagtacgactactacatggacgtcgttcggttcccgcaggtacttaccggaaggggaacggcggtacgtagggaagttcggggtccttacgtaacgtttaacttttaacgacccggtacgttacgggtaaacctacccgttttactaaccgttaccgtaacggtaacccgttcccgggtaggggtacccgggggtacccgtttaactttacccgtaacttaccgtaaccgtttcccttaacccggtaaccgggttaaccgggtaaccccgggttaccccgtaaaacccccgtttaaaaagtttaaaaccgtttaacggtttttacgggttttaacggttttaaaccgttttaccggttttaaaccggtaaacccgtttaaacggtttaaacccggttaaaaacccgtttaaaacccgggtttttaagggaaacccgggttaaacccgggtacccccggggtaaaaccccgggttaaccccgggttaaacccccgggtttaccccccggtttaaggttttaaaccgttttttaacgggtttaccggggttaacccgggggtacccggggttaaaccggggggtaccgggttttaaccgggggtttacggggtaaaccgggggggttaacgggggtaaacccccggggtaccccccggggttaaacccccgggggttaccccccccggggtttacggggttaaaccccccgggggttttaacccccgggggggttaacccccggggggggggttaaaccccccccggggggtttaaaccccccggggg

SEQ ID NO: 31077 - DNA, 726 bp, Homo sapiens
  misc_feature: GYAE6OF01CAXW0.41.78.H01.1.454.CMB.1.raw
  modified_base (669)..(669): a, c, t, g, unknown or other
  misc_feature (669)..(669): n is a, c, g, or t
  modified_base (697)..(697): a, c, t, g, unknown or other
  misc_feature (697)..(697): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggtagttttggctgagctgtcgttttccttgttgtacttaagttttaaaaggtgtccatgtagagtagtcgtaccgtggtggacgtcgtgggaggcgtcttgacgtccgacgggccggggggtccctggacgactctacgatgtcgacacgtccgttgttaggtttaagcgtacgaaggtacaacactaacgagtcggacgtccggttacggtccgaccgtacgttacgttacggaacggggtaacggcgtaccgtaggtaaggttcgggtacgttacgttaagtttaacgtttacgtacccggtagtaccggtaaacctcctttacgtaacctcgtaacgtacccgtaccggttagggaacccggggtcctacgttactactcgtactccgtacaacgtacggtaccgtaccgaaactaaagttacttagttagttaccttagttcggtataactagtaaacgaactagtagaacgaacgaccgtaacgacgtccggtccttagttactacgttgacgtggtaacgtgtggttagngggtaccggcgaacccgtccggtaccgnggtacgtaccgggtcgggcccggtaaccg

SEQ ID NO: 31078 - DNA, 944 bp, Homo sapiens
  misc_feature: GYAE6OF01BT2WI.41.78.H01.1.454.CMB.1.raw
  modified_base (324)..(324): a, c, t, g, unknown or other
  misc_feature (324)..(324): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccagtggtagtttggctgagtctgttcgtttttccttggttgtacttaaagtttttaaaaggtcgtacctacgttggtggtaagtattcggttaaccgttgggttagggtacgttcggttaggggagggtccggtcgttacgaacgtccggacgggggtccccgggggggttccctagtaccgtaccttccgtacngtcggtcgacgtcgttccgttagttttaggtttaaggtcgttagtaacgtaacgtaccgtaacctagtaagtggtacgttccgggttacggttccccgaccggaacgttaccggttaccgggggaaagggtccggccggtggtaaaggttacggtttcgggtaccttgtttaaacgttttagttaaccggtccggtacgttaaacggtacccttacctttactaccgtacgacgttacccggtcgggtacgggtaccgggtacctaacgttacgtaccgttaccgtacgtttacccgtaccgggtacggtaccgtaacccgtttacccggaaactttaaaatttaacgtttaggtttacgtttagttttaccttacttaaacgtacgtaacttaaacggttaacgttaaccggtggaacccgggaacccgttaccgggaacctaaccccggggttaccgttttaccgtaggtttttaagtcggttacggtccggggtaaacgggttacgggtacgtttgggggttaggggtacgggacccccgggtagaccccccggagggttccccgggtacgggttaccggggtaccggggggtcccggggtaaccccccggggttac

SEQ ID NO: 31079 - DNA, 885 bp, Homo sapiens
  misc_feature: GYAE6OF01DTU3E.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactagaacacagaggactcaccagtggtagttttggctgagctcgtccgttttccttgttcgtacttaaagttttaaaaggtcgtcctacgtgtgagtatcgttaccgtgggtggagtcgtgggacggcggtcttgagtccggacggggtcccggggggtccctagacgtaccttcgtacgtagttggtcgacgtacgtccgtttacggtttaggttttaaacgtcgtacgtaaggtaacgtaacctaacttacgagtgtacggtcgttccggttcccgaccgtagtacgttacggacgggacggtccgtagtaggtaagttcggtactagttaagtttacgttaacgtaccggtcggtaacggtacctacgttctaacgtcgaccggtaccggtcggtacgggaccgggtctaacttcctacgtcctactaccgtaccgaacggtacgtaaccggtccctaaaattaaacgtacgttagtttacggttacgtttaacgtccttaacgaacgttaagtacccggtaaacgttaacgttagggaacccgaaccggtaacccggaccggtaaacccggttaccccggttaacgtttacggtttaacgttacgggtttacgggacggggtaccgggtacgggttaacgggttgggtttaccgggggaacggggtacccggggcccggtacccccggtacccccggggttacccggtaccgggttaacccgggggttcccgggggttaaccccggggggaccccgggtttaacccccggg

SEQ ID NO: 31080 - DNA, 781 bp, Homo sapiens
  misc_feature: GYAE6OF01BA5UK.41.78.H01.1.454.CMB.1.raw
  modified_base (356)..(356): a, c, t, g, unknown or other
  misc_feature (356)..(356): n is a, c, g, or t
  modified_base (535)..(535): a, c, t, g, unknown or other
  misc_feature (535)..(535): n is a, c, g, or t
  modified_base (590)..(590): a, c, t, g, unknown or other
  misc_feature (590)..(590): n is a, c, g, or t
tcagtctatactatcacgaccggtgctcgatttagtgtgagtagtttgggtttgggggggagaggagcccagcactgggacctccgaggtgtttccattcggtgatcagcacagaacacagaggactcacagtggtaggttttggctgagtctggttcgttttccttgttgtacttaaagttttaaaaggtcgtacctacgtgtgaagtattgtaccgttgggtggagtcgtgggaggtcggtcgttggactccggacgggggtcccggggggttaccctggaacgctctactagtggtcgactacggtccttggtttacggtttaagtgtacgtaagtaacgaactaccgttacngtaggtacgtccggttcggttaccccgaagagtaccggttacggaaggggccgacgtacgtagggtacgggttcggtaccttagttaaaggttttacttacggtaccggcggttacggtaaccttacccgttcgtaactccggaacggttacctacccgggtaggaccgggtaacgttnttaccacgtctacgtacctaacggacgtacgtaccgactaacgtaataacggttnttaacgttagtactttagtactaacggtataacgtaacgagttaacgacgtacggtaccgaaccgtacccggtacctacgtagttagttcgtaacggtcggtacggaggttccggtgggtacggtagggacggcccgacggacccgggtccgacgggtccggaaccgggtcccggggcccggtaacccggg

SEQ ID NO: 31081 - DNA, 746 bp, Homo sapiens
  misc_feature: GYAE6OF01D9RL7.41.78.H01.1.454.CMB.1.raw
  modified_base (186)..(186): a, c, t, g, unknown or other
  misc_feature (186)..(186): n is a, c, g, or t
  modified_base (619)..(619): a, c, t, g, unknown or other
  misc_feature (619)..(619): n is a, c, g, or t
  modified_base (675)..(675): a, c, t, g, unknown or other
  misc_feature (675)..(675): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggtagttttggctgagctgtcgttttccttgttgtacttaagttttaaaaggtntcctactggtgagtatggtaccgtgggtggtagtcgtgggagggccggtcttgacgtcccggacgggggtcccgggggggttccctaggacgtactctctagtcgtgcgacgtccttcggttaggttagtcgtacgtagtacgactactaatacgtagtacggtccgttcggttaccccgactaggtaaccttaccgggaagggggtaaccggccggtacggtagggtaacgttcgggtacttaacgttagttttaactttacgtacccgtcggtaacggtaacctccgttactaccgtacgtacgtaccgtacgtacgggaccgggtaccgtattaccaagttcctacgttccgaccgagtaccggtaccgactaaactaagtaacttagtggtttactagtttctagtaactagtactaaagtacgtaggngaaccggaccgacctacgcgtccttattagtgttggcgcggtagggtatggggttnaggggtccggaccggtcccgaccccggtcggttcggacgggtcccgggggtaacgggtccccgggtaaccg

SEQ ID NO: 31082 - DNA, 744 bp, Homo sapiens
  misc_feature: GYAE6OF01B3LMB.41.78.H01.1.454.CMB.1.raw
tcagtctatactatcacgaccggtgctcgatttagtgtgagtagtttgggttttgggggagaggagcccagcactgggactccgaggtgttccattcggtgatcagcactgaacacagaggactcaccatggagttttggctgagctgtcgttttccttgttgtctaattttaaaaggtgtccacgtgtgagatgtacctggtggagtcgtggaggcgcttgactccgagggtcccggggggtccctggacgacctctacgagtgtcgacacggtcccttcggttaggttttaaggtgttacgtaacgtacggtaacctaacctaacagtggacgtccggttcggttcccgacgtaacgtacgttaccggaaggggaacggcggtaccgtagggtaagttcgggtctacgttaagtttaattaccgtaccggtcgttaacggtaacctaccgttctaacgtacgacgtaccgtcggtacgggacgggtactatacctacgtcacgtcctacgacgtacgtaccgtacgactaaagtaacttagttagttagtacttcgtagactaagtacgtaactacgtacgtaacgacggaccgaccgaccgtaccgtacccgttagttacttacgttggtacggtacgggtacggtacggttaggttagggtaggggacggtaccgggacccgtacccggtcccggtacggtaccggtaaccggggtccgggggtaacccgggtacccggg

SEQ ID NO: 31083 - DNA, 807 bp, Homo sapiens
  misc_feature: GYAE6OF01EFHYS.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggtagtttttggctgagcttgtcgtttttccttgttgtctttaattttaaaaggtgtccacttgtgagatgtaccgttggtggagtcgtgggaggcggtcttgactccgacggggtcccgggggggtccctgacgtactctacagtgtgcacgtccttagttggtttaagtgtacgagtacgacaactacgatgagtcgttcggttcccacgaggtacgtttccggaacggggaaggccgtcgtagggtaacgttgggtcttacgtagttttaagtttacgaccgtacgtacggtaaccttaccttacgtacctcgacgtaccgttcggtcgggaccgggtaccgtattacacgttctacgtcctacggaacgtacgtaccgtaccgaacctaaagtaacttagttcggtttagttaacgtttcgttaagacttaagtaacgtaaaccgttaacgttggaaacggtaaccggacccggaaacccgtaacccgtacccggttacccgtttagtttaaacgttttacgttggtacgggtacgggtaacggggtcgttaaggggtttggggtacgggacggggttaccgggacccccggtacccccgggtcccgggttaccgggtacccggggtttaacccggggtccgggggggtaacccccggggtaacccccggg

SEQ ID NO: 31084 - DNA, 720 bp, Homo sapiens
  misc_feature: GYAE6OF01CZQTX.41.78.H01.1.454.CMB.1.raw
  modified_base (179)..(179): a, c, t, g, unknown or other
  misc_feature (179)..(179): n is a, c, g, or t
  modified_base (601)..(601): a, c, t, g, unknown or other
  misc_feature (601)..(601): n is a, c, g, or t
  modified_base (609)..(609): a, c, t, g, unknown or other
  misc_feature (609)..(609): n is a, c, g, or t
  modified_base (635)..(635): a, c, t, g, unknown or other
  misc_feature (635)..(635): n is a, c, g, or t
tcagtctatactatcacgaccggtgctcgatttagtgtgagtagtttgggttgggggggagaggagccagcactgggactccgaggtgttccattcggtgatcagcactgaacacagaggactcaccatggtagttttggctgagctgtctttccttgtgtacttaagtttaaaggtcncctatgtagagtactgtaccgtggtggtagtcgtgggacggtcggtacttgacgtccgggtacggggtcccgggggggtcctaggtaacgcttaccgtcagtcgtgaccgtcgtccgttagttaggttagtcgtagtacgaacgtactacgtaacgtgtacggacgtcgttcggtcccgaccgagtaccgttacggaaggacggtcggtcggtaggtacgtggtctacgttagttaacgttacgaccgtacggtaacggtacctaccgttacgactacgtacgtccggtggtcgggacggtacctatacgtactgtactccgacgtacgtacgacgtacaacttaatagtacgtgttatactgtaccatacgaactaacgtagtaggaccgacggtaccacggtaccgtccggtaattacgngtttacgngggtaccgaggtaggtccgttagggnggtacgggacccgggcccgtaacccggggtcctaccccggggttacgacgggtccccggggtaccgggggacccggttaccccgg

SEQ ID NO: 31085 - DNA, 861 bp, Homo sapiens
  misc_feature: GYAE6OF01CVDGI.41.78.H01.1.454.CMB.1.raw
  modified_base (361)..(361): a, c, t, g, unknown or other
  misc_feature (361)..(361): n is a, c, g, or t
  modified_base (524)..(524): a, c, t, g, unknown or other
  misc_feature (524)..(524): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcacatggtagtttgctgagctgtcgttttccttgttgtacttaagttttaaaaggtcgtaccctagtggtaggagtattacgtaccgtgggtggacggttcgtagggacggcggtcttacggacgttcccggaacggggtccccgggggggttccctaggaacgtcctcgtactagtgttcggactacggtccgttagttagggtttaacgtgttacgagtaacgactaactacngtgccgtacgttcggtcccgacgtacgtacgtccggaacgggagtaccggtgtaggtacggtacggttctacgttaacgtttattaccgacgtagtaacggtacttacgtttactacgtaccgactaccgtacgtacgggtcgggacgggtaacctacgttanaaccgttcgtaaccgttcccgaccggtaagtaacccggggaaacccgttaccgaaaacccgttaaagtttaaacgttacgtttacgggttttacgtttaaacgttaccggtttaacggaaagtttaaccgtaaaaccggttaaacggtaaacgttaacgggaccggaaaccggtacccgaaccccggacggtacccgtaacccgtttagttacgtttagtacccggtgggtaacgggtcgggtaccttaaggggttggtacgggaccggtacgggaccccgaacccccgggttcggtaccggtttccggggaccccgggttcgggggtacccccggg

SEQ ID NO: 31086 - DNA, 785 bp, Homo sapiens
  misc_feature: GYAE6OF01B3UVH.41.78.H01.1.454.CMB.1.raw
  modified_base (641)..(641): a, c, t, g, unknown or other
  misc_feature (641)..(641): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttaagttttaaaaggtgtccacttggtgagattcgttaccgtgggtggagtcgttggggaggtcggactttgactccgacggggtcccgggggggtcccctggacgaccttcgtctaagtgtcgactcgtcctcgtttggtttaagtgtactagtacgactactacgtatagacgtccgttcggttacccgccgtaaggttacgttacccggaagggggaacggcgtacgtagggtaacgttcggggtctacgttaagttttaacgtttacgtaccggtacggttacggtaaccttacccgtttctaacgtacgtaacgtccgttccggtgggacggggtacctaacgttacacttcctacgttccgtacgacgtacgtaccgtacacctaaatacttagtgttactattctagactagtacgaactacgttagacggacgtacccgaacggtaccgaccggttaccttaggttnttaacggttgggtaggaccgggtacggggtacggttggtttaggggaccggggtaacggggaccggtccccgaaccccggggtcccggttcgggacccggttacccgggggtaccggggggtacccccgggggttaaccccggg

SEQ ID NO: 31087 - DNA, 835 bp, Homo sapiens
  misc_feature: GYAE6OF01D2VI4.41.78.H01.1.454.CMB.1.raw
  modified_base (289)..(289): a, c, t, g, unknown or other
  misc_feature (289)..(289): n is a, c, g, or t
  modified_base (543)..(543): a, c, t, g, unknown or other
  misc_feature (543)..(543): n is a, c, g, or t
  modified_base (657)..(657): a, c, t, g, unknown or other
  misc_feature (657)..(657): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctggacgtctgtcgtttttccttgttgacgttaatttttaaaaggtgttccacttggtagagattcgttaccgtggtacgggagttcgtgggaggccggtcttgacgtcccgacgggtcccggggggttccctaggacgtaccttcncgtagtcgtgctagtccttggtttaggtttaagttgtaccgtaagttaccgaactaacctagtaactggtacgtaccggttcggtttaccgactaacggtaccggttaacggaaggggaacggtcgtccggtaaggtagttcggttaccttattaggtttaacttaaccgtaccggcgttaacggaacccttacgttacctacgtacctaaggttacccgtcggttacggggacggttaccgtatttcgtaacnccttacgttccgaacctaaccggtaacgtccgttaaccaacttaaattacgttaactttgggttttactagtttaccgggtacttaacaaggttaacgtaaaacccttggtaanaacgggtaccacccgggtaactacccggttaccgttacccgtttgttaacgtttcggtcggtaaccgggcgggttaaccgggttcgtaaaggggttccggggaaacgggcgttaccccgggacggaccccggtccttaacgggaccccgttgggggtccccgggtaacgggtcccccg

SEQ ID NO: 31088 - DNA, 819 bp, Homo sapiens
  misc_feature: GYAE6OF01CQTPV.41.78.H01.1.454.CMB.1.raw
  modified_base (190)..(190): a, c, t, g, unknown or other
  misc_feature (190)..(190): n is a, c, g, or t
  modified_base (616)..(616): a, c, t, g, unknown or other
  misc_feature (616)..(616): n is a, c, g, or t
tcagtctatactatcacgaccggtgctcgatttagtgtgagtagtttgggttgggggggagaggagcccagcactggactccgaggtgtttccgattcggtgatcagcactgacacagaggacctcaccatggagtttgctgagctgtcgttttcttgttgtacttaagtttaaaggtcgtccactggtnagtagtcgtacgtgggtggtacgtcgtaggacgggcgcgttagactccgacggggtcccgggggggtcctaggacgtacctctacgtagtggtcgacgtacgttcctgtttagggtttaccgtagtccgaaggtacaaccgtaactacgtagtcgacgttcgtacggttacccacggttaacgtacgtaccggtaaacggggaccgtcggtaccggtagggtaaacggttccgggtttacctaaacgttacggtttttacgttaaccgtaccgggtaccgtaacggtaacccttaccgtttaccgtactacggaacgttccgtacgggttacggtacgggccgttaattaccagtacctactccggtaactaggtacccgtacgaccgtaaacgtaataacgttaagttgttacgttacttcgtanacgtacgtaacgaactagttcgaactccggaccggaccgtaccggaccggttacgttagtttacgtagttaggggtcgaacgggtcggtacggtacgggttcgggtacggggacgggacccgtaccggtacccccgggttacccgggtaccggtccgggttacccggggtaaccccggggggttaccccggttaacccccggg

SEQ ID NO: 31089 - DNA, 846 bp, Homo sapiens
  misc_feature: GYAE6OF01BUDH2.41.78.H01.1.454.CMB.1.raw
  modified_base (184)..(184): a, c, t, g, unknown or other
  misc_feature (184)..(184): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggtagttttggctgagtctgtcgttttcttgttgtcttaattttaaaaggtntcctactgtgagatgtaccgtgggtggagttcgtgggacggcggtcttgactccgacggggtcccgggggggtcctggagtcctcctacacgtgtcgcgtacgtccttacgttaggttttaaagtcgtacgtaagtaacgacctaactacgattacggaacgtccggttcggtaccccgacgtaacggtaccgttaccggaaagggggtaacggtcggtacggtacgggtaaggtttcggggttcctttaacggttaagttttaacgttttaaccgtacccggttacgtaaccggggtaacctttaccccgtttacgttaaccgtaccgtaacgtaccggttacccgggtacggggaccggggtcctacgtttcacgtcctaattcccgaccgaacggaacgtacccgttaccgtaacccgtaaaattaacgttagtttgtttaagttaacgtttcgttaccgtacgaattaaccgtaagtaaccgtaggaacgtacggaccgtacccgggaccgtaccggttaccttcttaagttcgttggcggtaacgggtggtccggtaagggttcgggacgggtaccggggtaccggccccggtacccgggttcccggtacggggtacccggttaccgggggtcgggggaaccccgggttaccccggg

SEQ ID NO: 31090 - DNA, 818 bp, Homo sapiens
  misc_feature: GYAE6OF01CZHM9.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggtagttttggctgagcgtgtcgttttccttgttgtactttaagttttaaaaggtcgtcccacgttgtagacgtagttcgtaccgtgggtaggagtcgtgggaggcggtcttgacgtccggacggggcccggggggtcctgacgactctcagtgtgactcgtccttgttaggtttaagtgtacgtaagtaacgacctaactacagtgacgtcgtcggttcccgacgtagtacgtacggaagggtacggcgtacgtaggtaacggtcggttactacgtttaagtttacgttacgtaccggtacggtaacggtaaccttaccgtttactaccgtacgtaccgtaccggtccgggtacgggaccgggtaccttagttaccgactacgtacgttacccgacgaaggtaaccggtaccgtaccgtaacttaaaagttaattgtttagttacttacgttacgtacgaaactacgtaacgtaaacgttacgtaacggaaccgtaccggacccgtaaccggtaaccgacccgttacgttagtttacgttacggttcggtacggtaccgggtagggtccgttaaggggttcggggtaaaggggccgggtacccgggaccccggttaccccgggtccccgggtacgggttacccgggtacccggggggtcccgggggaccccggtttaaccccggg

SEQ ID NO: 31091 - DNA, 643 bp, Homo sapiens
  misc_feature: GYAE6OF01EN6UH.41.78.H01.1.454.CMB.1.raw
  modified_base (417)..(417): a, c, t, g, unknown or other
  misc_feature (417)..(417): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgtttttccttgttgcttaattttaaaaggtgtccactgtgagatgtaccgtggtggagtcgtggaggcggcttgatccgagggcccgggggggtccctggagactctcatgtgcacgccttgttggtttaagtgtacagtagacactacatgagtcgtcggttccgccagtacgttccgaaggggaaggccgacgtgggaagttcgggtctcgtaagtttatttacgtaccgcgtaggaactaccttctactcagaccgtccggnggacggggtcctaagttcactcactcaccgagacgcgtacgacctaaattaactatgtttatacttcttagactatacgaactaacgttagaagacggacccgtaacggaccgtaccggtcccttagttatttgttggtacggcggtagggcgtaggtttgggagggacggacggccgacccgggtccccgtgggaccgtcgggtcggggggcccgggtaccccgg

SEQ ID NO: 31092 - DNA, 910 bp, Homo sapiens
  misc_feature: GYAE6OF01CHONP.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagagactcaccagtggtagttttggctgacgcttgtccgtttttccttgttagtactttaaagtttttaaaaggttcgtaccctagttaggtaggagtacttacggttaccgttggggttaggtagttcggtaggggcgggtccggttcgttacgtacggtccggaccgggggtcccgggggggttacctaggacgtaccttcgtacgtagttgtcgacgtacgttccgttacgttttaaggtttacggtcgtacgtaagtaacggacctaactaacgtagtaggtaccgtcgttccggttaccgacgtacggtaccgttacggaagggacggtcggtacgtaaggtacggttgttccgttaacgtttagtttaacgtttaccggtaccgtaccggttaaccggtaaccttaccgtttacgtaaccgtacggtacggtttacccggtcgggtaacggggtacccggttacgtaacgtttacgtacctaccgtacgtaccggtaccgaaccggttaaccgtaaccggtaaccgtaaacgttaaacgttaacggtttaacgtttgtttaacgttacgtttacgttacgttaagtaaacgtaacgtaaactaaggttacgacggtaaccggacccgtaacggcccggttaacgttacgttagtttagtacgttaggcgggtacgttaggtcggttaaggttggtaacggggtacgggacccggtaccggtaccccgggtacggtacccgggttacgggtaacccggggtacccggggtaccccgggtaacccggg

SEQ ID NO: 31093 - DNA, 731 bp, Homo sapiens
  misc_feature: GYAE6OF01A3QKD.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccgggggggtccctgagactctcatgtgcagccttcgttggtttaagtgtcagtagacactacatgagtcgtcggttccgaccgagtacttaccggaaggggaacggcgcgtagggaagtcgggtctacgtagtttaattttacgtacccggcgttacggaaacctaccctttactactcgaacggtaaccgtccggtagggacggggacccgtattccgattcctactccgtaccaaggtacgaccggtaccgaccctaaaattaacgttagttgttagttattccgttagaactatacggtaaactaagttggaacgaccggtacccgaaccgtaaccgaccgggtacccttaggttaactttagttggttacggaccgggtaaggggtaccttaggggtttgggtacggggaacggggtacccgggaccccggtaccccgggccccgttacggggtacccgtacccggggtacggggggggtcccccggggtaaacccgg

SEQ ID NO: 31094 - DNA, 945 bp, Homo sapiens
  misc_feature: GYAE6OF01A95BZ.41.78.H01.1.454.CMB.1.raw
tcagtctatactatcacgaccggtgctcgatttagtgtgagtagtttgggtttggggggggagaggagcccagcactgggactccgaggtgtttccattcggtgatcagcactgaacacagaggactcaccatggtagttttggctgagctggtacgttttccttgttgtattaacgttttaaaaggtcgttccacgtgtagatagttacgtacgtgggtagagttccgtaggggaggtccggtactttacgaacgttcccggacgggggtcccgggggggttccctaggacgtacctcctagtagtggtacgacgtacgtcccgttagtttacgggttttaagtacgttcggtaacgttacaacccgtaactaactagtaggtaaccgtccggttcgggttacccccgagtaacggttacgttaccgggaacggggacggccgtaggtagggaacgttcggtaaccttaggttaatttacgtttaccgacccgtaggtaacggtaccttaccgttcctaacgtcgtaaccgtaccggtcggtaaccggggtaccgggtaacccttactcgtaacctacctacgttaccgtaccgaaggtaacccgtacgtaacccgtaaactaaaggtttaacttaggtttagttaccggtttactttaacggtaacctaacggtactaaacgttaaaccgttaacggtacggtaacggtaacccgtaacccggtaaaccggtacccgttaacccggtaccgttttaacgttacgttaccggtttagggtaccggggttaccggtaggggtttaaaccggttgggggttacggtaaccgggggttaacccgggaaaccccgggtccccggtttaacccgggtacccgggtaccgggttaccccggggttaaccccgggggggtaccggttaacccccggggggttaacccccgg

SEQ ID NO: 31095 - DNA, 1071 bp, Homo sapiens
  misc_feature: GYAE6OF01CCEWN.41.78.H01.1.454.CMB.1.raw
tcagtctatactatcacgaccggtgctcgatttagtgtgagtagttttggggtttggggggggagaggagcccagcactgggactccgaggtgtttccattcggtgatcagcactgaacacagaggactcaccatggtagttttggctgagctgttcgttttccttgttgtcttaagttttaaaaggtgttacctattgtgagtattcggtaccgtgggtggagttcgtgggagggcggtcttggacgtccggacgggggtcccgggggggtccctggaacgtaccttccgtactagttggtcgaccgtacggtcctttacggttttagggtttttaagttacggttaccgtaaaggttaacgtaaccttaaccgtaactagttacggacggttccggttccggggttaccccggaccgtaaggtaccggttacccggggaagggggaccggtaccggtacggtgggtaaacggttcggggtacttacgtttaaggtttaacttttaacgtacccggttacggttaccgggtaacctttaacccgtttacccgtaaccgttaccgtaaccgggttacccggttacccggggtaacggggtacccggggggtaacccgttaactttacccgtaacttacccttaaccgtttacccgtaaccggtaacggttaaccggtaacccggttaaacccgtaaaccgtttaaaaacgttaaaccgttttaagtttacggtttttaacgttaacgttttacggttaaaccggtaaaccttaaggttaaaccgtaaaccgtttaaaacggttcggaaaacccgggtaacccgggtaaccccggggtaaacccgtacccgggttaaacccgggtttacccgtttaaaggttttacgtttaaacgggtttgggaaaccgggttacgggggtaacgggttaccgggtttaggggtttacgggggaacggggtaaccggggggttaccccgggtaccccgggtaccccggggtttaccggtacccgggttacccgggggttaccgggggtacccgggggggtacccccggggtttaaccccggg

SEQ ID NO: 31096 - DNA, 730 bp, Homo sapiens
  misc_feature: GYAE6OF01E1AEQ.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggtagttttggactgagctgtcgttttccttgttgcttaagttttaaaaggtcgtccactgtgagattcgtacctggtggagtcgtgggacggcggtcttcgacgtccgacggggcccggggggttccctggacgtactcgtcagtgtcgctacgtccttcgtttaggttaacgtgtacgtagtacgacactacgtagtcgacgtcgtcgttcccgactacgtacttaccgagggaacgcgtacgtggtaagttcggtctaccgttagttacgttacgtaccgtcgtacggtaacctaccttctactacgacgtaccgtcggtacgggacgggtaccgtattaccagtacctactccgtacacgtacgtaccgtcgaactaagttactagttacgttagtcttactacgactaacgtacgtaaacgtagttaacggaccgtaacggacccggaaccggtaccgtacccggttacgttacttacgtttacgtggtacggtcggtaacggttacgtggttacggacgggtacgggacccggtaccgacccggtcccgtacgggaccccgttcgggggtaccgggtccccgggttacccgg

SEQ ID NO: 31097 - DNA, 773 bp, Homo sapiens
  misc_feature: GYAE6OF01CMMOK.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctaattttaaaaggtgtccactgtgagatgtaccgtggtggagtctggaggcgcttgatccgaggccggggggtcctggagtactctcatgtgcagtccgtcgttggtttaagtcgtacgagtacgaactactactatggagtcttcggttccgcaagtactccgaagggtacggcgcgtaggaacgttcgggtactcgtaagttacttaacgtaccgtcgtacggactaccgttctacctacgacgtcctcgtaggacgggtacatttcgactcaacgttcctacgaggaacgtacgtaccaaccgtaaagtaacttagttcgtttagtactttacgtacgtaactaacgttaacgtaaaccttaacgttacggaacgaccggttaacccggaaccgtaccggtaccccggtccgtttaacgttaacgtttaaacggttcggtaacgggtaccggggtaacgggtaacggttaacgggtttggggaacggggtaacccggggtcccggtaacccccgttacccgggggttacccccggtaacggggttaccccggtttaacccgggggaccccggggggggttaacccccgggttaaaccccccgggg

SEQ ID NO: 31098 - DNA, 848 bp, Homo sapiens
  misc_feature: GYAE6OF01C6NRD.41.78.H01.1.454.CMB.1.raw
  modified_base (293)..(293): a, c, t, g, unknown or other
  misc_feature (293)..(293): n is a, c, g, or t
tcagtctatactatcacgaccggtgctcgatttagtgtgagtagtttgggtttgggggggagaggagcccagcactggactccgagtgtttccattcggtgatcagcactgaacacagagactcaaccatggtagttttggctgagctcgtcgttttccttgttgacttaagttttaaaaggtcgtcctacgtggtagagtagtacgttaccgtggtacggagtcgtagggacggcggtcttacgacgtaccggacggggtcccggggggttccctaggacgtaccttcctanacgtgtgacctacggtccttagtttacggtttaaggtgtaacgtaggtaacaaccgtaactaacgtagtaagcgtacgttaccgggttaccacgacgtaacggttacggacgggtaacgtacgtcggttaagggtaaggtgggttcctaagttacgtttacgtttaccgacttaccggtacggtaaaccctaccctttcgtaaccgtaccgtaacgtaccggttaccggtacggggtaccgggtacctaacgttactacttaccgtacgtaccgtaccccgaaggtacccggtaaccgtaacccgtaacgttaaacttaatttacgttagtttaaccggttatttaacgttaacgaaacgttaacgtaacgtaaacttacgttagaaccgtacggaaccggaccgtaccggtaccgttaccttgttaactacggttcgaagggaccggtagggccggtttaggtacgggtcgggaaacgggtcccggtacccgacccgggtacccggttacgggacccggttccgggggtacccggggacccggttaacccgggg

SEQ ID NO: 31099 - DNA, 777 bp, Homo sapiens
  misc_feature: GYAE6OF01CFTEK.41.78.H01.1.454.CMB.1.raw
  modified_base (621)..(621): a, c, t, g, unknown or other
  misc_feature (621)..(621): n is a, c, g, or t
tcagtctatactatcacgaccggtgctcgatttagtgtgagtagtttgggttgggggggagaggagcccagcacgtgggactccgaggtgttccattcggtgatcagcactgaacacagaggactcaccagtggtagtttggctgagctgttccgttttccgttgttgtacgttaaagtttaaaaggtcgtacctacgtggtaggagtagttgttaccgtgggtacggtagtcggtagggacggtcggtccgttagacgtccggacggggtccgggggtccgtagacgtactcgtacgtagttggacgacgtacgtccggttacggtttaaggtttaacggttcggtacgtaagtaacgaactaacttacagtaggtacgtcggttaccggtcccgtacgtaaacgtacgtaaccgggaagggtaccggacgtcggtaggtacggtacggtacgtacgttaacgtttacgtaaccgtacggtaccggtaacggtaacctaccgttactacgacgtaacgtcgtacggtacgggcggtacgtatctacgtctacgtctaacgagtccgtaacgccaagtaatagttacgtagttctaatcgtagaactacgacgtaactagngtaacgccgtacggaccgtacggaccgttccgtagttacgttaggtcggacgtagggtacggaacggtttcggagggaccgggtacgggacccggtaccgggtaacccggtccgacgggtaccggtcccggggtccggggtacccggtaccccggg

SEQ ID NO: 31100 - DNA, 799 bp, Homo sapiens
  misc_feature: GYAE6OF01BOR7S.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacgagaggactcaccatggtagttttggctgagctgtcgttttcttgttgtacttaagttttaaagtcgtccacttgtagagtagtcgtaccgtggtggtagtcgtggaggtcggtcttgactccggacggggtcccgggggtcctaggacgtacctctacgtagttggtcgcgtacgtcctttacggttaggtttaacgtgtacgtagtacgaactaactatagtacgacgttcggtccggttaccaccgtacgttacggtaacggaggggaacgtcggtaggtaggtaacggtcggtacttacgtttaatttacgttacgaccgtacggtacggtaacccttcttacgtaccgtacgacgttcgtacggtacgggtaccgtacgttctaacgtctactacgtccgtaccgtacgtacggtaccgtacgtaaactaattaagttagttcggtttacgttacgttagtaactaacgtaacgttaacgtaacttaacgtacgaacggtaaccgtaccggaaccgtaccggtacccgttaaccgttagttaacgtttcggttacgtaacgggtccgggtaagggttaccggttagggtacggggtaacggccgggaacccggtcccggtaccggtccgggtaccgggtacggtccgggggtacccggggtaaccggtaccccggg

SEQ ID NO: 31101 - DNA, 767 bp, Homo sapiens
  misc_feature: GYAE6OF01CZVHJ.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggtagttttggctggagctgtcgttttccttgttgtcttaattttaaaaggtcgtccacttgtgagatcgtaaccgttggtggagtcgtagggaggccggtacttgactccgacgggtcccggggggtcctgagactctcatggtgcacgccttagttaggtttaagtgacgtagtacgaccaacctatactggtacgtcgttcggttaccaccgtagtacgttaccggagggaacgcgtcgtaggaagtggttactatacgtttaattacgtaccgcgtacggtaactacctttactacttccgaaggtaacccttccgggtagggaccggggtcttaacgttacacgtacctatacctaccgaaggaccgtaccgtaccgaaactaaacttaagttacgtttggttactaatttccttaaaccggaatacgttaaacgacttaaaccgttcggaaagaccgggtaacccggacgaacccggtaccggtaccgtttaacttagtttaggtttccgacgggtaccggtagggttactagggttggttaaccgggagggaaaccccgccgggtaacccggtccccgaaggggttacccgttaacgggggaccccgggggtccccggttaaacccgg

SEQ ID NO: 31102 - DNA, 854 bp, Homo sapiens
  misc_feature: GYAE6OF01AMWRN.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaaccacaggaggactcaccagtggtagttttggctgagctcgtccgtttttccttggttgtacttaagttttaaaacggtcgtacccgtactggtgaagtagttcggtaccgtgggtggtagtcgtgggacggtcggtcttagaccgtccggtacgggggccccggggggttcctaggtacgtaccgtctacgtagttgtcgacgtacgtccgttcggtttaaggtttaaggtcgttacgaacggtaacgtacctaccgtaactagtacggtaccgtccggttccggtacccgaacgtaacgtaccgtaccgggaagggtacggtcggtacggtaggtacggttccggtaccgtacgtttaacgttttacgtttaaccgtcccggttacgtaacccggtaccgttaccctttaccgtaccgtaccgtaaccggtaccgttaccggggacgggtaaccgggtaccttacgtacctacgttacctacgtccgtacgtaggaccgtacccgtacgtaaacctaagttacttacggttcttagttacttcagtaccgtaatacgtaacgttaccgtagaccggacgacccggtaacgaccgtcggttactacggttatttacggacgcgggtacggtgggttacggtggttagggcggggtaaccggcccggttccccgaccccgggtttcgtacccgggtaccggggttaacccgggggcccgggggttaaccccggtacccgg

SEQ ID NO: 31103 - DNA, 827 bp, Homo sapiens
  misc_feature: GYAE6OF01BUE52.41.78.H01.1.454.CMB.1.raw
  modified_base (264)..(264): a, c, t, g, unknown or other
  misc_feature (264)..(264): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggtagttttggctgagtctgtcgttttccttgttgcttaatttaaaggtgtcctactgtgagtatgtacctggtggagtcgtggaggcgcttgactccgagggcccggggtcctgagactctcagtgtcacngtccttgtagtttacgtgtactagtagactactacacgtgtacgtccgttacggtccccgacgtaacggttacgttaccggaacgggggaacggtccggtacgttacgggtaacgttcggggttaccttacgttaaaggttttactttaaccgtacccggtaccgtacgggtaacccttaccgtttaccctaacttaccgaaccgtccgttaccggacgggtaaccgggggaccttacgttaccaagttaccgtaccgttccgttacccgaaggtaaccggtaccgttacccgtaacccgttaaaattaacgttacgtttggttaacttaccgtttacgttaccgtaacgtaacgttaaccgaaacgttaacgttagaacggtaccggaccccgtaacgaccgtaccgttcgttaacggttacgtttacgtttcggcggtaccgggacgggttacgtaggggttcggtacggggacggaccccgggtaacccggtacccgggtccccggtacgggtacccggttaccgggggtccggggggtacccccgggttaaaccccggg

SEQ ID NO: 31104 - DNA, 754 bp, Homo sapiens
  misc_feature: GYAE6OF01A75DV.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggtagttttggctgagctgtcgtttttccttgttgtcttaatttttaaaaggtcgtcccaacttggtagagattgtaccgttggggtggtagtcgtgggagggtccggtcttgacgtccgacggggtcccggggggtcctggacgtctcctctagtcgtcgcgtacgtccttcgttaggtttaagtcgtacgaagtacgaaccaactacataggacgtcggttccggttccgacctaggtaccttaccgggaaaggggaacggtccgacggtagggtagttcgggtactatagttttacttacgaccgtcggtacggtaccttaccgttctacgtacacgttccggtacggtgggaccgggtaccttagtccactcgtactccgtacgaagtaccgtaccgaccgtaactaaacgtaattagttagttacgttacgttactacgtaactacgtaacgtaacgtacgttaggaacgaccggacgaacccgtaccggaaccgttaccgttagtttacttagtcgggtaggccggtaggtcgtaggttagggacggtacggaccggtcccggacccggtcccggtacggtcccggttacggggcccggggtaacccggtcccggg

SEQ ID NO: 31105 - DNA, 530 bp, Homo sapiens
  misc_feature: GYAE6OF02HM742.41.78.H01.1.454.CMB.1.raw
tcagtctatactatcacgaccggtgctcgatttagtgtgagtagtttgggtttggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctgagactctcatgtgcagcctctggtttaagtgtcagtagacactacatgagctggttccgccagattccagggaaggcgctggaatgggtctcagttatttataccgctgggaacaccttctactcagactccgtgagggccgattcatcatctccagagacgtcgccaataatatgttgtatctttgacatgaacaacttgagagccgacgacacggccctgtattattgtgcgaggcgagttgtggaggaggccacggcccctggcctacgtcggggccgggtaacccg

SEQ ID NO: 31106 - DNA, 529 bp, Homo sapiens
  misc_feature: GYAE6OF02G4W2N.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttccgccagattccagggaaggcgctggaatgggtctcagttatttataccgctggaacaccttctactcagactccgtgaggggccattcatcatctccagagacgtcgccaaataatatgttgtattcttgacatgaacacttgagagccgacgacacgccctgtattatgtgcgaggcaggttgtggaggaggccacggcccctggcctacgtggggcccggtaacccgg

SEQ ID NO: 31107 - DNA, 538 bp, Homo sapiens
  misc_feature: GYAE6OF02HTKVI.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctgagactctcatgtgcagcctctggtttaagtgtcagtagacactacatgagctggttccgccagattccagggaaggcgctggaatgggtctcagttatttataccgctggaacaccttctactcagactccgtgaggggccattcatcatctccagagactcgccaaataatatgttgtattcttgactatgaaacaattgagagccgacgacacggccctgtattattgtgcgagggcaggttgtgggaggtaggccgacggcccctggccgtacgtgggggcccgggtaacccgg

SEQ ID NO: 31108 - DNA, 605 bp, Homo sapiens
  misc_feature: GYAE6OF02IMDG9.41.78.H01.1.454.CMB.1.raw
  modified_base (352)..(352): a, c, t, g, unknown or other
  misc_feature (352)..(352): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctgagactctcatgtgcagcctctggtttaagtgtcagtagacactacatgagctggttccgcagattccgagggaaggcgcgtggaagtgggtctctagttatttataccgntagggaactaccttctactcagactccgtgacggggccattcatcatccaccagacgacgtcgaccaaatactatgttgtattcttagactatacgaactaattagagtacgcccgaacgaccgaccggtccttaggtaacttagttcgtaggacggagggtcctaagggtttgtacggggaagggtaccggacccgacccgggtccccgtgggaccgttacggtccgggggggtaccccgggtaaccccggg

SEQ ID NO: 31109 - DNA, 624 bp, Homo sapiens
  misc_feature: GYAE6OF02J1QSM.41.78.H01.1.454.CMB.1.raw
  modified_base (275)..(275): a, c, t, g, unknown or other
  misc_feature (275)..(275): n is a, c, g, or t
tcagtctatactatcacgaccggtgctcgatttagtgtgagtagtttgggtttgggggtaggtagggaggcccgagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctggagactctcatgtgcagcctctggtttaangtcagtagacactacatgagctggttccgccagattccagggaagcgctggaatgggtctcgagtttatttataccgctgggaacctaccgtttctaacgtcaagaccttccggtgaacggggccctatttcagttcatcctccagacgaccgtcgccaataatatgttagtattcttgacatgaactacgttgaagtagaccgtagaccaccggtaccctggttaacttagtttgtacgccggtaaggggtccaggtttacggtggggaacgggtacggaccccgtaaccgggtcccccgtggggtacccgttaccggttaccgggggggacccccggggtaaccccg

SEQ ID NO: 31110 - DNA, 564 bp, Homo sapiens
  misc_feature: GYAE6OF02HP2K7.41.78.H01.1.454.CMB.1.raw
  modified_base (506)..(506): a, c, t, g, unknown or other
  misc_feature (506)..(506): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctgagactctcatgtgcagcctctggtttaagtgtcagtagacactacatgagctggttccgccagattccgagggaaggcgcgtggaatgggtctcgtagttatttataccgcgtaggactaccttctactcagactcgtgagggccattcatcatctccagagcgtcgaccaaataatatgttagtatcttgaactatagaacaacttgaagacgaccgaacgacgaccggcccttagtattaagttgtgacgaggcgtaggttgngggaggacggccgaccggccccgtggtcccgtacggtcgggggacccgggtaacccgg

SEQ ID NO: 31111 - DNA, 547 bp, Homo sapiens
  misc_feature: GYAE6OF02GRXPH.41.78.H01.1.454.CMB.1.raw
  modified_base (477)..(477): a, c, t, g, unknown or other
  misc_feature (477)..(477): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttccgccagattccagggaggcgctggaatgggtctcagttatttataccgctgggaacaccttctactcagactccgtgagggccgattcatcatctccagagacgtcgaccaataatatgttgtattcttgacatgaacaacttgagagccgacgacacggccctgtattattgtgcgngggctaggttggtgggaggacggcccgaccgggtccccgtggcctacggtcgggggcccgggtaacccgg

SEQ ID NO: 31112 - DNA, 651 bp, Homo sapiens
  misc_feature: GYAE6OF02HZDFU.41.78.H01.1.454.CMB.1.raw
  modified_base (262)..(262): a, c, t, g, unknown or other
  misc_feature (262)..(262): n is a, c, g, or t
  modified_base (546)..(546): a, c, t, g, unknown or other
  misc_feature (546)..(546): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagcgtgcgtttccttagttgctatttaaaaggtgtccactgtgagatgtacctggtggagtctggaggcggcttgatccaggccgggggggtccctgagactctcatgtgcagcctnttggttaagtgtcagtagacactacatgagctggttccgccagattccagggaagcgctggaatgggtctcgtagttatttacgaccgtcgtagggtaacctacctttctaacttcaacgaccttccggtggacggggtccgtaatttccaatccagttcctacccaaggacgaccgttccgaccaaattaattattgtttagtaattccgtttgactattacgaaactaacgttgacgacgcccgaacgaccgaaccggtcccttggttaacttagtttaggngtacgggtaacgggtcctaagggtttacggtgggaagggaccggtcccgaacccgggtccccgtagggcccgttaacggtccggggggaccccgggtaaccccgg

SEQ ID NO: 31113 - DNA, 545 bp, Homo sapiens
  misc_feature: GYAE6OF02HV8ER.41.78.H01.1.454.CMB.1.raw
  modified_base (392)..(392): a, c, t, g, unknown or other
  misc_feature (392)..(392): n is a, c, g, or t
  modified_base (418)..(418): a, c, t, g, unknown or other
  misc_feature (418)..(418): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctgagactctcatgtgcagcctctggtttaagtgtcagtagacactacatgagctggttccgccagattccagggaaggcgctggaatgggtctcagttattataccgctggacaccttctactcagactccgtgaggggccattcatcatcnccagagacgtcgccaataatatgttntattcttgacatgaacaacttgagagccgacgaccacgccctgtattattgtgcgagggccgtaggttgtgggaggacggccgaccggaccccgtggccgtacggtcggggcccggggtaaccccgg

SEQ ID NO: 31114 - DNA, 534 bp, Homo sapiens
  misc_feature: GYAE6OF02GTTP5.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctgagactctcatgtgcagcctctggtttaagtgtcagtagacactacatgagctggttccgccagattccagggaaggcgctggaatgggtctcagttatttataccgctgggaacaccttctactcagactccgtgaggggccattcatcatctccagagacgtcgccaataatatgttgtattcttgacatgaacaacttgagagccgacgacacggccctgtattattgtgcgagggcaggttgtgggaggaggccgacggcccctggcctacgtcggggccgggtaacccg

SEQ ID NO: 31115 - DNA, 564 bp, Homo sapiens
  misc_feature: GYAE6OF02JRDEZ.41.78.H01.1.454.CMB.1.raw
  modified_base (362)..(362): a, c, t, g, unknown or other
  misc_feature (362)..(362): n is a, c, g, or t
tcagtctatactatcacgaccggtgctcgatttagtgtgagtagtttgggtttggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggcccgggggggtccctgagactctcatgtgcagcctctggtttaagtgtcagtagacactacatgagctggttccgccagattccagggaagcgctggaatgggtctcagttattagtaccgctaggaacacctttnactcagactccgtagaggggccattcatcatctaccagagacgtcgcctaaataatatgttagtatacgttgactatagaactattagagagccagaccacggaccctgtatatgtgcgtagggcctaggttcgtagggtacggacggtccgaccgggcccccgtggccggttaccggtcgggggtacccggggtaacccgg

SEQ ID NO: 31116 - DNA, 534 bp, Homo sapiens
  misc_feature: GYAE6OF02HQHJK.41.78.H01.1.454.CMB.1.raw
  modified_base (494)..(494): a, c, t, g, unknown or other
  misc_feature (494)..(494): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctgagactctcatgtgcagcctctggcttaagtgtcagtagacactacatgagctggttccgccagattccagggaaggcgctggaatggggtctcagttatttataccgctgggaacaccttctactcagactccgtgaggggccattcatcatctccagagacgtcgccaataatatgttgtattcttgacatgaacaacttgagagccgacgacaccggccctgtattatgtgcgagggcaggttgtggaggnggcccgacgggcccctgggcctacggtggggaccccgggg

SEQ ID NO: 31117 - DNA, 548 bp, Homo sapiens
  misc_feature: GYAE6OF02GIBKK.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttccgccagattccagggaaggcgctgggaatgggtctcagttatttataccgctgggaacaccgttctactcagactccgtgaggggccgattcatcatctccagagacgtcgccaaataatatgttgtattcttgacatgaacaacttgagagccgacgacacggccctgtattattgtgcgagggcaggttggtgggaggaggcccgacgggccccgtggccgtacggtcgggggcccgggtaacccgg

SEQ ID NO: 31118 - DNA, 557 bp, Homo sapiens
  misc_feature: GYAE6OF02FXGVA.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttccgccagattccgagggaaggcgcgtggaatggggtctcagttatttataccgctagggaactaccttctactcagactccgtgaggggccattcatcatctccagagacgtcgaccaaataactatgttgttattcttgacatgaactaacttgagagcccgacgaccacggccctgtacttagttgtgcgagggctaggttgtgggaggaggcccgacggcccctgggcctacggtcgggggacccgggtaacccgg

SEQ ID NO: 31119 - DNA, 856 bp, Homo sapiens
  misc_feature: GYAE6OF02GQB2N.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccgggggggtccctgagactctcatgtgcagcctctggtttaagtgtcagtagacactacatgagctggttcccgccgagacttccgaaggggaaggcgcgtagggaatggggtctcgtaggtttatttactaccgtcgtacgggaaacctaccgtttactaacctcaacgtaccgttccggtaggacgggggaccctatttaccgaacttccgtaacttccttacccgaaggtaacggtaaccggttaccggtaacccctaaaatttaaacgttaacgtttagggttttacgttaaacgtttccgttttacggaaaccttaagttaacgggtaaaacctaaaccggttttagggaaacgggttaaccggtaaccccgggaaaccggtaaaccccggtaacccggggtacccccttttaagggtttaaacgtttttaacgtttcggggttacggtacccgggtaacgggggttacccgtttaaggggttttaccggggttaggggggtaaaccgggggaaccgggggttacccccggtaaccccggggttccccccggttaggggtaccccgggttaacccgggggtttacccgggggggggacccccccgggggttaaacccccggg

SEQ ID NO: 31120 - DNA, 556 bp, Homo sapiens
  misc_feature: GYAE6OF02GTAJO.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttccgccagattccagggaagcgctggaatgggtctcagttatttatacgctggaacaccttctactcagactcgtgaggggccattcatcatcctccagacgacgtcgaccaataatatgttagtattcttagactatagaactaacgttgagacgccgacgacgaccgtcctagtattatgtgcggaggcgtaggttgtgggaggacggcccgaccggtccccgtggtccgtacggtccgggggacccgggtacccgg

SEQ ID NO: 31121 - DNA, 552 bp, Homo sapiens
  misc_feature: GYAE6OF02GEC9A.41.78.H01.1.454.CMB.1.raw
  modified_base (354)..(354): a, c, t, g, unknown or other
  misc_feature (354)..(354): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttcccgccagattccgagggaaggcgcgtggaatgggtctcagtttatttataccgntagggaacacctttctactcagactccgtgacggggccattcatcatctcagacgacgtcgacaaataatatgttgtattcttgacatagaactaacttgagagccgacgacacgcctagtattatgtgcgaggctaggttgagggaggacggcccgacggcccgtaggccgtacggtcgggggcccgggtaacccgg

SEQ ID NO: 31122 - DNA, 580 bp, Homo sapiens
  misc_feature: GYAE6OF02H3Z0C.41.78.H01.1.454.CMB.1.raw
  modified_base (403)..(403): a, c, t, g, unknown or other
  misc_feature (403)..(403): n is a, c, g, or t
tcagtctatactatcacgaccggtgctcgatttagtgtgagtagtttgggtttgggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttccgccagacttccgagggaggcgcgtggaagtgggtctcagtttattactaccgcgtgggaacctacttctactcagactccgtgacgggcgattcatcatcnccagagacgtcgactaataatatgttgtatcttgacatagaacaagttgagagccgagaccacggcccttagtattagttgtgacggacgggtactaggttcggtaggggaagggaccggtcccgaccgggtcccccgtggaccggtaccggtcggggggaccccgggtaaccccgg

SEQ ID NO: 31123 - DNA, 555 bp, Homo sapiens
  misc_feature: GYAE6OF02HDYOH.41.78.H01.1.454.CMB.1.raw
  modified_base (421)..(421): a, c, t, g, unknown or other
  misc_feature (421)..(421): n is a, c, g, or t
  modified_base (498)..(498): a, c, t, g, unknown or other
  misc_feature (498)..(498): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttcgccagattccagggaaggcgctggaatgggtctcagttatttataccgctgggacaccttctactcagactcgtgaggggccgattcatcatctccagacgacgtcgccaataatattgttnttattcttgacatagaacaacttgagagacccgagaccacggtccctagtattagttgtagcgagggctaggttggngggtaggacggcccgaccgggcccctgggcctacggtcggggacccgggtaacccgg

SEQ ID NO: 31124 - DNA, 646 bp, Homo sapiens
  misc_feature: GYAE6OF02IZWC0.41.78.H01.1.454.CMB.1.raw
tcagtctatactatcacgaccggtgctcgatttagtgtgagtagtttgggtttgggggggaggaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccggggggtcctgagactctcatgtgcagcctctggtttaagtgtcagttagacactacatgagctggttcccgcccagacttccgaaggggaacggccgacgttgggaaacttggggtctcgaagtttatttagtaccgcgttagggaaccaccgtttctaacttcaagtacctccggtgacggggccgtaattcgagtcatcctacagacgacgtcgaccgaaataagtatgttgtaatcttgactatagaaactacttagaagtacgaccgacgaccgacggtacccttagtaactttagttcgtggtaccggaggggtaccgtaggtttggagggtaagggtacgggtacccggtaaccgggtccccggttacgggtaccgtaccgggtcggggggaccccgggttaaccccgg

SEQ ID NO: 31125 - DNA, 560 bp, Homo sapiens
  misc_feature: GYAE6OF02JAXDP.41.78.H01.1.454.CMB.1.raw
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
  modified_base (486)..(486): a, c, t, g, unknown or other
  misc_feature (486)..(486): n is a, c, g, or t
  modified_base (509)..(509): a, c, t, g, unknown or other
  misc_feature (509)..(509): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctgagactctcatgtgcagcctctggtttaagtgtcagtagacactacatgagctggttccgcagnttccagggaaggcgttggaatgggtctcagttattataccgntagggaacaccttctactcagactccgtgacggggcctagtcatcatctccagacgacgtcgacctaaataatatgttatatcttgactatacgaacaacgttgagacgccgacgacacggtccctgtacttattgtgngtacggcaggttggtaggacggnggcccgacggccccgtggaccgtacgggtcggggtacccgggaacccgtgg

SEQ ID NO: 31126 - DNA, 567 bp, Homo sapiens
  misc_feature: GYAE6OF02H9R03.41.78.H01.1.454.CMB.1.raw
  modified_base (434)..(434): a, c, t, g, unknown or other
  misc_feature (434)..(434): n is a, c, g, or t
  modified_base (519)..(519): a, c, t, g, unknown or other
  misc_feature (519)..(519): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagtttttggctgagctgcgttttccttgttgctattttaaaaggtgtccactgtgagatgtacctggtggagtctggaggcggcttgatccaggccgggggggtccctgagactctcatgtgcagcctcgtggttttaagtgttcagtagacactacatgagctggttccgccagatttccgagggaaggcgctgggaatgggtctctagttattataccgctgggaaccactttctactcacgactccgtgacgggccgattcgatcatctccagagactcgaccaattaatatgttntatcttgaacatagaactaacttgagacgaccgacgacaccggcccttgtattattgtggcgagggcgtaggttgtggggaaggngcccgacgggtcccctgggtcctacggtcgggggcccgggtaacccgg

SEQ ID NO: 31127 - DNA, 537 bp, Homo sapiens
  misc_feature: GYAE6OF02GNOW3.41.78.H01.1.454.CMB.1.raw
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
tcagtctatactatcacgaccggtgctcgatttagtgtgagtagtttgggtttggggggggaggaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttccgccagattccagggaaggcgctggaatgggtctcgagttatttanaccgctggaacnccttcactcagactcgngaggggccattcatcatctccagagacgtcgaccaataatatgttgtatcttgactatagaacacttgagacgccgacgacacgcctatattatgtgcgaggctggttgtggaggacggcccacggcccctggcctacggtcgggggacccgggtaacccg

SEQ ID NO: 31128 - DNA, 570 bp, Homo sapiens
  misc_feature: GYAE6OF02GLVK1.41.78.H01.1.454.CMB.1.raw
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
  modified_base (502)..(502): a, c, t, g, unknown or other
  misc_feature (502)..(502): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttccgccagacttccaggggaaggcgctagggaatgggtctctagttatttactaccgntagggaaccncctttactactcagactccgtggacggggcctattcgatcatcctccagacgacgtcgactaataatatgttactattcttgacatgaactaacttgaagtagccgacgacaccggccctgtatttagtgtggacgngggactggttgtgggaggacggcccgaccggcccgtggccgtacggtccggggggccgggtaaccccg

SEQ ID NO: 31129 - DNA, 554 bp, Homo sapiens
  misc_feature: GYAE6OF02FPR4M.41.78.H01.1.454.CMB.1.raw
  modified_base (494)..(494): a, c, t, g, unknown or other
  misc_feature (494)..(494): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggttaagtgtcagtagacactacatgagctggttccgccagattccagggaaggcgctggaatgggtctcagtttatttataccgctgggaaccacctttctactcagactccgtgacggggccattcatcatctcagagacgtcgcaataatatgttgtattcttgacatagaactaacttgagagccgacgacacgccctgtacttattgtgcggagggctaggttggngggaggacggcccgaccgggccccgtgggccgtacggttcgggggacccgggtaacccgg

SEQ ID NO: 31130 - DNA, 549 bp, Homo sapiens
  misc_feature: GYAE6OF02I6SUQ.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctgagactctcatgtgcagcctctggtttaagtgtcagtagacactacatgagctggttccgccagattccagggaaggcgctggaatgggtctcagttatttactacgctgggaactacctttctactcagacctcgtgaggggccattcatcatctccagagacgtcgaccaataatatgttgtatctttgactatagaacctaattcgaagacgcccgacgacaccgggtcctagtacttatgtgcgaggctaggttgtggaggtcgaccgaccggccctggcctacggtcggggacccgggtacccg

SEQ ID NO: 31131 - DNA, 698 bp, Homo sapiens
  misc_feature: GYAE6OF02HO49P.41.78.H01.1.454.CMB.1.raw
  modified_base (308)..(308): a, c, t, g, unknown or other
  misc_feature (308)..(308): n is a, c, g, or t
tcagtctatactatcacgaccggtgctcgatttagtgtgagtagtttgggtttggggggagaggagcccagcactgggactccgaggtgtttccattcggtgatcagcactgaacacagaggactcaccatggagttttggctgagctgtcgtttccttgttgcttatttaaaggtgtccactgtgagatgtacctggtggagtctggggagcggcttgatccgagccggggggtcctgagactctcatgtgcagcctcttggtttaagtgtcgtaagtagacacgtacatggacgcgtaggttcccnccaggacttaccggagggtaaggcgcgtggaagtcgggtctcgtagttatttataccgacgtagggtaactaccgtttactactactaagactccggtaggacggggaccgacgttcatccatcctaccgagaacgacgtcgaccaaagtaatatagttgtattcttaggactaagtacgaactaacgttagaaggtacgtacccggaacgaaccgtacccgggtccccttaggtttaaactttaacgtttcggtacgggtacggggtacgggtaccgttaagggtttcggggtaggggaacgggttaccgggacccgtacccgggtaccccgttacggggttacccgtttacccgggttccgggggggaccccgggttaacccccgggg

SEQ ID NO: 31132 - DNA, 673 bp, Homo sapiens
  misc_feature: GYAE6OF02I19A8.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccggggggtccctgagactctcatgtgcagcctctggtttaagtgtcagtagacactacatgagctggttcccgccagattccagggaaggcgctgggaactgggtctcgagtttatttagtaccgctgggaaccaccgtttctacttcagtacctccgtgacggggccattccatcgatcgtccagtagaccgtcgaccaattaaacgtattcggttgtaacttcgtttacgactaatcgaaaccaacgtttacgaagacgtaccccggaacgaacccgtaaccgggtcccccttaggttaactttacgttacggttcggacgggtaacggggtccgtaagggttttaggacggggtaacgggtacgggaccccgtaaccccggggtcccccgttggggtacccgtaacccgggtttcggggggacccccggggttaaaccccggg

SEQ ID NO: 31133 - DNA, 623 bp, Homo sapiens
  misc_feature: GYAE6OF02HI1DG.41.78.H01.1.454.CMB.1.raw
  modified_base (309)..(309): a, c, t, g, unknown or other
  misc_feature (309)..(309): n is a, c, g, or t
  modified_base (523)..(523): a, c, t, g, unknown or other
  misc_feature (523)..(523): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgctaattttaaaaggtgtccactgtgagatgtacctggtggagtctggaggcggcttgatccaggccggggggtccctgagactctcagtgtgcagccttcgtaggtttaagtgtcagttagacactacatgagctcggttcccnccagattccgagggaagcgactggaatgggtctgtaagttatttagacctgtacggacctaccgttctactcagtacctcggtagaggggcctattacgattcactctacgagagacgtccgacaaactattacgtgttataattcgttgaacattagaacctaacttgaacgtacgaccgtaacacgtaaccggtccctaggtacttgttagngtacgagggtaccgtaggttgggaggtacgggtacggaccgtacccgggtacccgtcgggtaccggtaccggtaccggggggtacccgggtaaccccggg

SEQ ID NO: 31134 - DNA, 741 bp, Homo sapiens
  misc_feature: GYAE6OF02GUSGU.41.78.H01.1.454.CMB.1.raw
  modified_base (263)..(263): a, c, t, g, unknown or other
  misc_feature (263)..(263): n is a, c, g, or t
  modified_base (302)..(302): a, c, t, g, unknown or other
  misc_feature (302)..(302): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggtagttttggctgagctgtcgttttccttgttgcttaattttaaaaggtgtccactgtgagatgtacctggtggagtcgtggaggcggcttgactccgagggcccgggggggtccctggacgactcctnatgtgcagcctcgtggtttaagtgtcagtagacactacntgagcgttcggttcccgccaagtacttacccgaaggggaacggccgcgtagggtaagtggggttcctacgtaagttttatttaacgtaccggtcgtacgggaaaccctaccgtttactacctacgaacgtaccgttccggtgggaacgggggtccctagtttccgaatcacttcctaccgaggacggaccgtccgacctaaagttaacttagttaggttagttacttcgttacgactagttacgaaactaacgttagaacggacgacccggtaaccgaaccgtacccggtacccttagttaactttagtttcgggtcggaccgggtagggtccgttaagggtttgggtaggggaacggggacccgggaccccgaccccggggtccccggttgggacccgttaaccgggggtcccggggggaccccgggttaaccccggg

SEQ ID NO: 31135 - DNA, 558 bp, Homo sapiens
  misc_feature: GYAE6OF02GJVOZ.41.78.H01.1.454.CMB.1.raw
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagccttctggtttaagtgtcagtagacactacatgagctggttccgccagattccagggaggcgctggaatgggtctcgagttatttataccgctagggaacacctttctacttcagactccgtggacggggccgattcatcatctccagagaccgtcgaccaataatatgttgtattcttgactatgaacaacttgagagcccgacggacaccggccctgtattattgtgacgagggctagttggtggagggcggccgaccgggcccgtggccgtacggtcgggggcccgggtaacccgg

SEQ ID NO: 31136 - DNA, 584 bp, Homo sapiens
  misc_feature: GYAE6OF02JAP3H.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccggggggtccctgagactctcatgtgcagcctctggtttaagtgtcagtagacactacatgagctggttccgccagattccgagggaaggcgctggaatgggtctctagtttatttataccgcttagggaactaccttctactcagacctccgtggacggggccgattcatcactctccagagacgtcgaccaataatattgttgtattcttagactatacgaaactaacttagagacgccggaacgaccgaccggccctgttactttagttgtcggcggagggtctaggttcggtagggagggacggccgaccggccccgtggtccgtacgggtccggggcccggggtaaccccgg

SEQ ID NO: 31137 - DNA, 628 bp, Homo sapiens
  misc_feature: GYAE6OF02GW0WQ.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctggagactctcatgtgcagcctctggtttaagtgtcagtagacactacatgagctggttcccgccagattccgaggggaaggcgcgtggaatgggtctcagtttatttataccgctaggaactaccttctactcagactccggtgacggggccattcatcatctccagacgacgtcgaccaataactagttgttatatctttgactatacgtaaactaacttgaagacggacccgacgaacccgaaccggtccccttaggttaactttagttcggttggtaccgggtagggtacgtagggtttggtaggggtacgggacggtcccgaacccgggtcccccgttagggtcccgttaaccggggtcggggggaccccggggtaaccccgg

SEQ ID NO: 31138 - DNA, 657 bp, Homo sapiens
  misc_feature: GYAE6OF02GONN5.41.78.H01.1.454.CMB.1.raw
  modified_base (410)..(410): a, c, t, g, unknown or other
  misc_feature (410)..(410): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttggactccgaggcccgggggggtccctggagacctcgtcatgtgcagcctcttggtttaagtgtcagtagacactacatgagctcggttccgcagtattccgagggaacgcgacgtggaagtgggtctacgtagtttagtttactaccgcgttagggaacctacctttactaccgtcacgtaccgttccggngacggggtacctattcgtactctactctaccgacgtagaccgtcgacctaaataatattgttgttaatcttagactatacgtaaactaacttgaagacgtacccggaacgaaccgtaccggtaccttacgttagttacgttgtcggtacgtagggtaccgtaggttcggtaggggacggtacggtcccggacccgggtccccgttgggtaccgtaccggggttccgggggtaccccgggtaacccgg

SEQ ID NO: 31139 - DNA, 663 bp, Homo sapiens
  misc_feature: GYAE6OF02HJI2S.41.78.H01.1.454.CMB.1.raw
  modified_base (304)..(304): a, c, t, g, unknown or other
  misc_feature (304)..(304): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgctaattttaaaaggtgtccactgtgagatgtacctggtggagtctggaggcggcttgatccgaggccggggggtccctgagactctcatgtgcagcctcgtggtttaagtgtcagtagacactacatgagctggttccnccagattccgagggaaggcgcgtggaagtgggtctcagtttatttacgaccgtgtacggaactacctttctacctcagtacctcggtaggacggggcctattcatccatcctccagtacgaccgtcgacctaaataactgttgttagtattcttagaactagtagaaactaacgttgaacgtacggacccgaacgaacgacccggcccttaggttactttaagttggtacggtcgggaaggggtccttaggggtttacggtaggggaacgggtaccgggaccccgaccccggggtacccccgttaggggtacccgttaacccggggttcccgggggggacccccggggttaaccccggg

SEQ ID NO: 31140 - DNA, 611 bp, Homo sapiens
  misc_feature: GYAE6OF02I9ZTA.41.78.H01.1.454.CMB.1.raw
  modified_base (576)..(576): a, c, t, g, unknown or other
  misc_feature (576)..(576): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctcgtggtttaagtgtcgagtagacactacatgagctcggttccgccagattcccgaagggaaggcgcgtggaatcgggtctcgtagtttatttactaccgcgtacgggaacctaccctttccttaacgtcaagtaccgtccggtaggacggggcctagttcactctactcctaccgaaggacgtaccgtcgacctaaattaattatgttagttattctttagactatacgaactattgagacgccgaacgacgccgtccctagttattagtgtcgcggtaggctagggttgagggaggcggccgacccggtcccgnggtccgtaccgggtcgggggaccccggtaacccgg

SEQ ID NO: 31141 - DNA, 589 bp, Homo sapiens
  misc_feature: GYAE6OF02IWRH9.41.78.H01.1.454.CMB.1.raw
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctatttttaaaaggtgtccactgtgagatgtacctggtggagtctggaggcggcttgatccaggccgggggggtccctgagactctcatgtgcagcctctggtttaagtgtcagtagacactacatgagctggttccgccagacttccgaggggaaggcgcgtggaatgggtctcgtagttatttagtaccgcgtggaacctaccttctactcagactcgtgaggggcattcatcatcctcagagacgtcgacaataactntgttntatcgttnacatagaacacttgagacgccgagaccgaccggcccttagtactttagtgtaggcgtagggtctagggttggagggtaacggaccggcccgtaacccggggtccccgtgggtacccgtaccgggtcggggggaccccggggtaaccccgg

SEQ ID NO: 31142 - DNA, 547 bp, Homo sapiens
  misc_feature: GYAE6OF02GW3MF.41.78.H01.1.454.CMB.1.raw
  modified_base (272)..(272): a, c, t, g, unknown or other
  misc_feature (272)..(272): n is a, c, g, or t
  modified_base (496)..(496): a, c, t, g, unknown or other
  misc_feature (496)..(496): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagngtcagtagacactacatgagctggttccgccagattccagggaaggcgctggaatgggtctcagtttatttataccgctgggaacaccgtttctactcagactccgtgacggggccattcatcatctccagagacgtcgaccaataatatgttgtattcttgacatgaacacttgagacgccgaacgaccgacggccctgtattattgtgcgagggcaggttgngggaggacggccacggcccctggcctacggtcgggggcccgggtaacccgg

SEQ ID NO: 31143 - DNA, 698 bp, Homo sapiens
  misc_feature: GYAE6OF02H9ZFZ.41.78.H01.1.454.CMB.1.raw
  modified_base (360)..(360): a, c, t, g, unknown or other
  misc_feature (360)..(360): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttaattttaaaaggtgtccactgtgagatcgtacctggtggagtcgtgggaggcggcttgactccgagggcccgggggggtccctggacgacttctcagtggtcgcacgtccttgttgggttaagtgtcaggtagaacactacagtagacgtcttcggttcccgcctaagtcgttacccgaaggggaaggccgngtaggtaagttcgggtctacgtaagtttatttacgaaccgtcggtacggaaccttacctttactactcacgaccgttccggtgggacgggtcctagttcaatcactccgacaggtacgaccgtcgactaaattaaactnttagttntaactctttacgaactagtacgaaactaacgttgaacgacgaccgtaacgacgacccgtccttagtaacttcgttacggcgtacggtacgggtcgtaagggtttcggagggtaaccgggaccggacccgttaccgggcccccgttgggtaccccggtacgggtccccggggggtaacccgggtaaccccggg

SEQ ID NO: 31144 - DNA, 588 bp, Homo sapiens
  misc_feature: GYAE6OF02FN4C7.41.78.H01.1.454.CMB.1.raw
  modified_base (263)..(263): a, c, t, g, unknown or other
  misc_feature (263)..(263): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctntggtttaagtgtcagtagacactacatgagctggttccgcagacttccgagggagcgctggaatgggtctcagtttattataccgtctgggaactacctttactactcagaccgtccgtggacggggctattcatcatcctcagagacgtacgaccaataatatgttagttatcttagactatagaaactacttagacgagtccgacgaacgaccgtccttagtatttagttgtcgacggagggtcgtggttggtagggaacgggacggtcccggaccggtccccggtggtaccgtaccgggtcgggggacccgggtaacccggg

SEQ ID NO: 31145 - DNA, 706 bp, Homo sapiens
  misc_feature: GYAE6OF02HLQ6Z.41.78.H01.1.454.CMB.1.raw
  modified_base (356)..(356): a, c, t, g, unknown or other
  misc_feature (356)..(356): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccgggggggtccctgagactctcatgtgcacgcctcgtggtttaagtgtcgagtagacactacatgagctggttccgccagacttaccgagggaacggcgctaggagtgggtctcgagtttactttanaccgtgtacggaacctaccttacgtacctcgacgacctccgggtggaacgggggtcccgtacttccacgttcctaacttaccgtacccgtaacggaacgtaccggtacccggaaccctaaaattaaacgttaacgttcggttttagttacgtttacgtttcggaacctagttacgtaaaactaccgtttaagaacggtaacggacccgaacgaccgacccggtacccttaggttaacttagtttcgtcggtacgggacgggtactacgggtttggacggggtagggaaccggtcccggacccggtcccggtcggtacggtacccggtcggggggaccccgggtaacccgg

SEQ ID NO: 31146 - DNA, 874 bp, Homo sapiens
  misc_feature: GYAE6OF02J28UL.41.78.H01.1.454.CMB.1.raw
tcagtctatactatcacgaccggtgctcgatttagtgtgagtagtttgggtttggggggaggaggagcccagcactgggactccgaggtgtttccattcggtgatcagcactgaacacagaggactcaccatggagttttggctgagctgcgttttccttgttgtctattttaaaaggtgtcctactgtgagatgtacctggtggagtctggaggcagtcttgatccgacgggcccgggggggttccctggacgacgtctccgatcgtgccagtccctagttggttaacgtgtacgagtacgacacgtacatgacgtcgtcggttacccgcagtacttaccgaggggaacggctcggtgggaacgtcgggtactcgtagtttattaacgtacccggacgtacgggtaaacctacccgttactaccgtacgtaccggtaacccgttccggggtacggtaacgggggtaccccgtaagttttccgaaacttccgtaaacgttcccgtaccgtaaacggtaaccgggaccggttacccggtaaacccctaaaaggttaaaccgtttaaggtttacggtttaacgtttaaaccgtttaccgtttttaaccgggaaacttaaccgtaacggtaaaacctttaaacccggtttagggaaccgtaacccggggtaccccgtaaaccggtaaccccggtaaccgggttacccccggtttaggtttaaaccttttgggtaacccggttagggtaccggggtaccggttaacccgggtagggtttacgggtacgggtaacccggggtaccggtcccgggtaaccccggtcccgggttacccgggtaccgggttaccggggtcccccgggggtaaaccccggggg

SEQ ID NO: 31147 - DNA, 791 bp, Homo sapiens
  misc_feature: GYAE6OF02GXM9U.41.78.H01.1.454.CMB.1.raw
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtcgtggaggcggcttgatccgaggcccggggggggtccctggagacctctcatggtgcacgcctcgttaggtttaagtgtcagtagacactacatgagctcggttccgccagtacttccgaaggggacggcgcgtagggaagttcgggtctcgtagttttatttactaccggtcgttacgggaacctaccgtttactaccgtacacgaccgttccgggtagggacggggtacccgtaattccgaactactacttcctacccgaacggtacgtaaccggttcccgaaccctaaaattaaacgttaagtttaggtttacgttactttacgtttacggaactaagttaacgtaaactaaaccgtttaggaacggtaaccggacccggaaaccgaacccggtacccgggtacccgtttaggtttaactttacgtttacgggtggtaccggggtagggtaccggttaaggggtttacgggtacggggtaacgggggtaacgggtaccccggtacccggggtccccccggttagggtaccccggtaacgggggtttacccgggggggacccccgggggttaaacccccggg

SEQ ID NO: 31148 - DNA, 572 bp, Homo sapiens
  misc_feature: GYAE6OF02I93NA.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccggagggtccctgagactctcatgtgcagcctctggtttaagtgtcagtagacactacatgagcttggttcccgccagtacttccgaggggacggcgcgtaggaagtgggtctcgtagtttatttagtaccgcgtgggaacctacttctactcagactccgtgacgggtcctattcatcatctccagacgacgtcgactaataatatgttagttattcttgactatacaactaacttgagacgaccgacgaccgaccgcctagtattattgtgacggaggtcgtgttggtagggaggacggtaccgccggtcccgtcggacgtaccgggtcggggtaccccgggg

SEQ ID NO: 31149 - DNA, 553 bp, Homo sapiens
  misc_feature: GYAE6OF02GS98J.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctgagactctcatgtgcagcctctggtttaagtgtcagtagacactacatgagctggttccgccagattccagggaaggcgctggaatgggtctcagttatttataccgcttagggaacaccgttctactcagactccgtgagggccgattcgatcatctccagagacgtcgaccaataatatgttgtatcttgactatgaacaacttgagtagccgaacgacgaccggccctagtaattattcgtgcgagggctaaggtttggaggaggaggacccgacggcccctggcctacggtcgggggccgggtaacccg

SEQ ID NO: 31150 - DNA, 613 bp, Homo sapiens
  misc_feature: GYAE6OF02I5QCJ.41.78.H01.1.454.CMB.1.raw
  modified_base (343)..(343): a, c, t, g, unknown or other
  misc_feature (343)..(343): n is a, c, g, or t
  modified_base (375)..(375): a, c, t, g, unknown or other
  misc_feature (375)..(375): n is a, c, g, or t
  modified_base (401)..(401): a, c, t, g, unknown or other
  misc_feature (401)..(401): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccgggggggtccctgagactctcatgtgcagcctctggtttaagtgtcagtagacactacatgagctggttcccgaccagtacttccggaggggaaggcgctaggaatgggtctntagttatttataccgcgtggaacacttctacncagactcgtgagggcattcatcatcncagagcgtcgaccaaatatatgtgttatcttagactatacgaaacctaacgttgaagacgcccgtaacgacacccggtccctagttaatttagtcgttacggacggagggtactagggttttggacgggaacggtaccgggcccgaacccgggtcccccggtagggccccgttaaccggggtcccggggggggacccccgggttaaacccgg

SEQ ID NO: 31151 - DNA, 640 bp, Homo sapiens
  misc_feature: GYAE6OF02GJ0OQ.41.78.H01.1.454.CMB.1.raw
  modified_base (457)..(457): a, c, t, g, unknown or other
  misc_feature (457)..(457): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctcgttggtttaagtgtcagtagacactacatgagctggttccgcagattccgagggaaggcgcgtaggaagtgggtctcgtagtttatttacgtaccgcgttacgggaacctaccgtttctactcacgtaccgtccggtagggacggggtccgtattcgactcactcctaccaggtacgaccgtcgaccaaataatnttagtgttattcttagactatacgtaactaagttgaggtacgaccgaaccgaccgaccgggtcccttgttaactttagttggtcgacggtacgggtctaagggttggtaggggacggaccgggtacccgaccgggccccgtagggacccgttacgggtccgggggaccccgggttaaccccgg

SEQ ID NO: 31152 - DNA, 668 bp, Homo sapiens
  misc_feature: GYAE6OF02HFXXR.41.78.H01.1.454.CMB.1.raw
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaaagtgtcagtagacactacatgagctggttcccgccagattccagggaaggcgctgggaatggggtctcagttatttataccgctgggaactaccgtttctactcagactcgtgacggggccattcatcatctccagagacgtcgaccaataatagtgttgtattcgtttagactagttacgaaactaacgtttagaggtacgacccgtaacgaccgtaaccgggtccccttaggttacttaagtttggtacggaccggtagggggtaccgtaagggtttacggttacgggggtaacgggtaacggggtccccgtaacccggggggtcccccccgttaggggtacccgttaacccggggttccggggggggtacccccgggggttaaaccccccgggg

SEQ ID NO: 31153 - DNA, 684 bp, Homo sapiens
  misc_feature: GYAE6OF02JDXGC.41.78.H01.1.454.CMB.1.raw
  modified_base (253)..(253): a, c, t, g, unknown or other
  misc_feature (253)..(253): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgtttccttgttgctattttaaaggtgtccactgtgagatgtacctggtggagtctggaggcggcttgatccaggccgggggggtccctgagactctcatgtncagcctctggtttaagtgtcagtagacactacatgagctggttccgccagattccgagggaggcgctggaactgggtactcgtaagtttatttactaaccggcgtacgggaaacctaccctttcgaccttaccaaggtactcccggttgggaacgggggccctaagtttccagtctaactctaccgaggacgtacggtccacctaaagtaataatcgttgtaattcttagactatagtaaacaacctttggaacgtacggacccgtaaacgaccgtaccgggccccttaaggttaacttaacgttcgttaagggcccggtaaggggtacctaagggtttacgttagggggacgggttaaccggcccggtaacccgggtaccccggtcgggtaccggtaacccggtcgggggggaacccccggggtaacccg

SEQ ID NO: 31154 - DNA, 670 bp, Homo sapiens
  misc_feature: GYAE6OF02HDG2A.41.78.H01.1.454.CMB.1.raw
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccggggggtccctgagactctcatgtgcagcctctggtttaagtgtcagtagacactacatgagctggttccgccagattccgagggaggcgctggaatgggtctctagtttatttataccgcgtagggaacctacctttctacttcacgacttccggtgacgggggtcctattcgactcactccttccgagacgacggtccgacctaaagttaatagttgttaggttacttcgtttacgtaacacgttacgaaacctaacgttgaaggtacgccgaacgaccgtaaccgggtccccttaggttaactttagttggttacggacggtacggggtcgtaagggtttggtagggggtaacgggacgggtaccccgtacccggggtcccccgtaggggtccccgtaacccgggttcggggggtacccccgggggttaacccccggg

SEQ ID NO: 31155 - DNA, 727 bp, Homo sapiens
  misc_feature: GYAE6OF02IQS8N.41.78.H01.1.454.CMB.1.raw
tcagtctatactatcacgaccggtgctcgatttagtgtgagtagtttgggtttgggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggcccggggggggtccctggagactctcatgtgcagcctcgtggtttaagtgtcagtagacactacatgagctggttccgccagacttccgagggacggcgcgtaggaagtgggtctctagtttatttacgtaccgcgtacgggaacctacctttctacctcacgtaccgtcgtggacggggcctattcatcatctaccaggacgacgtccgacctaaattaactagttgttagttattcgttacgactaatagtaaacctacgttagaacgtaaccggtacccgaacggtaacccgacccggggtacccctttaggttaaacgtttttaacggtttcggtacgggtaccgggtaaacggggtccggttaagggtttcgggggtaacggggtaaccggggtaaccggggtcccccgaacccgggggttcccccggttcggggtacccggttacccgggggttacccgggggggggtacccccggggttaacccccgggg

SEQ ID NO: 31156 - DNA, 584 bp, Homo sapiens
  misc_feature: GYAE6OF02I7H3P.41.78.H01.1.454.CMB.1.raw
  modified_base (275)..(275): a, c, t, g, unknown or other
  misc_feature (275)..(275): n is a, c, g, or t
  modified_base (340)..(340): a, c, t, g, unknown or other
  misc_feature (340)..(340): n is a, c, g, or t
tcagtctatactatcacgaccggtgctcgatttagtgtgagtagtttgggtttgggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtcgtggaggcggcttgatccaggccgggggggtcctgagactctcatgtgcagcctcgtggtttaagngtcagtagacactacatgagctcggttccgccagacttccgagggaaggcgctggaatgggtctntagttattacgtaccgcgtgggaacctccttctactcgagactccgtggacggggcctattccgatcatctaccagacgacgtcacaataatatgttgtattctgactatacaactagttgaacgacgacccgagaccgaccggtccttgtaatttctgtcgcggaggtcgtaggtttggagggagggacggacccgaccgggtcccgtagggtccgtacgggtccggggcccgggtaacccgg

SEQ ID NO: 31157 - DNA, 602 bp, Homo sapiens
  misc_feature: GYAE6OF02JYGYH.41.78.H01.1.454.CMB.1.raw
  modified_base (368)..(368): a, c, t, g, unknown or other
  misc_feature (368)..(368): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccggggggtccctgagactctcatgtgcagcctctggtttaagtgtcagtagacactacatgagctggttccgccagacttccgagggaaggcgctggaatgggtctctagtttatttataccgcgtacggaactacccttntacctcagtacctccgtggacggggcctagttacattcacttctccaggagaccgtcgacctaataatattgttgtattcttgactaatcgaactaacttgaagacgaccgaacgtaccgaccgtccctagttacttagttgtcggacgtaggtacgtaggttggagggaggaccggaccgtaccgggtaccccgtgggaccgtaacgggtccgggggaccccgggtaacccgg

SEQ ID NO: 31158 - DNA, 892 bp, Homo sapiens
  misc_feature: GYAE6OF02HXM4I.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccggggggtccctgagactctcatgtgcagcctcttggtttaagtgtcagtagacactacatgagtctcggttcccgaccgtagtacgttaccgaaggggaacggcgacgtaggtaagttggggttaccttacgtaagtttaacttttaacgtaccggtaccgtaacgggtaacctaacccttttaccgtaacttaccgtaacggtaccttacccgggttagggaccggggggtacccgtaagttttaccaacgtttacccgtacgtttacccgtacccgtaagggtaaaccggtaaccccggtacccgggtaaaccccttaaaagtttaaaacgttaacgttttagggttttaacgtttaagttaccgttttaggaaccttaaacgttacggtaaaaccctaaaacggttttaggaaaccggtaacccgggacccggtaaacccgggtaacccgtaacccgggtaccccgtttaaggtttaacgttttaacggtttacgggttaccgggtacggggtaaccggggtccggtaagggttttcgggtaacggggggtaacggggtaccggggtaaccccgtaacccgggggtccccccggttacggggttaccccggtaaccgggggttaccccggggggggtacccccgggggttaacccccggg

SEQ ID NO: 31159 - DNA, 649 bp, Homo sapiens
  misc_feature: GYAE6OF02GSJU4.41.78.H01.1.454.CMB.1.raw
  modified_base (339)..(339): a, c, t, g, unknown or other
  misc_feature (339)..(339): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctcgttggtttaagtgtcagtagacactacatgagctggttccgcagacttccgagggaaggcgcgtggaagtgggtctntagtttatttactaccgcgtaggaacctaccttctactacagtaccgtccggtggacggggcccgtattcgactctactccgtccaggacgaccgtaccgacctaaattaatagttgtttacgtattccgttagactagtagaaacctagttagaacgacgacccgaagacccgacggtcccttagttattacgttgtacggtcgggagggtccggtaaggtttgggtaggggaagggtaccggcccggtacccgggtcccccgtagggacccttaccggggtcgggggggacccccgggttaacccggg

SEQ ID NO: 31160 - DNA, 651 bp, Homo sapiens
  misc_feature: GYAE6OF02FS1DL.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccgggggggtccctgagactctcatgtgcagcctctggtttaagtgtacagtagacactacatgagtctggttcccgcagattccgagggaaggcgcgtaggaagtcggggtcttcgtaaggttttaattttaacgtacccggtcgtacgggaaaccctaccctttccttaaccgtcacggtaactcccggtgggaacggggcccgtattccgattcacttcctaccgagtacgaccgtcccgaccaaataattactgtttagtattccttagacattacaactacgttagagaccggtccgacgacgacccgtccttgtaacgttattgtcggacggaggtccgtaggttggtagggacgggtacggacccgaccggtccccgtgggaccctaccgggtccgggggtacccgggtaccccgg

SEQ ID NO: 31161 - DNA, 654 bp, Homo sapiens
  misc_feature: GYAE6OF02JM01S.41.78.H01.1.454.CMB.1.raw
  modified_base (312)..(312): a, c, t, g, unknown or other
  misc_feature (312)..(312): n is a, c, g, or t
  modified_base (337)..(337): a, c, t, g, unknown or other
  misc_feature (337)..(337): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
tcagtctatactatcacgaccggtgctcgatttagtgtgagtagtttgggtttggggggggtaggagggaggcccagcactgggactccgaggtgtttccattcggtgatcagcactgaacacagaggactcaccatggagtttggctgagctgcgttttccttgttgtctattttaaaggtgtccactgtgagatgtacctggtggagtctggaggcggcttgatccaggccggggggtccctggagactctcatgtgcagcctctggtttaagtgtcgagtagaacactacatgagctggttcccgcagntccgaggagcgcgtggaatgggtcntagttattanccgngtagggaacctaccgtttactacctcgacgtaccgtccgtagggacggggcccatttcagttcctatcctaccagacgtaccgtacgaccctaaattaacgtattagttcttattcgttagactatagtaacctaatttacgaagacgaccgacgaaccgtaccggtacccttagttaactttacgttggtcggtacgggtacgggtcgtaacgggtttggtacggggtacggtacgggaccccgacgggtcccccttaggggacccgttaccggggtccgggggtacccgggtaaccccggg

SEQ ID NO: 31162 - DNA, 565 bp, Homo sapiens
  misc_feature: GYAE6OF02GFB67.41.78.H01.1.454.CMB.1.raw
  modified_base (349)..(349): a, c, t, g, unknown or other
  misc_feature (349)..(349): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
  modified_base (494)..(494): a, c, t, g, unknown or other
  misc_feature (494)..(494): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttcccgcctagattccgagggaaggcgctggaatgggtctcgagtttatttanaccgctgggaactacctttctactcagactccgngnggggccattcatcatctccagacgacgtcgaccaataatatgtagtattctagactatacgaactaacgttgaagacgccgaacgacgaccggtcctgtattatgtcgngacgggctaggttgtagggtaggacggccgaccggcccgtggccgtacggtcggggacccgggtaacccgg

SEQ ID NO: 31163 - DNA, 579 bp, Homo sapiens
  misc_feature: GYAE6OF02GC93G.41.78.H01.1.454.CMB.1.raw
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctatttttaaaaggtgtccactgtgagatgtacctggtggagtctggaggcggcttgatccgaggccgggggggtccctggagactctcatgtgcagcctctggtttaagtgtcagtagacactacatgagctggttccgccagattccagggaagcgctggaatgggtctcagttattataccgctggaacnccttctactcagctcgngagggccatcatcatctacagagacgtcgcccaagtaatatgttatattcttagactatagaactaacttgaagagccgacgacgaccggccttagtacttagttcgtggacgtagggtactagggtttggtaggggaaggtacgggcccgaccgggcccccgtagggcccgtacgggtcgggggacccggggttaacccccgg

SEQ ID NO: 31164 - DNA, 685 bp, Homo sapiens
  misc_feature: GYAE6OF02JARYP.41.78.H01.1.454.CMB.1.raw
  modified_base (354)..(354): a, c, t, g, unknown or other
  misc_feature (354)..(354): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccggggggtcctgagactctcatgtgcagcctcgtggtttaagtgtcagtagacactacagtgagcttggttcccgccagattccgagggtaaggcgcgtggaacgtgggtactcgtagttatttanaccgctagggaaccacctttcaacctcgtacgaccgttccgtaggacggggacctaattctacgttcaacgtttccacccgaaggtacgtacccgtaccgacctaaattaaacgttagttagtttacgtaagttctttaggaacctagtaacgaaactaacgtttgaaagacggtaacccgaaccgaaccgtacccgggacccttaggttaccttttagtacggtcggacgtaacggggtcctaaagggtttggacgggtaagggcccggtaccgaccgggtccccgtccggtaccggtaaccggttcccgggggacccgggtaaccccgg

SEQ ID NO: 31165 - DNA, 611 bp, Homo sapiens
  misc_feature: GYAE6OF02JSBR8.41.78.H01.1.454.CMB.1.raw
  modified_base (300)..(300): a, c, t, g, unknown or other
  misc_feature (300)..(300): n is a, c, g, or t
  modified_base (338)..(338): a, c, t, g, unknown or other
  misc_feature (338)..(338): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccggggggtccctgagactctcatgtgcagcctcttggttaagtgtcagtagacactacatgagctggttccnccagattccgagggaacggcgctggaatgggtctacgngttatttagtaccgctacgggaactacctttacgtactacagtaccgtccgtggacggggccgtagttcatcgatcctacgagtacgaccgtcgacctaaatactagtgttagtactcttagtacatagaactactagacgacgtaccggacgacgaccggccttagtaacttagtacgtgcggtagggtaccgtggttacggtagggacggtacggtccgaccggtcccgtcggtaccgtaccgggttcgggggacccggggttaaccccgg

SEQ ID NO: 31166 - DNA, 726 bp, Homo sapiens
  misc_feature: GYAE6OF02F4OOF.41.78.H01.1.454.CMB.1.raw
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgagggcccggggggtccctgagactctcatgtgcagcctcgttggtttaagtgtcagtagacactacatgagcgttcggttcccgccagtacttccgaaggggaacggcgcgtaggaagtcgggtctcgtaagttttactttacgtacccgtcgttacgggaaacctacccgttttactaccttacgaacgtaccgttcccgggtaggggaccgggggtccctagtttaccacttactacttcctacccgaaggtaacggaccgtaccgaacctaaattaaattagttgttacgttattcgttagactaagtacgtaaacctaacgttagaacgacgacccggaacgaccgacccggtcccgttagttaatttagttcggtacggtacgggacgggtcgtagggtttggtaggggaacgggaccggacccggtacccgggtccccggttacgggacccggttaccggggtacccgggggggtaccccgggttaaccccggg

SEQ ID NO: 31167 - DNA, 596 bp, Homo sapiens
  misc_feature: GYAE6OF02HKT5B.41.78.H01.1.454.CMB.1.raw
  modified_base (359)..(359): a, c, t, g, unknown or other
  misc_feature (359)..(359): n is a, c, g, or t
  modified_base (508)..(508): a, c, t, g, unknown or other
  misc_feature (508)..(508): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctggttccgccagacttccgaggggaaggcgcgtggaagtgggtctcgtagtttatttactaccgngtacgggaacctaccttctactcacgacgtccgtggacggggcctatcatcatcctaccagacgacgtcgacctaaataactattgttgtattcttgactatagaactacttgagacgccgacgacgaccgtcctagttacttagttgngacggaggtcgtaggttggtagggagggaccggccgacccgggccccgtagggtaccgtaccgggtcgggggacccgggtaaccccgg

SEQ ID NO: 31168 - DNA, 829 bp, Homo sapiens
  misc_feature: GYAE6OF02IX87X.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgtttttccttgttgtcttaattttaaaaggtgtccactgtgagatgtactggtggagtcgtggaggcggcttgactccaggccggggggtcctgagactctcatgtgcagccttcgttaggtttaagtgtacagtacgacacgtaacagtagagcgtcggttcccgaccagtacttcccggaaggggaaaggccgacgtagggaagttcgggtacgttactaacggttttaatttaacgtaacccggtacggttacgggaaaaccctacccttttacgttaaccctaccgtaacggtaaccgttacccgggtacgggaacgggggtacccgttaagtttacccaatttaccccgtaattacccgtaacccgtaaacggaaccggttaccggttaacccggtaaccctaaaaaagtttaaaacgttaacgtttagttacggtttaaacttcgtttacgtaaacctagttaaacgtaaaccttaaacgttaggtaacggaacgtacccggaaaccggacccgtaccgggtaccccgtttaagtacttttaaggtcggttacggcgggtaagggtccgtaagggttaggtacggggaacgggaccggtacccgaccccggggtcccggttcgggaacccggttcgggggttaccgggggaccccggggttaacccccggg

SEQ ID NO: 31169 - DNA, 675 bp, Homo sapiens
  misc_feature: GYAE6OF02G5NXZ.41.78.H01.1.454.CMB.1.raw
  modified_base (372)..(372): a, c, t, g, unknown or other
  misc_feature (372)..(372): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgtcgttttccttgttgcttaattttaaaaggtgtccactgtgagatgtacctggtggagtctgggaggcggcttgatccgacggccgggggggtccctgagactctcatgtgcagcctcgtggtttaagtgtcagtagacactacatgagctcggttccgccgagtacttccgaaggggaaggcgcgtaggaacgtgggtctcgtagtttattacgtaccgngtacggaacctacctttctacctacgacgtaccgtccgtgggacggggtcctatttcattcactcctccaggacgaccggtccgaacctaaataattattagttagtacttcgttagtactagtactaaactaacgttagaacgacgtaccgaacgtaccgaccgggtcccttaggttactttagttcggtacggacgggacgggtacggtggttagggttaggggaaggtaccgggtacccggtacccggtccccgtagggtacccggtacggggttcccggggggacccgggtaaccccgg

SEQ ID NO: 31170 - DNA, 776 bp, Homo sapiens
  misc_feature: GYAE6OF02HF7GL.41.78.H01.1.454.CMB.1.raw
  modified_base (306)..(306): a, c, t, g, unknown or other
  misc_feature (306)..(306): n is a, c, g, or t
  modified_base (321)..(321): a, c, t, g, unknown or other
  misc_feature (321)..(321): n is a, c, g, or t
  modified_base (376)..(376): a, c, t, g, unknown or other
  misc_feature (376)..(376): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccgggggggtcctgagactctcatgtgcagcctcgtggtttaagtgtcagtagacactacatgagctggttccgcagnttccgagggaggcgngtggaagtgggtctcgtagtttatttacgtaccgtgttacgggaactaccgtttnaccgttacagtaaccttccggtagggaacggggtccgtaatttcgaacgttctactaccgtcccgaaggtaccggtaacggtcccgaaccgtaaacttaaattaagtttggtttagttaacttttcgttaacggaacttaagttaacgaaaccgtaaacgtttagaaggtacccggacccggtaaaccggacccggtaaccgggtacccccgttaaggttttaaacgttaagtttacggttacggccggggtaaacgggggttcgtaacggggttttggggttaacgggaacgggggtaaccgggtacccccggtaacccggggcccccgggttacgggttaacccggggttaaccccggggttccgggggggtacccccgggggttaaaccccccgggg

SEQ ID NO: 31171 - DNA, 780 bp, Homo sapiens
  misc_feature: GYAE6OF02I3N9V.41.78.H01.1.454.CMB.1.raw
  modified_base (186)..(186): a, c, t, g, unknown or other
  misc_feature (186)..(186): n is a, c, g, or t
  modified_base (195)..(195): a, c, t, g, unknown or other
  misc_feature (195)..(195): n is a, c, g, or t
  modified_base (269)..(269): a, c, t, g, unknown or other
  misc_feature (269)..(269): n is a, c, g, or t
tcagtctatactatcacgaccggtgctcgatttagtgtgagtagtttgggtttgggggggggagaggagcccagcactgggacctccgaggtgtttcctattcggtgtatctagcactgaacacagaggactcaccatggagttttggctgaggctgtcgtttccttgttgtcttatttaaaggtntcctatgtnagatgtactggtgagtctggagtcggcttggacgtccgagggtccggggggtccctggacgtcgtctcatcgtncacgtcctcgttggtttaagtcgttacaggttacgtactaccgtactagtcgacgtcgttcggtcccgtaccgtacggtacgttccggaagggacggtccggtcgtagggacgttcgggtacctcggtaggttttacttacgtaccgtggttaacgggtaaacctaccgtttacgtaccgtacgtaacgtaccgtccggtagggaccggggtcctacgtttaccgacttcgtacctcctaccgacgtacgtaccgtccgaactaaactaacttacttaaggttacttaacgttctttacgaacgttacgtaacgtaactaacgtttaagaaccgtaacggtacccgtaacgaccggtaccgtaccgttacgtttaacggttagttccgttaggtaccgggttacgttacggttaaggttacggacggggtaacgggtaccggacccggtcccgggtccggtaccgggtaccggtacccgggggtaccggggtaacccccggggttacccgg

SEQ ID NO: 31172 - DNA, 673 bp, Homo sapiens
  misc_feature: GYAE6OF02F21D5.41.78.H01.1.454.CMB.1.raw
  modified_base (465)..(465): a, c, t, g, unknown or other
  misc_feature (465)..(465): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccggggggggtccctggagactctcatgtgcagcctctggtttaagtgtcagtagacactacatgagctggttccgccagtacttccgaggggaacggcgcgtagggaatcggggtcttcgagtttatttactaccgcttacgggaacctacctttctactcgagacctccgtggacggggccgattcatcgatcctaccagacgacgtcgaccaataatatgttgtacttctgactntagaactaacgttgaacgacggcccgaaccgaacgacccgggtacccttagttaactttaagttcggttacgacgggtaacggggtccgtaagggtttgggtagggggtaacggggaccgggtacccggtaccccggggtccccccggttagggaccccggttaacggggttacccggggggggacccccgggggttaaacccccggg

SEQ ID NO: 31173 - DNA, 654 bp, Homo sapiens
  misc_feature: GYAE6OF02HQMS5.41.78.H01.1.454.CMB.1.raw
  modified_base (490)..(490): a, c, t, g, unknown or other
  misc_feature (490)..(490): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggtagttttggctgagctgcgttttccttgttgctaatttttaaaaggtgtccactgtgagatgtacctggtggagtctggagggcggcttgatccgagggcccgggggggtccctggagactctcatgtgcagcctcgttggttttaagtgtcagtagacactacatgagcttcgggttccgccagtacttaccgaggggaacggcgcgtgggagtgggtctcgtagtttatttacgtaccgcgtacgggaactacctttctactactacgactccggttggaggggtccctattcatcactctacccgagacgacgtcgacctaaataactattgttacgtattcttagacctanacgtaaactacgtagtagacggaccgaaccgaccgaccggtaccttgttaattagtttcgacgtacggtacgggtctgggttggagggagggtacccggacccggaccgggtcccccgtacgggtacccgttaccggggccggggggtacccggggtaacccgg

SEQ ID NO: 31174 - DNA, 967 bp, Homo sapiens
  misc_feature: GYAE6OF02FIES2.41.78.H01.1.454.CMB.1.raw
  modified_base (857)..(857): a, c, t, g, unknown or other
  misc_feature (857)..(857): n is a, c, g, or t
tcagtctatactatcacgaccggtgctcgatttagtgtgagtagtttgggtttggggggagaggagcccagcactgggacctccgaggtgtttccattcggtgatcagcactgaaccacagaggacctccacccatcggtagtttttcggctgagtcttgttccgttttaccttgttagtaccttaacgttttaaaaacgggtctaccctaactgttagacgtacttcggttaacccgtgggtacggtacgttcgtcgggacgggtccggtcgttacggaccgtcccgaccggggtcccgggggttcctcggtacctccgtcctcgacgttcgtccgtaccgtacgttacccgttaggtttaacggttaaccttacgtaccgtaaccggttaaccaaccccgtaccgttaacgacggttacggtaacccggtttccggttaccccgtaccccggtacgtaacggtaccgtaaccggggtaacgggtacggtccggtacggttaacggttaccggtttaccggttaaccgttaaccggtttaacgttttaaccgttaacccggtacccgggttaaccggttaacccggtaacccttacccgttaccgttaccggtaaccgtaacccggtttacccgggtacgggtaaccggggtaccggttacccttaccttaccgtaaccgtacccgtacgttaccccgaacgggtaacgtacccgttacccggtaaacttaaccttaaagttacgttacgttaccgtttaacgctttaacggacctaacgtaccgtaactcccggtacgaacggtacccggaccgtaaccggtacccgtaaccgttaccgtttagtagtttacggngaccgggtcggtacggcgttaaccgggtcggtaccgggaccggttaacccgccgaccccgggtcgggaccttacccgggttaccgggaccgggttcccggtacccgtccg
